United States Patent 7,833,706 (GENETIC POLYMORPHISMS ASSOCIATED WITH RHEUMATOID ARTHRITIS, METHODS OF DETECTION AND USES THEREOF) - sequence listing, part 3

SEQ ID NO: 10579 - DNA, 107507 bp, Homo sapiens
  misc_feature (1)...(107507): n = A,T,C or G, or insertion/deletion polymorphism (see Tables 1-2)
cagttgctgtgtgagggccaaggctgtgttggccaggagcccagggaggtggcagctgtctcgtcgccaagttcgccccttcacacacccccccaagagcctttcatggtcttttgctgccttataggggacagccagcagcttgttgggaggatgagatggtcccttggggcctgtggaaggagcctggggcccccattgttgtgaagtcttgtctgatgtgctgaatctcaggcaagactttcagccctgagagtcccctacccccaccctgggatgcagccccaggcttgaatttgtctacctgtcttaggtggcaaagccctgatcacactgtgggtggccccgccaggtctctctgcaagatgccccctgtctgctgaagtccttgctgttttctagggcagtgggctctagccttatgtttgcggggaaagggaggagcaggccaagtaggggctaccttcatactgtgatgcacaggagtgctgggagctggaagacaatgtccctgggctaaggggcagcggagagccttgacaataagagtttctcaaggaggccctctcagtcccaacagttttgacccctttcttccctccactctccccagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacggtgagttatctgttctcagcttcccagacagcctaggcttgcgtctatgtgagaattgatccaagaaggtgctaggatggggcttctgggtagaggaaacagcatagcagatgatgggtttcttttcagcagacaggtgtttggcacctgttgtgagccaggacctgtgctaggctctgatagtgcagtgatgaatgagacatgagattgcatccttctcagtactcagggtgtcacagggacgctatgcagttaacgggtgggaggttgaggttggggctatagcctggggtatgagggatgggtgggaatggcaccatcagagtcaggatttgcccgggaccactaggggacaagccaggtcagatagtggaagactccagggacagtatgggctacagttggcatgatacttgctgggaatggatactctcagacagttatttcttcagctctgctatgaacaaggaatagctggaacactgggtaaaatacagaaatcctgagtaaaattcagtgatccctcgccatccaggtgattccgaggcaggtgacccagccatgacacttgaagattgcctagaaaagcagacctaactctctcagaaagcctctattaagactcaagagtcaatagctttataaaaagagaaaataatttttaaaatgttttacgaagtgtttcttctaccaccactccttttaaaaatgtagaattgtaatattttgttttctgaaaagtgagcccaaatttgagataaggtcatcacctagtgttattcagtcttggctttcattagaaatgttttttgaaagacatttgattttggacggtattcactagaagtgctctgtggccatttctgaatttgagtagctgacatacatactttgttcaaactttattaccaagtaaaaccattgacttttaaaagccctcaagtgcagaggtttgagttcatcatactttccagttcaaggtaggtttctgtcataggtcagcaaaaggcttcctcttgtcatgtttattttttcatttttattcccaattcccacctctgtgggcagctgctctgtcgtgtttgatatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatcatagatttatcatatagatcattttcatataaatgtatcatatagatacatgtatcatataaatacatacataaatgtatcatatagatacattttcatagaaaatgaaaatatgaagtgttgttttgagtgactgtgttttcagttgacacacatggcatggtgccacagtcttcgttttgtttcctgaactttgtattactcagagtgggaggttttttttgttttttgttttttgttttgagacagggtgtctctatgttgcccaggctggtctcaaactcctgggctcaggcaattctcctcccttggcctcccaaagtgctgggattaaaggcatgagccgctgtaactggccaacagtgctgtttttttttgtttgtttgttttgttttgttttgtttctttgttttgagaaagagtttcactcttgttgcccaggctggagtgcaatggcgcagtcttggctgaccacaacctctgcctcccggtttcaagcgattctcctgccttagcctcccacatagctgggatttcaggcatgtgccaccacgcctggctaattttgtatttttagtagagatggggtttctccatgctggtcaggctggtctcgaactctcgacttcaggtgatcctcccatcttggcctcccaaagtgctgggattatgggcatgagccaccacacccggcacagtgctgtatttttaacatctgtctgtattgccatgtatatgttactactttgtttctaattgctggcaagggcatcatggggcatgtctactgagttttacttaatacttcccccaagagtagatgcctgttgttaattttgatgtgctagcatcattttttttttttttttttttgagacggagtttcgctcttgttgcccaggctggagtacaatggcgcgatctcggctcaccacaacctccacctcccaggttcaagcaattctcctgcctcagcctcccaagtagctgggattacaggcatgcgccaccacgcccagctaattttttgtatttttagtagagatggggtttctccatgttggtcaggctggtctcgaactcctgacctcaggtgatccgcccgcctcggcctcccaaagtgttgggattacaggcgtgagccaccgtgcccagcccaacgtcaccttttttgctttatctgttaatgtatagtgttttttgtttgtttgtttgtttgttttgagatgagtctcgctctgtcacccatgctggagtgcagtggcacgatctcggctcactgcaaacttcgcctcccgggttcacaccattctcctgcctcagcctcccgagtagctggtgctacaggcgcccgccaccacacctggctaattttttgtatttttagtagagatggggtttcactgtgttagccaggatggtctcgatctcctgacctggtgatccacccgccttggcctcccaaaatgctaggattacaggtgtgagccactgcgcccagcctaatgtagtttttaccttttgcattcagatctttaatccatctagattccactcttgaatatggcatacggtaggctccggttttattttcttccatatagtaggcagtttttccagtaccacctcctaaatagtccattctttctttattgatctgtggtacctcatctgatttcaggttccctcatgtacatggatccgtcttgagtgatgtgatttgttccattggtctatttgcacattcttgtgccagcaccttactgtttttattattatggctttatagaatgtcttagtagctcctttgcacttatttttcaaagctggtttaatcatttatggggctttattatatatcaaaagttatcaaagtccctcaaaaacaacaagaattttgatcgatgttacactgaacttctctattaatttggggaaaattatctttgtaagtagtcatctcatctaagacctttgtagagaatattttgaaatttatgtaaagagcataaaaagctttcattttcataaatggaaatacaggtcttatgtattctttgttaaagtaatccctaggtacttcagtcactttcattatcttttttttttttctcgagacttggtcttgctctgtcacccaggctggagtgcagtggcgacctccacaggctcaagtgatcttcctacctcagccttccaagtagctaggactacaggcacgcaccaccacgcccagctaattttttgtagagacggagtttcaccatgttgtccaggctgatcttgaactcctgagctccagcaatccacccaccttggcctcccaaagttctgggattacaggccattatcttattttttaaaaaatatttttcatgctggtatttgctggggtagaggaaagctgttgatttctgtaagttacccctgctgtatgcccttattatttctaatacttcattgttgattctgatgttctttctaagtagttggtcatattgtatgcaaatctatcctgtcacttatttatttttcttcatttatagtattgtccaggacttttagtaccatattaaatagtataagtgatactgggtacacaaattaagatttactttggctggttgtggcagaaagtccaaaggataatggcttagacaagatagtttacttttctttcccataaaggcagtctgcagaagagcaattaatctagggctgacaggcagccccttctgtgtagccatcctcagcacatggcagttgagacagtaggaagaagggagaggaataaaagggaatgtgtctaaagtttctccattaagtatggtgcatgcagtaagtttttagaatgtatcctttaataaatcaagaaaattatctaatcttcgtttgctaagattgaccataaataagtattgaacttcaaaatcctgtgctttttttctccctttgtccattaatttcataaattgtggcctggcatggtggatcacagcaccttgggaggccaaggtggttggatcgcttgaggccaggagttcaagaccagcctggccaacatggtgaaacctcatttctactaaaaataaaaaaatcagccaggcgtggtgaagcatgtctgtaatcccagctactggggagactgagacatgagaatcgcttgaacctgggaggtggaggttgcaataagctgagatcgtgccactgcactccatcctgggcaacagagtgagactccatatcaaaaaaataaataaaaattttgtaaattgcattaaatgatatccttggcattcttgagctataccccacttgatcatggtatgtatgtatatgtttatgacttcttactttgaaaatatctcaaatttacagaaaggttgcaagaaaaagtataatgaattcccatatatcctctactcagaattacttgttttaagtattttgccacatttgctctatcactctatatctttttttttttttttttttttttttgagacggaatcactctgtcacccaggctggagtgcaatggcgtgatcttggctcactgcaacctccgcctcctgtgttcaagcaattctcctgcctcagccttccaagtagctgggattacacgcgcctgccagtacgcctggctaatttttgtatttttattagaaacgaggtttcaccatgttggtcaggttggtctcaaactcctgacctcaggtgatccacctgcctcagcttcccaaagtgctggaattacaggcgtgagctaccgcgcctggcccaccctatagctctatatctttacatagacacacacacacacacacacacacacacacacacacacacacgttttttttaatcgtttgagttggtggcagccatgacttttctttttgagtcagagtttcactcttgttgcccaggctggagtgcaatggtgcaatctcggcccactgcaacctcttcctcctgcattcaagcgattctcctgcctcagtctcccaagtagctgggattacaggcatgcgtcaccacacccagctaattttgtatttttagtagagacaggatttttccatgttgatcaggctggtttcaaactcccgacctcaggtgatccgcccatctcggcctcccaaagtgctgggattacaggcatgagccaccacatccagcctgacatgaccttttaagtctggcagcatgtacgtcttaagaacaaaggtgttctcttccataaccacaatatacttatcaatatcaggaaattaaacaattatatagtacttttattctatataaagcccatattcagatgttatcactcttctcaataatgtcctttataatggttttccccaatccaggatccagtccaagatcatgtattgcattgagctccttgtctcctttaatctgaaacagttattctatctttgtcttttatgaccttgtcatttttttttttcctgaacctatggattatattgaaagcatgttttaaagttagttgttttatagaatgtttctcagtttggatttttctgatgcttactcatgagtttttggcagaaatgttatttaagtgatttatgtatatttttaaaaccttgttagattttattagccattgtatcatctaggatatctacacctgtatttatcagtgaggtagtccaatatttttattttcagtatttatctggcattggaatcaaggtagcctcattacatgaattgggcagcctttgttattctctctttattggagaaacttgtataagaattatctgtacctcgaaaaacttggtaggactcacctttaaaagcatctggaggctgggcgcagtgggctgaggcagttggatcacttgaacccaggaattcgagacgatcctgggcaacatggcgaaactctgtctctacaaaaaatacaaaaattagctgggcgtggtggcaggtgcctatagttctaactactcaggaggctgaggcaggaggattacctgagtctgggaggttgagactgtggtaagccatgatcatgccactgcactccagcctcagtgacagagtgacaccctgtctcaaaaaataataaaataaaagcatctggagctggtttttgattaccatttcatctcttctgccaattttagcattttatattttctagaaatatactcattttgtgaagatcctcatatatgatgattcagtccagcatcctagaaatgctttataaaagggatatgcctttggaaggtgtttgttcagagtgctttggtggccaattaaaaatattcctttctatccaaatatgttcccttcctgagtttagatagcaagagttcaatacctgaatttatttggtttggatattggatgtcaagagagttcaggataatttcatctgaaaatttataaatttattcatatctgttcagttcttgattttttttcctttttttttttgtttgtttgtttgtttgtttttgtttgtggagatagtctcactctgtcttccaggctggagttcagtggtgcgatcttggctcaccgcaacctctgctttccaggctcaggggattcttgtgcctcagcttcctgagtagcaaggattacaggcccgtgccaccacacccggctaatttttgtattttagtagagacggggtttcaccatgtttgccagactggtctcgaactccgtacctcaggtgatccactcgcttcagcctccgaaagtgctgggattacaggtgtgagccaccatgatggcccagttcttgaattttgatgactacagttcaaattgattgtatcaagaaccttataactactcataccactgacagtgatttcttctctaggcatttacggtagggaaacaatttggggccaggtgtggtggctcacgcctgtaatcccagcactttgggaggccgaggcgggtgaatcacgaggtcaggagtttgggaccagcctggccaacatgatgaaaccccatctctactaaaaatacaaaaaattagctgggtgtggtggcaggcacctgtaatcccagctactcgggaggctgaggaaggacaatcgcttgaacccaggaggtggaagttgcagtgagccaagatcacgccactgcactccagcccggaggacagtgcgagactccctctcaaaaaaaaaaaaaaaaaaaaaagagtttgggttccaagctgagttcgtggggacagggactttattttgttcacagcagtatccccattacctagaacagtacttatcgtatagccaatgttaggttaatatttgttgaatgaatgcatgaacaaataattgtttaaaaaaatggaagtcaaccaaaatgtttgaaaacatgtttaatggatatttgccccatttgttacttatctttatggtgttttccatagtttagtgtgaaatttcaagcatgtagcaaagtttaaagaattttacaatgggcctggtgcggtggctcatgcctgtaatcccagcactttgggaggctgaggtgggcagatcacgaggtcaggagatcaagaccatcctggctaacacagtgaaaccccatctctactaaaaatacaaaaaaattagccggctgtggtggcgggcgcctgtagtcccagctacttgggaggctgaggcaggagaatgtcatgaacccgggtggcggagcttgcagtgagccgagatcgccactgcactccagcctgggcaacagagcgagactccatctcaaaaaaaaaaaaaaaaaaagaattttacaatgaacaccatatatacccatccactagattctttttttttcttctttctttcttttttttttttttgagatggagttttgttcttgttgcctaggctggagtgcaatgacacaatctcagctcaccgcaacctctgcctcctgggttcaagtgattctcctgcctcagcctcccgagtagctaggattacaggcacgcgccaccacacctggctaattttgtatttttagtagagacggcgtttctccatgttgctcaggctggtctcaaactcccgacctcaggtgatctgcctgcctcggcctcccaaagtgctcggattataggtgtgagccaccgtgcccagcccactagattctactattaacgttttaccatacttgctttattacatatttacttctaagtttctcgtattttttacactctatagagatttataatttttacaaagccagatttattcattttccttttatgactgctgggatttgtcttgctgaggaaggccttccccactcttaaggtgatacatttttttcttatgttttctaatatttgttttctttttttaaaagttcaacttttattatagattaaaggatacacatacagtttttttttttaactcagtgaagatgtctgcacagcaggaatcatgtgggatgggatggccctttttcctaacgctggaccacttgatgttctcttccatcttcccccaaccctcatttagatcatgacatcagaaaatcaggttaaagttaagaaaaagaagaatcagatcattggggattcttagtagtagcatcgccattgggagctgctagcccagcgggtattccccatgccacccctctggatcttggctccatgggtactgggaggaggccttgttggccagggaggccacgctgtgctgctagaagctgggcgacatactggtggtgcagcagagtctcgggtgcggcagcttggaggtactacccacataggcattggccttccagggtgcatcctggcccatcatgctgctgcagcagctgtggctggtgctgcatgtctgcttgcctgctaggctgctcgccggcttggccaggagcttgctgtgcctcagtggggccacatcccctgtggctgctgtggctgtgctctggtcttggaaaatggtggcgatgtggttccagaggtctgtgaagaacctgctcacaccctcgtaggctgggaaggcgttgatgtcgatgacggcatgctgccccatctggttgttgatgatgatgtcggtgccgaacagcaatactcccagtgcctgccgcagggcccgggggagttcccggatgacctctttgctcggctgctcttgaacagaccagaccccttgatcttgtccagctccatcaggaccaatgatgactctggctttgacacactgtggctattgaggaagatggattcgtggtcacattgtgtccgcggagaatttcttgagcaagggcctctggaccacggtgtaggacttgctgaccacgaacaccttgtacagaacggtgttgtggttgatgaaattctagaccacacagggtggctgtatgccattcaggccctcctgattgaatacagtagacatctcgtgagagttggtgccgtgagccactctagttttgcacatgaacaggaaagccaggctgttcttctccagcagccacatggtgtcatccccgcacaggcttgtgacctccatgaagggcagcaagcagatcctgccgccttccatgtagatctcaatcttccagatgagtttgcaggacttggagcggtcgagcagggttctgacggcagggaaggagtccaggacgatggtttcagggtgggcatcgatgtagtcctgaaacctgtgcaccagctccagggactggctgtcattctggtcggcttcaaggatgacatcagtcaacttgtgaatgatgacgtccaggggtccctgctcctcgattggccggctgaggttcagctgcatgacttttttttttttttttttgagatcagtctcactcagtcgcccaggctgaagtgcagtggtgtgatctcagctcgttgcaacctctgccccccaggttcaagcgattctcctccctcagcctcccgagtagctaggattacaggcacttgccactacggctagtttttgtatttttagtagagacagagtttcaccatgttggccaggctggtcttgaactctcgacctcaggtgatccacccgcctcggcctcccaaagtgctgggattacaggcgtgagccaccgcgcccggcctcagctgcaccacttctatccctcacttcctgcacacctccgctaaagccgggaaattgagcttcttgattttcttctcatgcagccagtagccaactctcttccctttcataaaggtctatatcttcctcctcgggcaaggagcctgggtcctgaggaaattgcccataggctgagtctgttggccagtgagcgctgggagcgtgcgggcaccccctggtggcaggggtgtggaaagggctcggggtgcggggttagggccgcgtggtgtcacggtctccacaacccccccacccctggccacccagctggagctcacggcccacatacaggttgttctttttttcatacgcagtttcactctgtcgcccaggctggagtacagtggtgcgatcggctcactgtaacctccgcctccctggttcaagcaattctcgtgcctcagcctgcccagtagctgggactgtaggtgtgcaccaccatgcccagctaattttggtattttttagtagagacgaggtttcaccatgttgcccaggctggtctcaaactcctgacctcagtgatctgcccccctcggcctcccaaagtgctaggattacaggcatgggccaccgcatctggcctgtacaggtttttttacatgggtaaattgcgtgacactgaagcttgaggccccgttgatcccatcacccaagcagtaagcttagttcccgacagatggtccttcagcccatgccccccttcccaccttcccggtctagtgatccccaatgtctgatattccaatatttacattcatgtacattcaacatttaactcccatttataagtgagaacatgcagtacttggttttctgttttcgtggcaggtggcttaggataacagcctccagctccatctatatggctgtgaaggacatgattttgtcttttttatggctgcatagtattccatggtgtatatgtaccacatttttctttatcctgtccactattgatgggcattcaggctgattccatgtccttgctattgtgaatagtgctgcagtggccaggcgccatggcccatgccagtaatcccatcactttgagaggccgaggtgggcagatcacctgaggtagggagttcgagaccagcctgaccaacatggagaaacgccatctctactaaaaataaaaaattagccaggcgtggtggcacgtgcctgtaatcacagctactcgggaggctgaggcaggagaatctcttgaaccaggaggtggaggttgcggtgagccgagattgcaccattgcactccagcctgggcaacaagagcgaaactccgtctcaaaaaaaaaaaaaaaaaaaaagtgccgctttgaacatgggtgcatgtgatagaataaattattttcctttgggtatatacccggtagcaggattactgggtcgaatagccaaagcaatcctaagcaaaaagaacaaagccagaggcatcacattgtccaacttcaaactatactgtaaggctacagtaatcaaaatagcatggtcctggtgcaaaaacagacacataaaccagtggaacagagtagagaacacagaaataaacccgcacacatagaaccatctgatctttgacaaaatcaacaaaagtaagcaagggggaaaggactccctgttcaataagtgctgggataggtggctagccatattcagaagaatgaaaccggacccttacctctcaccatatacaaaaattaagatgtaagacctcagactataaaaatcctagaaggccaggcgcggtggctcatgcctgtaatcccagcactttgggaggccgaggcaggcggatcacctgaggtcgagagttcgagacgagcctgaccaacatggagaaaccccatctctactaaaaatacagaattagccaggcgtggtggcgcatgcctataatcccagctacttgggaggctgaggcaggagaatcacttgaacctgagaggcggaggttgcagtgagccaagattgtgccattgcactccagcctgggcgacaagagtgaaactctgcctcaaaaaaaaagaaaaaaaatcctagaagaaaacctaggaaatgccctcctcgatacagggtttggcaaagaatttatggctaagtccccaaaagcaattgcaacaaaaccaaaaattgacaatttggacctaattaaacagcttctgcacagcaaaagaaactaccaacagagtaaatggacagcctacagaataggagaaaatcataagctacacatctgacaaaggtctaatatccagaatctacaaggaagttaaatcaataggcaaaaagcaaaatttccaattaaaaaatgggcaaaggacatgaacagatacttctcaaaagataacatacaagtggccaacaaacatgaaaaaatgctcatcatcactaatcatcagagaaatgcaaatcaaaaccacaaggagacaccgtctcatgccagtcagatggcaattattaaaaagtaaaaaaaaaaaaacatgttagtgaggctgcaaagaaaagaatgcttatatactgttggtgggaatgcaaactagtttggtcatgggagaaagcagtttcgagatttttttttggagagagagatttctttaatatttttatggtttctatttgggaatttaagttttcacccatccataatttatttggcgtaagaagtgaggtaaactttgttttcttagtgggcaacacttttctgtgaaggatcagatagtaaatatttttggcattgcattgcaggactgtctctgttgcaactaaactgaaagcagtcacggacaatttatgaatgaatgaatatagctgtgttccagtaaaactttatttaattaattttttttttgaaacaaggtcttgctgtgttgccctggctggctggagtgcagtggcgcgatcagagctcactgcagcctctgtctccctggctcaagggatcctcccacctcagcctcacacacagctaatttctttctttctttctttctttttttctttttccagtagagacgaggtctgactactgtgttacccaggctgggtctggaactcaagggttactcctgccttggccttccaaagtgttgggattacagatgtgagccactacatctggcctccactaaaactttatttaaggagactggatttggtccactggctatagtttgctgattcctaggccagatagttattgtaactattatttattgactaatttgttttccccttgttagtttgaaatataacctttggcttatactgaatttccaagtgtgtttttgtatgctgtagattctattctatttcactgatctgtctattcatgttttaattaatttacctttataatgttttaatatttgctagagttcctctcaactcattagttttttttttttttttttttagtgagagagagagagagagagagagagggtctggctttgtcgcccaggtgcagtggcgcgatcatggctcactgcatccttgacctcctggcctcaagtgattctcctgcctcagcctcccaagtagctggggatacaaacacgcaccaccacgcctaactactttttgtatttctttgtagagatgaggttttgccatgtcacccaggctggtcttgaactcccgggctcgagcgatccgcccacctcatcctcccaaagtgctgggattaggggcatgagccactgctcctggcttatcctttgttttttgtttttgtttgttttgagacagagtctcactctgttgccaggctgtagtgcagtggcgcaatctcggctcactgcaatctttgctccctgggttcatgagattctcctgcctcagcctcctgagtagctgggattacaggcacgcgttaccacacccagctaatttttgtatttttagtagagacggggtttcaccatgttggccaggctggtctccatctcctgatctcgtgatccgcctgccttggcctcccacagtgctgggattacaggcgtgagccactgcgcccagcctgtcctttgttttttaaaacaatgctacagtaacttttttgtacatgtgcaagtatgtgtatactttaaattcccagaagtagaactgtgggtcaaagggtatatagatttttagttttgtcagctattgccgaattctcctctataaggattattccatttttaactcctaccagcaatatgaaagtacctgttttccatacagtcttgctgtttgttttcaaacattggactgttgtaaatctgttagattaaaaatgttctatcaaatcttccttactagtgattattgtatagtacaatactatattatttaatagttatcataaataataattttaatataactccaaataatgtagatactccctcctctaggaggtagagcttaattaccctccttttgactgtgggctggtcttagagactcacctctaaagaatagagtatggaggccgggtgtggtggctcacgcctgtaatcccagcactttgggagggcgaggggggcggatcgtgaagtcaggagatcgagaccagcctggccaacatgatgaaaccccgtctctactaaaaatgcaaaaattagctgggggtggtggcaggtgcctgtaatcccagctacttgggaggctgaggcaggagaatcgcttgaacccgggtggaggttgcaatgagctgagatggcgccaccgcactccagcctggcaacaaagcgagactccatctcaaaaaaaaaaaatagagtatggagagagaaatagagaaattttacagggaagaaacctggcagacagcaccttaactaggtgatcatggttaacatcaccagagataagtcatgttgttatcatgtactcttctgtgatatgatcagaagggcatttcactatctcacttctgttgtatgcttctccaaaaaaaaaaaaaaatccataatcttaggtctaatcatgagaacacatcaaacaaaaccagttaaagggcattctacaaaatacctggccagtgctcttcaaaactgttaaggtcattaaaaacaaacaaggacagactgataaaccttcacaggccagaggagactgagggaacatgacaactacatgtaatgtaatatttaggattaaatcttggatcagaaaaaggatattaacgagaaaattggtggaatcctaatataatctgtagtttagttaattccttagttttgacaaatgtgccttagttttgttaatattaggggaagctgggtgaagggtatacagggattctttgaacttttctgcaaatgtaaaattatttcaaaataagaagtttgacttcatcaaaattagaaacttttgtttatttttgttggttttatagcgatgagttttcggtatgttgcccaggctggtctcaaactcttgggttcatgtgatccgcccgtcttggcctcccaaagtgctggaattacaggtgtgagcccaccacgcctggccacaattagaaacttttggaagtctctctgaacctattctggttcagggactgctggtaacaacaacaaaagattagaaacttttttttttgagacgtagtctcactctgctgcccaggctggagtgcagtggcgcgatctcggctcactgcaagctccgcctcccaggttcacgccattgtcctgcctcagcctcccaaatagctgggactacaggcgcctgccaccacgcctggctaattttttttttttttttttttttttttttgagacggagtctcactctgtcgcccaggctggagtgcagtggcgcgatctctgctcactgcaagctccacctcccggattcacgccattctcctgcctcagcctcctgagtagctgggactgcaggcgcccgccaccacgcccggctaattttttgtattttttagtagagacggggtttcaccgtgttagccaggattgtctcgatctcctgaccttgcgatctgcccacattggcctcccaaagtgctgggattacaggcgtgagtcactgtgcctggccgattagaaacttttatacttccaaagacactatcaagaaagtgaaaagacaacccacaatgggaaaacatatttgtaaataatatatctggtaagggattaacatccagaatatatgaactcttacaacaacaaaattatccaatttaaaaatgggcaaaggattcatgaccagcttgacttaacatggtgaaacccctgtctctactaaaaatacaaaacatcagccaggtgtggtggcaggcgcctgtaatcactgctactcgggaggctgaacctgggaggcagaggttgcagtgagctgagatcatgccactgccctccagcctgggtgacagagttgtactccatctcaaaaaaaaaaaaaaaaattggcaaaaggacttgaatagacatttctccaagaaagatatacaagtggccagtaagcacatgaaaagatgcaaaataacaagtgttggtgaggatgcggggaaattggaacccttgtgcaacactggtaggaatgtaaaatggtacagctgctgtggaaaacagtttggcggttccagaaaaagttaaacacaggattaccatatgatccagcaattccactcctagatatatacccaaaagaattgaaagcaataattcaaacagatacttggacaccaatattcatagcagcgttattcacaatgtccaaaataaccaaggggtggaaacaacccaagtgtgcacgaacagatgaatgaacaaaatatgcatactacaatagaagagtattattccaccataaaaaggaaggaaattctaacatactgccttgtggatgaaccttgaaaacatgccaggtgaaataagctagacacatagggacaaatatatgattccactactatgaagtacctagaataggcaaattcattgagacagaaagtagaatagaggctgtggggtggggtgagaattgtttaatgggtacaaaggttttgtttgggatgatgaaaaattcctggaaaaggtgatggttgcataacattgtcagtatacttaatgccactgaattagataattaagaatggttggctgggcgcggtggctcatacctgtaatcccagcactttgggaggccgagacgggcggatcacctgaggtagggagttcgagagcagcctgaccaacttggagaaaccctgtctctactaaaagtacaaaattagccgggagtggtggtgcatgtctgtaatcccagctactcgggaggctgaggcaggagaatcgcttgaacccgggaggcagaggttacagtgagccaagattgcgccattggactccagcctgggcaacaagagtgaaacttgtctcaaaagaaaaaaaaaaaaaaagaggctgggcgcggtggctcacacctgtaatcccagcactttgggaggcygaggcaggcggatcacctgaagtcagaagttcgagactggcctggccaacatggtgaaactccatctctactaaaaatacaaaaattagccaggcatggtggcacacacctgtagtcccagctactcgggaggttgaggcacaagaattgcttgaggcccggcccagtggctcacgcctgtaatcccagcattttgggagaccaaggtgggcagatcacgaggtcaggagttcgagaccagcctggccagcatagtgaaaccccgtctctactaaaaatacaaaaattatccgggcgtggctgcgtgcatctatagtcctaactactcgggagactgaggcaggagaatcgcttgaacccaggaggcggaggctgcagtgagccgagattgtgccactgcactccagcctgggtgacagagcgagactccatctcaaaatttaaaaaaaaaaggatggttaaatggtaaatgtatattttaccacaatacaaaatgatctagaaaaaatatacaaaaattaaaattttaagtttattttaggccatgtgcagtggctcccgtctgtaatctcagcactttgggaggctgaggcgacaggctcactttagtccaaaagttcaggatcaggctgggcaacatagtgaggtcctgtatctacaaaaaatttgaaaattagctggatgtggtggtgcattcctgtagtcccagctggttggggctgagatgggaagattgcttaagcccaggaggtggaggctacagtaagctatgattgcaccactgcactcagcctgggcaacagaccgagaccttgtctcaagtaaaataaaatttattttgaaacagtctatccaatgtagttttaattctcatctttctctctctcttttttttttttcttgagatggagtctcgctctgwcactcaggctggagcgcagtggtacaatcatagctcactgtaacctagaactcctaggctcaagcagtcctttcgcctcagcctcctgagtagctgggactatagatgtacaccaccatgcccaactaatatgttgtggtggtgatggtggttttgtaaagacgggatcttgctatgttgtccaggctggtcttggcctcgagcaatcctcccactttcaccccgcaaagtgctgggattacaggatgagccatctcacctagcaaaattttcttttttttttttttttgactgagtctcgctctgtcgcccaagctggagtgcagtggtgcgatctcggctcattgcaacctccgccttctgggttcaagcgattctcctgtctcgccctcccgagtagctgggactacaggtgcgtgtcaccacacccagctgattttttttatttttagtagagacggggtttcaccatgttagccaggatggtctctatctctggaccttgtgatccgcctacctcaccctcccaaagtgctgggattacaggtgtgagccaccgcgcccggcaaaattttcatctttcattatgagtgagatagagcatcttttcagatacacatcattgatatttttatctgtgaattctgtttacttcctttccccatattttttcctagtttattgtcttttgacttggttaatgatgttttttatttttctgtttttttctccaagcaaaagtattttatttttatgtagttgaatttagtaatcttttctgtggcttctggatttggattataggtttccccatttcaagattataaagaaattattcagttattctatattttcttttatgatttcatttcttttttttttttttttttaagacagagtcttactctgtcacccagactggcagtggctcaccgcagcctccgcctcccgggttcaagcgattctcctgcctcagcctcccaagtagctgagattacaggcgtatgccaccacacccagctaatttttgtatttttggtagagatggggtttcaccatgttggccaggctggtctcgaattcctgacctcaagtgatctgcccacctcggcctcccagggtgccacccacgcctggcctatggtttcatttcttatgtttaaatctttgatctatttcaaatatatcctggtatatatgtgaagtatagtcataatatcttgcacatgtctaggtatttaacctttttgatgaattgtacttgggacctttctattttctaaacagtggttacattaatttgtacccagcatccttactgatttattatttataacaagtttttcagttgattctcttaggctttgcaggtatactctcatatcatttacaaataatggtaattttaccttctcctttccagcttttaacctcttttcttccttccctgtttaattgctttagctagtgtctttagaataatgttaagaatgctgttgataacggacattctaatgttgttcccgaccagaattggaatcctgttagtatagtagcattcttctgtggcatctagttttttctattttaaataaacatatattggttgctcttagaatgcttttttagtcattatttgttcaaaataattgttgagcgcctactgagtgctagggaatatggcagtgagctaagggtcccctcatttcctggagcccatattctagtaattttttaactcaccaaagaaacacagattaggccatgcacagtggtggacgcctgtaatcccagcactttggaaggctgaggtgggtggatcacttaagcccaggaatttgagaccagcctggcaatgtggtgaaaccccatctctacaaaaaatacaaaaatgagctgggcgtggtggtgcgtgcctgtggtcccaactactcaggaggctgaggtgggaggatggcttgagcttgggaggttgaggctgcagtgagccctgataatgccactgccctccagcctgggcaacagtgccagatccattctcaaaaaaaaaagaaaagaaatgcagatgaaatcagctttgagatcattattttacagttattgcggtaggagaaattttaatgaaagagctgctagtgtcggcaaggtgacagtgaagcaggggcaggggacgtggtgcaagacagggaggaggagcctcacccccggggatcctgcaagccgaatgagaccttggtgagcattttggtatttgatcctgagactgagggggagccactaaagggagtgagatgggtttgagtggctttgccttagaaagcactcacatttgggatttgggatgtagagactgaactggggaggtccaggtagaagtgaggagaacagccaggccacaaccaaggtgccccatgagggaagccagtggcatggaccagagagtgacatagggatggagagaggcaggttgcacttcagagatgtggagcagggatttaggaatccctgtatgggggcgggcctgagggcttccaaagaatagagtagggggagggaaaaatagaaagtttacagggtgagaaacctggcagacactgccttaaccagatgaccatggttaacatcaccagagctaagtcatggtggtatcatgtacttctttctctgataggatcagaagggcacctcacttctgttgtatgctcctccaaaaaaaccaaaaccctacgagaacacatcacctgggcctcttgcaccttttagaaagggcaaccttctgatccctccccatccttcttcctccactagtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggtgaggagggggcgcgctgcgccaggcctggctgggatgggctcccaagggccctctgtgtctggctgcagcaccgtgtgcaggcagctctccactcccgtgccttcagactgtgctcggtggctttgcctcacctggagggcctgttcccactcccctctctgagggctcctctcccaacctgggtctccctggcttccacatgcttggctctgtacttctgagggcccctggccaccactctttccctttctccctgttgttcagttcgggcccatggctcactgtgaaccctgtactgcccgctcccagccaacttgggcacttgaagagcctcttccatgggacccggcgtctggggttgggaggacaacaaggggactgcagaccaccaagctgaggagctctgggaggccagccatgggcattcccagtggtgatagagcccctagacagaagggaaggacccttctggagaagccagtgccatgttgggtagttcaccctagcctgcgggatgaggcgcgatgtttacaccatcagggagcccccacccgaggggaagaaacaggcttgccttaggggaatcccagttggaggggcagtcagggacctggtccatgcgagcaggcagctctcctgtccagcaggctgggaagggagttcttgcaagcccagccctggggggcagtctgtgagctgcccactgccctctggagggtccagggcaaaaacccctttggtggactgccaggcttctccagtggcagctgtcaagctgtgcccagacgtctccaggagcactgggccctggccagggtgggaatggagcaccaagttatctggtgcttccccactgtgggcgggagggctttggccccaggcctgctctgcttagtcctggaatggatggattgggcaacagcccagagcccaacagccataccgttttgagcgtggtgtgtggtggaggactggccaaggctgaggatcagggactgaggagggagtgtctgcagccctcacaccacctccaccagctcctgctgcctggctctggctgagatctgaagctgttcttatgcccccagcttggttgcagggtggaaccgtaggagacatgcagccttcggtggtacagtgaagcaattgagcacaccccctgagctggccagagaggagaggaaaatcaagggtggggtctggtgtgctgaccccaggccatcttgccccaaggaggtttaagctgtgtcttgtcagctacctttgggagttccccccacaccaatactgtcacctacctctccccacccactgaaggcagcccccaaaaggaccccatggagaatttacagtcccagaaagattgcaggccggggcctgcccaccctgcctgcctgagcctttagccggagcccgcacatccctggctttcagagcctgcctgcctcacagagccagcggccagctcctaggcctgcccagactgactgcccgtctggtgtcactcatctcattctgtcggccaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacgtacgtgccccccatggccccgggcaggaggccaggctgggtctcctccagggccctcaacttctccccacccctccctcacctgcaacctcagcgcctttcatcccttctccccctccagctcctatcccccagcactgatccgtcctctgtgggcaggtcccatcggccccccggtctggagggaggagtgtcagagaggccggcttggccaagggacattggccatgggtgtctggtagtggtgggtatgggcgggagaagagcagtcctgcacattccactggtcatccagccattttgcatgtgtgcatcatgggccagacgctcaccgggccagtgctggctattgctggtagcagagatgacactggggccctgtaaccattgggggagggatgggattttctgaaatttccttctctttttcccccatccttttttgtcagcagcctggcctggcctcagagccttgggtggctgctaacagcctccacgcctgcctccctttcctcctgtttccttttcatacatacttctcatgacagccacactgaagccccacgaggcctaccagaataacctccaagaatagtgtcctgatcttggtccttcttagtctactccgccgcccctcaccccctacccccatgaattctctgatcagccctcctctgaaatctgctagctgctcattttgtaacagagaaaatcccacttgtgtatttgagggtttctaaggtctggcccacctgccctgttcagggtcagacagtagctggttgctgacatttgttgagaatgtatctcagggtgggccatgtgttaggtatgattcagtccccatggcagcccagcagggaaggtactctttgtattccatccttcggatgaggaaaccaagccctgagtgggaatgtgacttgccccaggtctcatagccagtgagtggcagagcagagctggagtctgaacccgggcagctggaccctagagcccactttttgctgcttcctcagccttccctgagtttggagtcctgataagctcttctgtgtgtttttccttttcaccctgtgtatgggtgtgtgtaaggctaatgtcctgtctgttgtttaacctggtggggaaactgaggcccagagacatgaagactccttcccaagaatggctggcataggctcctggtcctcagtgagagacctcactggcctagagaccctgcctcacctgggccaaatcctgaattgcctctgcagtttccctctggcctactccatctgggaagcaatccccaggactacatctttttgctttttgtctccaccctaagttattgctacagtcatggtctagggcacatggctgggatttgctcagactcctgtcctccccagtttgacatttatgtcatggatctcttttgacgcaagctgcaggtcagcagggcaggggcgggggtgcgggttatccccttgccaagggcaagaattgcatcccaggtttccttacttcgtggctgccagcgagccctttgtcagatcaccctgcccaccgttcttaagtggctggctcacttgctctcttgttctctgtgcccctgagggtcgtcctgctgccatgctttaccttgctctgtgcccatttcttcatttgattcactttctgcaagtctggggctgaaagtcaagactgtgaactggtgtgggcctggggctgttgtcactcagggaaaagctgcgaaagaggcggaggagactgtgtgcacatcaccgatgacccctcgggatccagaggcctccagccagcctcaggtacccagcggccccattgtgctgagcctgccctactctgtatctccccgtatagatccgtggccagctgcagtcgcacggcgtgcaagcacgggaggttcggctgatgcggaacaaatcttcaggtgagcttttgttctagtgccctccccttcaagtggccagcctcagcctccgaatctccctcctgcctctgccttctcccccactccctccaccaccttcctgccacagctgggaatgggcagcgtggggggtgccctctcttctctcccactccccacactctcctcacagctccagccaaaagcctcttcaatggggctgtcggggcaggggtgcagctctgagctgagctgggtgctccctggggtcagggccagggccaggctcccaggcacctcctctctgggactctgagtatctgagatggtaaccccctcccatacactcccttccctctcctttcttctccttcctctgcccctcactttcccccacattttttggtaacagcctctgaccagaaagtagctctgacgtggtggtcccacatgtgtgtcccaagggggaagcaggggatggctcttatccaaggacacatcccaaggaacagccaggacttcctggcctcgcctgttccctccctccctccctcttgcaggctgcttggagctggcctgaggttagcagggtggtggtggggggagttgtctctacaggacctctgcccaggctccccaaggcaggcacagtggggcctcactctgcctgggcttctctctccatctctcagtctctcctccccacacctccatctctctctctctctctctctctctctctctctctctctctctctttctccctctctctctttctctctctctgccccccccaactatattattcattccatcctcctatgcatcctaacggttattcttttgaacattaagcatgcccccccaagcccctctcatccaagccctccccatgtatctgcctctaaaggacatgctatcctgaggcctcaaccctgaatccctttcccaagcctggaatcttggttgcatgtaggtcttgctctgcatcaccccaactacaccacacacggacagcttctgggtctctctctccacaaggaggtgttccaggtgcggccttctcaatggccctgggcgcttctcccaggcacccattgattcttacctctaaggtcctcctggccaatcctggccaccattctccttttgtccaggggaacctggactgtttgtggctgtagtctccaccctgtggccctgaggtggctccctagcgaggcccgcctcccctgcgctgcggtgaggctgagatgaggtcgtgtctttaaccgcccctggtttccaatgggccaagagccttcctagcctcgcagagcagcctggcccagcttctcttttgctcctgtgattcaacacctgttacaggacccctcctgggcacccctggccttgagctgggcccgccctggagttacgtattgtggcttgtgtggagccagcagcctgcccaccatcccctccctccttctttggaggcagatctctcgtattctttccctcccagctgcttctctccgtctctgtcaccccaggctggctgggcaggtctgcccgagccccatctctctcttcccagttggtgtgtgtgtctctccccctaccgacctctggcctctgtttttctccctccaccttccctgccccacctggccatctaccttgccccccacgcccgctagtctttctctctctgattgcctctttctctttcttcctttttcctcttcccctttccctctctgccccccgtcctctcccctcgggtcccgcccccgggaacgccgtgtgtccaaagctgttgactaacccactgcgtctgtatctgaatgctgtctccaggtcagagccggggcttcgccttcgtcgagtttagtcacttgcaggacgctacacgatggatggaagccaatcaggttgctttgccgcacttgaacccccccccaaacaaatactactttgtaatcgagcgctccccatcgcctgattcttatggacacagttccctgccctgtggccctgtgtcccatccccccgccccctctctccccttcctgaccctcactatctcctcttcccatctctcgctaccccactgggcttctcatccagagcccacactcaccactggccccttcctaccaccaggcactagtgctgccccttcacctctcccagctgagcgttcagagaaagagctgccagggtgggttctttcacctagcttcccactcccccggggctggtggggggggcacccctctctggggttagccagagccaggacctcattccaccctcaggaccactggaagtcctgccagtgaggagcttagctattggcacagtcactagcaagactcattttgtcagccccatccctgcatgtgaatttggccctttgattttcatgcaaggggacagcactgctctgttgatctcaagttcccgtcgagtatgatagttttatcgacaccctggcctcacttcgccgcccctacccttcctatcacatctccacactcgcaggaggcaccacctcaggcagctctgtcttctcggcaaggacctgtgcacagtcagccctggggggagcctgtcccccaagcctggcacgggatcccaactcagcagctttgggacctccgagacccaaagatctgcctggtcacccacccctgcccagatccctggtgtagggcactggagagcagtttcaggggaggaaggggcagaggtggtagaatgggggatcccggcagaggcagccctggggccgtctcctcggggttggtaggctagtgccatgggcccaggacccagccatccatgggaagacggcctcatggcagaaacttccatctgttcgaaatggctctttctttttccccttctccagcactagcgcacctgcgctctctttctctttttctcccctctccctccccctccctgtctcccctcaccccccaagtgtagcctgtgtagtcctggccctgggtgtggcctggcagtgtcagggccgagtgggggtttctccccactgtccggcaagcgtcggtcagccgaacactgtgtgcctggtggtgtgtgttcacatgtgtgcgtgcgtgtgcccggcagagcagcaaacagctgcgcccgagagctgtggcgctttccctccctacctcccttcttccctccatccgctctccgacctccctccgttccctgtccctcatccatccagctgaagggctcgctcactctcttctcctatgctgaaacggtgcgtggggcactgctgcctggacctcactgtgctctgctttttcccgcagcactccctcaacatcctgggccagaaggtgtcgatgcactacagtgaccccaagcccaagatcaatgaggactggctgtgcaataaggtacaggggcggtgggcagcagttgtcatggacagagacagcaacagcagtggcggcgatctctcccttcctctcccgctctttctccctccatctctccccctcccccaatctctcctctccctctgtctctctctctctctctctctctctctctcattctctatcccttgctagctcagcttgagtagtcaccattcctagccagccatatacaaatgtgtagtgagcgttcacttggtgcaggctctgtcctcctaaaatgcagtcttgcctggagttccagtagactttaaggaaatatatacgtggatgatgaattagtgacagtgtagacttgaagtggtggtgtggagaatgtgggcttcagagccagactggctgaaatgagactatcccagatcggccttgattttggccaaggtgcttagcctctctttgcctcactttccccatctctaaaatgtgaatattaatgacacctctcccaaaaggtggttgggaggattcagctgtgttaatgagagagtaacactcagaacagtgcctggcccacatttaacacagtcgaattgttaactgtaatcatgaaagaaaagcacagagcrttctgagagcccatagcaggtagctcaagcctgaaggccactctgaccaggccaagtcaaacctgaaactggaggctgtggttttgtagtcacctctgtcttccctgaggggaagctgaggctcagagaggtggaaccatgggtgaacctttagctgtgccctgtgccttgctcctgatcacagggacttggatgccacagtggcttcaggtctgccctggggccagcattgtgattccacagtttgtagaggccccaaccctctccccaggaagtactctgcctagtcagggagagtggtgcatctgttttaaaaaaaaaagtcccatcagaggattggtgcttaacatttctggagagataaagacaaagtgacagtggaactccttcctgtgtttccagatagcctcaaaaccagggaattctcttttttttttttttgagacaggatctggctctgtcgcccaggctggagtgcagcaatctgggctcactgcaacctctgtctccagcgctcaagccatcagcctccagagtagctgggaccacaggcgcatgccaccacacccactaatttttgcctttttatttttattttttttggtagagacagggtttcgtcatgtttgccaggctggtcttgaactcctgagctcaagcagtcctcacgcctcagcctcccaaagtgctgggattacaggcgtgagccaccacgcccagcccaaaaccagggaattctcttgaactccttcccctcccctgcatcctgttggccaccaggtcctgtcacttccatcacagaaacgccaccttccctccctcgccattcccgctgctcatgccaatcgtcacgctctcacccactcactgtggagccctctctggtatgctggcctcttgtcctctttctcccacgccctcacctggaacattcctcaaaaccacctctgactacccacgcctctcctcctctgcttaaccagccccagctcagcttaagcataagatcctccattacctaactggcttccttccccggccttggcttttgcttctccccttactctcccacaccagtttcggaaagtccattgttccctccgataacaatccctccccagcaaggcttaacaaaatgaaacttctgggcatcccaggtcaaacctccctgcttctgtgcagggactgtccctgccgagtaaatggcaccccacccccagcccatttccctccccgagcccctgctggatggtccatgcagaccgacctgcccctcttcatgctgcatctgcccctgtgctattaggccatgagggcagagaccatgttctggccatgtgcagcagggcctggcccaggagtggtgcttagtacctgagtctggaacagagatggagtgtggtagaagctgggtctccagatgctggaacattcaaggaaaatttctcaagcgtagcaggatccaacccagtcctagagctaagaggaggggtgcgggtctggctactgacttctagggctgaaacactgaaaggtttctgaatagaggagcaagtttcagggagaggaacctaataaagggattgaatacctgaggcggggaacagtcctgggagttggtggccttaagaaggcagaggaaggagaggagggagttgttgtaccaaatgggggagttgtttattcctgagctgagtgggttggcacagaggacaaatgagagtctggaaagggaagatgcacagtactgagaacaacatcagaaggttcagaaggcacctgccaccattgcctaggggctttccttcctggggcactgcggggtccctgggagatctcttcatccaagtttggagggtgcagtgggaaatccctgctccctctgacggcctggcctgtgcctcacagtgtggcgtccagaacttcaaacgccgagagaagtgcttcaaatgtggcgtgcccaagtcaggtgaggcccacctacctctcgtgctctccagggcggagcggttggggagaagggaagggtgaggggtctgtgctcagggcttggtatagggaggagggtgaccagtcgtggagccttccccttatcaccagcctgtctcccactgcccctgacagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacagtgagtcagttgttccttcttcctctgtgccctagggtgtcgggctgggctcaccaagaccagagaaatggcagtgagcaggacctcatcctcatggaatctccacttggtgcggggatagacatttgatgtagggagaacagggggagtggcaacatcccacctgactttgggggtgtgtcgggaaggttctcagcagacaggcagccaggctggcacctggaccgccaagcagagttgatcctggaggaagcagtgagggaagcggcagttgcaaaggcacggagtgagtgggggcagaggaaagggagcagtgggggcattgaagggcagggctggcaagagtgccaggggtgtcctctaacattgggccccttcccacagccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggtgagggcggcacagttgggggccgggcagccagggtcccggcccccggggtggagacgagggtccttttccccagcctcccaccgcggctgccagcctggaaatcgggcaatggagccgggggcctccccgggcctgacccttctgtccctgcctcccctcctcccacaggaggcagcccagctgctgcagatcctgcaggccctgcacccaccactcactatcgacggcaagaccatcaatgttgagtttgccaagggttctaagaggtcagggccccacctgtgtgccttcccacccttcccctccccaccctcccactcccccctaccgcttggggcctcctatctcactcccagtctctaacatcctcctcagggacatggcctccaatgaaggcagtcgcatcagtgctgcctctgtggccagcactgccattgctgcggcccagtgggccatctcacaggtactcagaccccttgtgcctcccagcgtcctgagacctgggctttctcaaccctcctgcaccctctctgaagcaggaaggctggcttgctatccatggatgcaaaaccctctcccagtagctggcatggctattctaccttgctcctggctctctagaccccctgggacattccccttcatcatcaccgcagctttcttcccaattgcctcccatgcgctcatgtacgacgccattgtgcctggcattctgtgctgtttggtggggtttttattgtcctgaataggtatgatatacacatatccttatatgtaatatatacatatatgatatacacgtatcatatgttcctgaataaaaataacgtataagtggttgagagaaaattgggagaagagaataaagaagtaagaagatggtgtcttccttggcctgacacccaacacacacgccacacacagcagaatcagcagaatcagccctggaacattttggcgttcatctgtttttctgtcttgtgtttgccactggcctatttgttctcttgtggccaggcaaccctcgctttccacttgtcttaaggctgcatgctttgtctgtcaggtagaaatactagccccacgtgtgggacagatgcttctagcaggttccccaccccccacccccacaccttcctgttctaatgaacccctcccacctgcccttcaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtgagccccagcatctctctctgcagctgtggtgggggccagcaggcataaagtccccggccccattattcacaggcattgtccctgccctgtccctccttacaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccaggtgagtgagccctgtgggtatgtatcccggggaggcaggcaggcggcaggggtggcatgggcagacactgagccctgttctcctgtctggccccatgaccagtcgtataccatcatgtcacccgctgtgctcaaatctgagctccagagccctacccatcctagttctgctctcccaccggctaccagccccactgcccaggaatcctacagccagtaccgtgagtagccacagcctgtgggtaggggtggggagttcttaataaagcagggaatagtgtgaccccgttcccctcaccccctagctgttcccgacgtctctacctaccagtacgatgagacctccggctactactatgacccccagaccggcctctactatgaccccaactcccaggtaatagggcagcccagggagggatgggatcgggtcaggtcgcgtcaggaacagctagccctgcaggttcccttcacaaggtcttccctcacatcccctcttccctcctcctccctcagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacaggtgaacaccagggtccagcagtcactggctggctgtgtggtgtcttccagcaacggcactctgtcagctcttgccctctcctgccaagggagatggcgggcaggtgtggatgtgggcagtgactgcttagcagaccatgctcttgccccagctctgctctttgctgaatggccttgagccagagcagtctcctcagtgtgtggcagggttgcccaactccaggaggtggcttgtgccatccgagtgagccctgtcaggtgtcttctgtcccatggtggggaccctcacattctgctggtgaatatacatgtatgccagagaaattctcacaggccataagggggtgggcaggaaaaaagccctgcaatgttttgtgggagtgggcagatggagggcacctcagtgtctctctgtggagaaagggtgtgacactgtgagcgtagcgtttacaagcaagcactaagtgttaccttagcaacctgatgaattctaaaaatggtgctgtgctggggggaacatggaaatatagaatgtggcattgtgtcatgcatataaagttatacacagataaacattcctatgcatttttaaatgataaaatggaaatgcacaacaaatgtgacagcgtgggtgtatgtcaggggaagaggagtgtcttcatccatttgctgctccataacaataccacagactgggtaatttataaggaaaagagattgatttggctcacagttctgtaggcagggaagcccagtggtgttggcatctggtgagggccttcttgccgcatcataacatggcaaagggcaagagagcatgcatgagagcaagagaaaattgggccaaactccccctttttatctggaacccactcagtgatggcattaaatggagactcaaaaggtggaggggggccgggagccgtggctcatgcctgtaatcccagcagtttgggaggctggggtgggcagatcacctgaggtcaggagtttgagaccagcctggccaacatggcgaaaccccgtctctactaaaaatacaaaaattagccaggcgtggtggcaggcgcctgtaatcccggctactcaggaagctgaggcaggagaatcacttgaacccaggaggcggaggttgcagtgagctgagatcgtgccattgcactccagcctgggcaacaagaacgagactccttctcaaaatatatatatattatatatatataaaggtggaggagatgggagggggtgaaggatgaaaaattacttaatgggtatgatgtacattatttggctgatggatgctctaagaaccctgacttcagcactatacaatctgtgcatgtaacaaaagcacttgtttattttatttatttatttattatttttttgagatggagtttcgctcttatcatccaggctggagtgcagtggtgcaatctcggatcactgcagcctccacctcctgggttcaagcaattctcctccctcagcctcccgagtagctgggattacaggcatccgccaccatgcccagctaatttttttgtaattttagtagagacgggttttcgccatgttggccaggctggtctcaaactcctgacctcaggtgatgtgtctgtctcggcctcccaaagtgctgggattataggcatgagctaccgcgcctggctacaaaagcacttgttaccccataaacttatacaatttctttaaaaagcagccgcgatctcttgaggagggcagagcctttgtgacctaatcacctctgaaaggccctgcctgtcaacactgttgcatcagggattaaatttatcttttgagatggagtttcactcttgttgcctgggctggagtgcaatggtgcaatctcagcacactgcagcctccgcctcccgggttcaaggaattctcctgcctcagccttccaagtagctgggattacaggcatccaccaccacgcccagctaattttgtatttttttagtagagctggggtttcactgtgttagccaggctggtctcaaactcctgacctcaagtgatccacccgccttggcctcccaaagtgctgggattacaggtgtgagccactgcactcagccgggataaaggctccacctgtgaacactgttgcattagggattacatttctgacacatgaactttgagggacaaaaaacatagcagagaacacagccagagaggggcttggcaagaagcactggtgactggtgacagaaaataggaacttgcactactgtgtccctcaccttctgattgttctgcctcagcttccactcatctgcctcccagatgggcccgccactctgtccacactgcttctgccacctcaccattgcaaaccagtgggggtgggggcacagggtgtgttcagtgatgaggtcaggagtagccaggtgccaagtgccttgcaggctgtggttgcgagtttgggtttattcttggtgtgatgggaggcgaaggaagggttttaaggacattgtatttgggggtgggagtggcttatacttcatgaaagagcgctctgctgggaaaggtggtcaggagccgtagcccagaggccagatgaagccttctgcagtggttcggactagggatagtggctggcccgtgtttgaggatgcagggcagtgggtcagcagatasagttagtagccccagggtcatgagggttctgggaacctcacctccaccctcacccccagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaaggtgtgttggggccacccccctgcaccctgccccacaatcttgtccttcctttgggccctctgtggagtccctgaatttctgtgtccctccaccccagggagcactagccgagagacagcacaccagcatggatctcccgaaattggccagtgacgaccgcccagtgagtgcccaaggcagagaggggcgggggctctgatctggccaggcctgaccgcccaccctcaccctctacagagccctccgcgaggactggtggcagcctacagcggggagagtgacagtgaggaggagcaggagcgtgggggccctgagcgggaggagaagctcaccgactggcagaagctggcctgtctgctctgccgacgccagttcccyagcaaagaggcgctcatccggcaccagcagctctcagggctccacaaggtaacagcggatggttggcagggcatgctggggcctggcccactgaggctcatcctcttcacttctcatcctgtccctcttgcagcaaaaccttgagattcaccggcgagcccacttgtcagaaaacgagctagaagcactagagaagaatgacatggaggtgaggtgtgacctgaccctgggctccctcccctgtgtcccttccaagtccccatcacctcaggcagctggagttcaatttctcacgtgttaaccccgtgagccttcttccccattttcctatcctggctgcttgtgcctgtgatggcctgaccctcaggacctgagcctcattagccagatggcatgccctgtgggaccccactccccatgcctgtgttgcctgagaaaagagaccagctccccaacattcacatacacatacaaactttcagcaaatgaagtaccgggaccgtgcagctgaacgcagagaaaagtatggcatccccgagccgccagagcccaagaggaggaagtacggcggcatatccacagcctctgtgtgagtggctgggccaggtgagggggtctggagcccggggccggggccggcaggccgaccactcatgctgtgcaccgcccctgcagagacttcgagcagcctactcgggacgggctgggcagtgacaacattggcagtcggatgctgcaggccatgggctggaaagagggcagcggcctgggccgcaagaagcagggcattgtaacgcctatcgaggtgagtctcaggcagtcctgtcccatcccccagcacccctcacagcatcccccaccagcctgacagagcctgcctccctcacacaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgcatgttggcctctcctctttctcgtgctctagcacagttgtatagcctatacagacacggggacccaagcagatggacaggggaccttatcaggccaaggtggatggcagtggtggcattcagtgtctggaacataatggctactagaacatggggttctgacctgtaccccgacccataatatcctggttatggcccctctcccttgttggttccagcaggttatgttgtaccaggaaatctagcaccaccaggcatgaagcgccccctgatcagagctaggactgggaacccccatcccctgtccttgctgccccctggctttacttagcctgcagtcccaaggctaaactgcattttgccatccctagatctggagacaatgccctcaggcatctccaagtagaatacaagaggtactcaggttccagttggcccagagccctcaacaggctgatgacagaggggtggaggtggagcttggcctgcaaatccaaggccaggtcccagggatgccctttgagaaccattcaggcctaccttctctgttgttaccacagtgccccacccctctagtcactgcaacccatgattcccaagtatgtgcttgtgctctcggcagaggttctgggtacagtggaccgtgacgctggggctgccctcttccaagcctcagagggccacagcgtgaaagggggatggtgctagaagaccagttggtgcaaagcccctcccccatttattaatatacattgtgacaccaccctgcaacagtcataggaggtggggttagaaggggacccctagaggtaggatggtgctgatctggggtggtgggtgttgcccaatgaaggaaggggatgggagaaaaaaagggtgaaggaaacaggattaaaaagaggcctcctgggcctgggcacagtgagttgcacctgtaagtaatcccagcaatttaggaggctgaggcaggcggatcacttgagctcaggagttcaagaccagcctggataacatagccaggccctgtctctacaaaaataaataaataaataaaattaggctgggcrcagtgattcgcgcctgtaatcccagcattctgggaggccgaggcagatggatcactggagctcaggagtttgaaaccagcctgggcaacaaggtgaaaccccgtctctacaaaaaaaaaagtacaaaaattagccagctgtagtggcacacacctgtaatcccagctactcaggaagctgtagtgggaggattgcttgagcccgggaggtggaggttgcagcgagccgagatcacgcccctgcacccaagtctgggggacaagagtgaaaccctttcttgaaaaaaagaggctgccctagtctcaggatgggtgtgtcttttagcagagacgcctccacattcccttccctcttcccaccccagagcactgctcccaaaatcccacaaggaaccctcaaagctcaactggcaggagtgcaaaatgatacagccactctggaaaactggctgcttcctataaagttaacatatgcttaacctatggcccagcaattctactcttagatatttagctccaaatacatgaaaacatgtcaacaaaagacttgcatacatatatttgtagcagctgtattcctaatagccaaaaactgggaacaacccaaatgtccaactagaggagaatggatacagtgtggtatattcaaaggatggactacagctcagcaatcaaaaggaacacaatgctgatacagatatcaaaggatgagtctcacatggtgagattgttcacatggtgaaagaagccagacacaaaaaacacataatgtttcattccatttatatgaagttctaaggcaggcagaacaattttatggtgatagtagaagagggttgaggtgaggagggtgtcactggaaagggttgcaaggtagctttctggaatcatgaaaagtttctatgtcttgattggggtgctggtcacatgggtgtatacctatttaaaagtccaacaagctgtataactaaaatctgagtgttttattgtatgtaaattatacaagaagttggaaaatcaccaccacagcaaacctcaataaataagaaggaaataatgaacagaaattgatgatatagagaacaaaaaatgacagattaatagaaaccaaaagcagaatctgaaaacaaaaattaagaggaaacacttttggcaagactggtcaattgaagaagatagaagatgcaaatgcaacagagcttttaaaaataaagaatgtatctgaaaatctagatgaaatgaatatattcctagagaaatatcaaatgccaaaactgttccatggagaaactgattactcaaatggagcaattagtaatatagaaattgaaatggttgtcaagatcttccctttccccacaaaaaaaaaaaaagggcccagatgatgtgtgtatgtgtgtgttcctttctttctttctttttttttttttagatggagtcttactctgtcacccaggctggagtgcagtggtgcgatctcagtttaccgcaacctccaccttctgggttcaagcaattctcttgcctcagcctcctgagtagctgggattacaggtgtgcaccaccacacccagggaatattttgtattcttagtagagatggggtttcgctatgttggccagctggtcttgaactcctgacctcaggtgatccaccctccttggcctcccaaagtgctgtgattacaggcatgagccacctcgcctggcccagatggtttttataagagcattctaccaaactcccaaggattcctttcttattaaagttaattcctttcttattaaagttgttctagatattagaaaaaagaaaagatgtctattttaacaggctagtgttagctgaagctgcgaaggaagaggcactctcatacatcgctggaggcaatgcaaaatagtacaaccctctcttccaccctccctctccctctcctttgtctattttcctgcctccacagggctcactgtgggaccacagatgcaccccactatgcccagctaattctttgattttttgtggagaccaggtggtggtggtggggtgtgtgtgtgtgtatgttggggcgtgggggggtctcactttgttgcccaggctggtcttgaactcctgggctcaagcaatcatcctgcctcagcctgccaaagtgatgggattataggcgtgagccgccgcgcccggccaagactccatttattaaaaggctaaagaattttgccaggcgcggcggctcgcgcctatagtcccagcactttgggaggccgagcgggcggtatcgcctgagctcaggagctctagtccagtctggctaacgtggcgaaatcccgtctccactatggtaacatgtaaacatagaaaagataacagtaaaattttttctgtgttataggaccgttgaccaaaatgttatgcagcacatgattgtatatccataatttatattactgtatatagtcacagatatctattataatacgggtttgtatgtgaaactataattttacttattgttatgtttatggtctgtgtatcttgctagaatgtcagctccatgagcccaaggaagaatttccagcacctggcccatgtcaaatgaacttttttggccacctgagtctcggtctccccatctgtaggatgggtgtgcctttccatgtggaggcacccacacgttccgtttcctcttcccaccctacagagcacggctccggcaattccacagctcaggcttacattttcccatattctggacgctggtgcccaccacgtgcaccaggcactggccagacagaactaccacccccagcatgccgcgcgcatttgggccgtaccacaacctgtagggtcatctgggtctgaaacgggcaccagcgacgcgggagcagggactgacgcccctctagcaaagcatctgtggtacatcccagacccggggctctccaaggccccgcgcttccgagctccgcgcaaactctggcttctcttgtacgacagaggtggtttgctcttccgttgccccgtggcttcagctcatctttggcaggaaggcgaggcttccgcccggcacagggggtgagctggagcaccgtgcccccaagcctctggacagcatttggaggagggtgcttccctaatcccaacttcggggaaacccctcatgggcgtatttggagcctccgggcccggggtgatatttagggggcgtctgcttttgagacccttaaggggtgccgtttggggacttcggggtgggatttgggagtctgtttcggggagcacccctcggaggcagggtttggggggctttggggagattcttagggtccgtgtatgggcacccttgtccgtggagcaggatttgggttattcttcaaggggagaagcaaagcttgaggttactaaagtcaaggcgggactgggggagggcttgtttcaggacggggtcctggtgacagaacaatcgggaccgacgtggcattgtggaggtgtcaggcctttgtgacctctggttttgtgatgaggtcctccccgcgcctggaggctcaggactgcgagactggacacgtcgggggcccagatgtttctagggagaggagcctcccagctcaggctagggaagggacaccggagcccagctcttcctgagctgacgaggcgccacccggcctttattcattattcataataaggtggggctgtggtaggcggcagtttttttgcctctttcgcacctggtccgctgaaggttctcggcttgtgaattattcacgaggggcggatcagcgtgccgaagggacgtgctgaaggggcgttctgaagtctgccgcgcaaacgagttcattgatgattcgcaaaagttaagtagcaccctgagttttcagtggcttttctaggggttccgtgcttaattcatgaggagcgtggcttttgcagctttgtctgcgtgatccgcggttagctttcccttgcaggtaccagagttaaaacctggcgtctagcaaagggatgaggcctcctacattgttcatttcttatggcctggtaatcccagataatcagccggctctggattcaaatcccatcgatcctttccagttgtgtgatctttggcaaatcgttttgtaagcctgaataatgggtatgaggataacgataagattagcttacactcgtttagctacttagcgcatttaatcttcacgacaatcctaggaggtaggtcattattacccccactttatagataaggaaactgggacacaggaaggctaagtaatttgcctaaggtcacacaatcagtgagtggctgggccgggattcaaattggggtctagttccgcaatctgtagtcttaaccagatgccataatgtctcccctccccattcccctgcgccgccatttgatagtactactactactaatataacacttagcatgtgccaggcactggtctaagccctttctacttatttcttcatttaaactccatcgcaaggtaagttgctgttattcctattttatggatggggaagcagtggcccaagttgggggtttctctagtggctgagtattcataactaattttatattaatgtaaatatatatttacatatcttaacatattacttttatattaatatataatattttaaaaatttaacagtgccttgtgccagcaatgttctaaggctcatcccataatttatattctctgattttcttttgtttgagacggagtttctctcttgtcgcccaagctggagtgcaatggcgcgatctcggctgactgcaacctctgcttcccgagttcaagcgattctcctgcctcagcctccccagtagctgggattacaggcgcccgccaacatgcccagctaatttttgtatttttagtagagacagggtttcaccatcttggccaggctggtctccaattcctgacctcaggtgatccacccgcctcggcctcctaaagtgctgggattacaggcgtcatctgattttcataataacacattactatcctcattttacagttgtggaaactgaggcacctgccaaagacatgtagtgagtttgggtttgattggaccaaggcagcccttgttcctgaggcggggagaatggagggaggcgtggagaggggaggtgggggcagggagtacacgtcccctgggttttctggtggcactgcagtgacatctttcattattcatgaacaggaaggcgtgctcactttgccttggctatagcatcgtaatccctatttgctgggcagggcagtcttgggtgtttcttcgccttatgcataattcataaattgggtggaacctttcttgacctctctgagtttccaggttgagctactgcagcagcataattcattattcaggacctgggagagtgtgttttccctgcagcagccccatttccctgcttacagtgtattagatgcagcaataggcgggcgtgccccttttattccaacccactgggcctcatgcattattcatgagtaagttgtggcctgggtctccttggcttccgggcccctgcaagatcatcattattcatgaatgggggtgtgtggcttccatgttttaacatctgctttctggttgctggttgttagtctaccaaccactcaacttcatgcataacttataatcaggaagcatggccttaacggtttttcttcgcttccttgacagcctggctgcaacaattcattcattagtcgcattccatgaggcgtggcctctgttttacctgttttcgttgttactgccacaatgtccaccaggtggtgctgttccacttctaaccgaatgaatcgcaaccgagtagggaactttatgcatgattcataagtaggcgcggcccgcttgcatccgggtttctgggggtggggcccaaggttttgttccggccccaggctcagcgtccgccatcttgtgtcggcggctcggctgtaaggaggtggcagggacaaccacaaccacaacggccgggggaggagaaggcggcagcggcgattctaggcggcccaggcggcggggaggaggagaaggaggagggtggcggccgggcttggcttcggctccttgaggagttggcggcggcgcgacccggggaaccggcattggtaaaaaaacgtcctttcactgcgcctcgccctgggcaggggtttcggggaggcactggagggccctgagccacgctgctgtcggggcgggccgcggtgactcgggagccaggaatcagcggagtagggagggggagcggatcctggggcggggccgactttccccggccaggaccactccggctccctctggttgcaaaatctgaccttggagtcggacccccaggatgtgcttttagagactcacgcccaacatctctagtctgggacctgactccgtcccgaaccttgtatctcagatcagaactcttccccagtctccaatagagatttacgtggatcagcattgctgatcagagctcctcaccattgaatgccgttaaagacctgccccagaatctcctttgagacacttcctagcttctcagtatttgtcctcaaggcttccaggacgggctagatctcgaaggggtccataggccctttatctctgtaagagagtcctctttagcattttccttcagacccccatcccacacacatgctagccgcgctcagagcttccaggggtactagaccctgtgaaaggccatttgggcctggcctttgtgtcgggggcccctcttcgccacacgtcaggtctcctaaccccaccctggccctagcatcttccatcagagactctgcccagtatttctactcagagacccctcttaccatctgccttgagagactcttcaattcctagactctgtcctttgacactttctctacttttatggaatttctcgctttttatacttccagtattcagagactactgagaggcctcagcatcttccccatcaggcaccttgaacccccagagccttccagtgcaccagataccagggaggaactgtttggatacataatcctccatcaaagagcccctgcgagcatctgctcttgcagatcccgttggcttctagccccttccatcagagactcgcctccccaaccccaccctagacccagcctctgccttcaaaaaccaacctgggttctagctgcttttttcacagatcccttatcctcacatcaggcctcagaatctgccctcagatcgtttcaaggtccctaacgtctgcagtcaggggttttcagcttctgctttcagcctccttggaccccaggatcattgtcagatgtcccttccccccacaggccttcttgttttctttttctttttcttttttccgagacagaattgtttcactatgtcgtccaggctggagtgcagtggcgccatctcagctcactgcaacctccacctcctgggttcaagcgattctcctgcctcagcctcccgagtagctgggattacaggcatgcaccaccacgcctggctaattttttgtatttttagtagagatggggtttcaccatattgcccaggctggtctcgaactcctgacctcaggtgatccacctgcctcggcctcccaaagtgctgggattgcaggcgtgagccaccgcgcctggccatggccctcttgttttctactgcagtagaaaaccctcttctcagcatctaccttcagcgcctccatggggtcctacataattggtcagagaaacccaaccccatttggggacctagccagtgtttgcttattaacctttttaaggcctgcactatctgggcccagcttcccgtttccacaccctcagagcagctgtgatacctagcatgtcctgtcagagattgacacagggcctttgtgttccattagaaacctctcccagcccctcaccatccaccctcacagcctcctgggactctgtagtaggaatgtcagatacacctctcctcttgcatgtccctatctattatttttggttaaagatttctctctgctaccagcatctgtctccagagtcctccagagcctcaacatcctcctgatggaggctgcctctccccccagaccccaacatcttcctgctgcctcctcagactctagaatcccccacccattccctttgcagcttccatggggcccagcaactgtcctcctacctccttgcagccttgggggcctccactgcaatttttcagcctttctccaaaagatccttttccagagatccgaatttgagtcttttcctaataccctagcctagtcctttccctcccaggacttctaacatctcctttcccatttgtctcagagcctccttgctcttagacacccacttcctgattctcctctcacgttcccatggacttctcagttaacccctcccagaaagcttgacatgctccagccccccttctctatgccctagcttctccatcctgctaacctgcctcctctcacacctccaagactcctccctcaaaccctctggtttgggaatagagaatgcttacgcttgaaaatcttcagtttggagactcaggtatgtttagaaactaagccacagctcagctttgccaaacagttcacagtgtgtatgttatggtgggggcctgagcaaatgttgaggtaggaagggtgtagattgtttttctgctgggggtgggggatctttagctcctctgcagagtttctgtcccagactcctgcttgccttgagacagggctgttccaaacctttgcagtcaaaatccacttgaacaatcatctgaaacttcttagactcttgctgcctgcactggggatccagaggtgaaatgtccagatattaaagtgctctctggccctggatcatctctaatttatggagtgaggaaatggcatgtcccaaacaaactgaccaatgacaaggcaaggagataactaagtaatagaggccactacacgtgcccagggaggaactcacatcctcaggtcagtgagttctgaccacagaccttggcttctttaaccctgccagcagccccttgaagacagtttcatttgtcccagcttttggagaaaatgaggctcagaggaaatgagatctctaccccaggtcagtcagagagtcagtaaatggaaaatatggttcacctttgtctctactaactcaccaagcctcttgctacccaggttggctcttagcattctaagcaattcacctggctatctcaggggctccagccagcctgctgcctcccctcatctcccattccttagccctgtggactgggccctgagcccaggggcatttggcaaacagtcccccaccagctgcatgcctctgggcgagtgaatggggttctctaagcctttcttttcccatttgtgatttgggcatagggttatctgggtcatggggattgttaagattagacaaagccctttcctctttgattgacacacagtatgctcttggtagatagtagggagctcttgtcattgtggttggtgctagtgacaagtgccaagatggaatcttaggtacattgggatacttagtgtcataaaagtctcagtgtgggaggacttgtgtgaacagaagactcagtgcctagaggagcacttggggtgaggggaagtgacgctgggtcctcccatctccagcatgtggacccagtcacccccaccaccagatttcacttccacagcaggctttattgttctgtctctgggacctagcaggtgaccctgggcaagttacttctcatttgtccggcaaggacactaaactctgccttgctgggtcagggtcatggaggggatgaaacgtgataacacgaggaagcagcctgggcttcagagtcagcagatcctggtctggtcccagctcagtgtgtgggaaccttggtcaccgaacgtccctgagtgaatttttttccatcactttaaagttgggggtattattgatagcagtccaaaccccacaggagtaccctgaggacagagtgagacgaggtttagagaagtgcttactatggcatctggcacaaggaggactcctgatcaatctaatactcatttatcattgtggttaacctgtttaagggactccgcatgcagatgaggcttgggatgtgtttgttttctatctttttgcaacctcttttattggtctgtgtcggttttcccctcccaaagctgggggcagggttgggctttataaaacttgagcccctctggggactgggttctcagcaagttaccgctcctgccatcatgccaccctgatggatgtccaagcctcacttccctcctgcactccccgctcccgccgccytccctgggattaagggagaggagaatggctgcttgttactgcctacctactctgtgccaggttctatgctctgtgttatttatcatctcgataaccccgtggggaaggtaagtggtattatcacccctgtttcacaggtgagaaaactgaggcctgtggsggttaattattactgttagtgcgtggcaggctcaagatttgaaaccaggtctgtcctgaatccacatccttcccctgacctcgacacaagtacattcttgtcattcctttcactccaggattggagtctctccctcrttatgctgggctgggaagaagcaaatggcttagtggtcagcagtgtggatttgcaaatcagaccacctgggttcagatcttaggtctgacagctgtgttaccctgggcaagtcctcacctttctgtgcctgtcccctctttgctgtaaaatgggggtactaatacttaagtcttcccttcccccacagttgctactaacaaacagaaaaacggtacccatgtgctccagggtcacctctgacctttttttcctccagatgtccagctcgccgctgtccaagaaacgtcgcgtgtccgggcctgatccaaagccgggttctaactgctcccctgcccagtccgtgttgtccgaagtgccctcggtgccaaccaacgtgagtgtcctctccgtggagactggcagacgaggtggtgggtgggaaagtcttttgtrtcactgtctgtctatccatgctccactcctgtgtgtctccctaaacttgttcttttcctctattcctagggaatggccaagaacggcagtgaagcagacatagacgagggcctttactcccggcagctgtaagtggggccaaggccgggctgaggggtgtggaatgggacattgagaggataaggttgggtggggcaggccctgacctagagtaccccctaacctggcaggtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccaggtacctcttcctagcacccttccccctttcccccttcccgaggcaccactgttcccggtgccacagccatttcatctttttccctactgcacacccttamagttctacctgcgggaggaggacatcggtaaaaaccgggccgaggtatcacagccccgcctcgctgagctcaacagctatgtgcctgtcactgcctacactggacccctcgttgaggacttccttagtggtttccaggtatcttgggggtactacscagccttctgcccagttttctcagagcccatctctggtttattcagtagtgttcaatattgatttaatgggtcggcctgaatgtcaggttttgtgctgggggactagagtatgcaggcagcagttagcccctggccctgccttttcttttcttctttttttttttttgagacggagtcttgctctgtcgcccaagctagagtgcagtggcgcgatctcggctcactgcaagctacacctcctgggttcacgccattctcctgcctcagcctcccgagtagctgggactacaggcgcctgccaccacgcccggctaatttttttttgtatttttagtagagacggggtttcactgtgttagccagggtggtctcgatctcctgaccttgtgatccgcccgcctccgcctcccaaagtgctgggattacaggtgtgagccaccgcacccggcctggccccgccttttcaagtggggaagatgtgtacagacagtacagcatagtggttgtgggcacagactgtagagccatactgccttgctgcaggcctccagccttggtagtgtgacttcaagcaggttgtttcatctcctgtacctttgttttcctgtttgtagtcagtgcgtggtagcagcactgacttcatggactttttgtgagggttaaacacgtggaattgcagctggcatataaggactggatgggtgtttgttaattaaaaagtccaggccggaaagaggtgctctggaagctgagagttgtccctggagtatcccaggttgccagggcactgcagctaaatcctgatggaggagtaggagctcaccctggtggggaaggatggacattcaggcagagagcaaaatcccaaagatcatggcggagcaggcgtcgtcttgagaattggaagcaggtgggtgtggtaggagtgagctcagactttggctggagacagagttttactccagtgtctcacagggcatggcagacagacagcagcgggtgtttgtcaaataaatgagtcagctcttctccaaactccctcctcccagctacctcttcacctttcctggtatagtccaggggttcattttcgacccccacagagtctgatacacagtaggtgctatgtgtttgtgaaagaggctgacccagcaaagcctggatgtgtttgccttgaggactgcctgagtcctccacaccagccctccattttttccccttcaccccaatgctgggcctgagcctccatctctccacaggtggtggtgctcaccaacacccccctggaggaccagctgcgagtgggtgagttctgtcacaaccgtggcatcaagctggtggtggcagacacgcggggcctgtttgggtgagtggcagcccacctccctccctgtccccttttcccccaactcctaccaagcccaggccaagactctaggctctccctgccctcatcccttctcagctacccaggttttgggttctgtgttttcatctctccccatgtggcacaagtaccatcttacatcccagcagtgataggctgagtttgctcagcaagttttcactacatcttgagggacccgtgggacctgtatgtgcatgggacacaggcaccagccctattgcttccctctacaggcagctcttctgtgactttggagaggaaatgatcctcacagattccaatggggagcagccactcagtgctatggtttctatggttaccaaggtaaggagaccagccctagggttcctggcaggcaggtgggctgcagtagtccttcctgtctgctcttggtaccctgggsctgtttctgagactcactcttcctttaaccaggacaaccccggtgtggttacctgcctggatgaggcccgacacgggtttgagagcggggactttgtctccttttcagaagtacagggcatggttgaactcaacggaaatcagcccatggagatcaaagtcctgggtgagctgsgaccatgggggaagcagaggggaactagaagatatgttcctgggttctggccggggagttgaagggagaagacatggcccttggttcagagttgggaagacacatcctggtgtttgagatgaactacagacaatcctgtggggtccaataagagctggtgggcatgggggagaggtactrtgtttgagctattcctgggagantgtgtccctrgtatctgagctgagtggggaaaaagtctctggtgtttgaacagggcagatcagcggatctacttgtgtgtgagctgatttggatgggaagcagagaaggtcttcccgtgtagacttggagccagggacacagggtctcacggggtctgagctgagtctggggcacaggagagatggtttctgatgtccaagtggagcctggagctgagggaagacagcttctgatgtctgagctgagtcggggcaggaggttccttatcttgcaggggttgtggattttagggagaatgggtagactgacagctctcttcctgccctctgtaggtccttatacctttagcatctgtgacacctccaacttctccgactacatccgtggaggcatcgtcagtcaggtcaaagtacctaagaagattagctttgtgagtgtgtcgatgggatcagtgggctgtggggggtggttctaggcattccctagttctccattcctctcttctggttctgatgacctctccccccgccacagaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggtgggtgagtgggcgagccagccagcgcagacatgcctggcactgcaggctcaccatgcctctctgcgtgtccacactccctgccctcactgtggcctgacatatcctctcttggttctttctggcccaccaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggtcagcacgggtggggagaggcaggattggggtgggccaggtncctccatgactctgtcacttgctctctgtctgtgtcaggcccctgttaaccactgaccaccccctctctcccttcccctctccaggcctgctccgggaagttcatgcccatcatgcagtggctatactttgatgcccttgagtgtctccctgaggacaaagaggtcctcacagaggacaagtgcctccaggtatgtgggtggsacctgtggggagggcatcattggggacatttctggggaggcctctctaaccctcctccctttgcattccttagcrccagaaccgttatgacgggcaagtggctgtgtttggctcagacctgcaagagaagctgggcaagcagaagtatttcctggtaagtggtccccttggatgtctgctcccctcatcttggcctctggccatcacccctggggcttccttcggcatctcaatgcaaccggtggcgcattctctttgccattctccttatcttgaagggaagcccagtgcatccctcgtttccccttctggtgcctccttcctcacatgactgygtgtcatttcttagagtcctgcaacctgaagatgtggtgttagcccctctccccgtctctcaggggagtgaggggtgatgggtagcttcacactaacctgcatcaccctgaccagcctctgcctgtcttcttggttgcttcttaggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacggtgagtagggtaggaggttggggctttgtcgtctcactttcctcctttttcttttttttttttttttttgagacggagtttcgctcttgttgcccaggctgtagtgcagtggcgtgatctctggcccaccacaacctctgcctcctgggttcaagcgattctcctgcctcagcctcctgagtagctgggactacaggcatgcgccaccacgcccggctgattttgcattttaagtagagacagggtttctccatgttggtcaggctggtctcgaattcccgacctcaggtgatctgcctgcttcagcctcccaaagtgttggtattacaggcgtgagccaccacacctcacccctcctttttcttgttcccattctttctgtcagagatctttctgcctctgccagaagcccttctttttggcctttctttccctcagcttctgtttttttttttttttttttttttttttgccttaacctctttttagtgctggttgggacagtgtgtctggggtcctcaaaactactctcaagctcaattcacctagagtacttacaggactcagcatatagtcgtgcttgtggctacaatttattacagcaaaaggatacagaccaaaatcagcaaagggaaaaggctggtgcaagtttctaggagtcttctcccagcgggagttaaacaaggcggcctttatttccccagtagcaacagtaactacagaaataacagcaacaaggtgtaacaagacatgaaatgttgccaaccagggaagcttgttagactcagcaccacctcttttacttggggctggtcatgtaggcgcccccttcctggcacataacaaaatttccagactcccagaaggaaaggtgttcagcgtaaactgtattgtttgcatgaacggtttaggcacagtgaaccactgataccaggtagggagcggtgggaaccttcctgaattccaagttcccagacaccagccaaggagccgaccttggaagcaggcctttccaagggttgtagtttcagtctcctaggcttacacttctctgcacatatggaaactgggttggttatgcagggttctctgagaagctttctgtaaggagcagtgtcgtttttgcttacccaggatttattccccctttcatttatttcatttattcaccagatagttttagtactgttttaggtattggggatataccaaggaataaaacaagattcctggagggagaggggaacggacagcaaacaatagacacaatacgatcgtgaggtatatagttaatgttggtgatgagtgctcctcaaaggaaacaactaaaaccagacaagggaagtcggggtgtcagggagaatggtttgtagtattgatgacaatggttaaggaaggcctgagttctgcaaagacctcaaggatatgagggactagagtgccctctgctgtggaagagcctgcgcaaagatcctgaggtgggaggggtcagggagccaactcattttacggtaagtggaggtgggatccaggggaggattctgagcagaggagggacgtggcccaatttgggctttgaaaggatcctgcttgtctgtgtgccagcatcctggtggtggttgggggagtctgcatcaatcctgggtgctgttacctgaaaaaatagcaggtgttagacgaaagaacagatgtctggcccattgtctccagtctgttcctgtccacagcttccctttatgctgagcccctgccacatgcatcatcatcctggccatgtggcattgtcacagaccgtctctcctgctagcctcctaactcagggcctgggtcttccccagcattaagtaaatcagtctcaggcagacagccctttataggtgtttgggccaggtgcggtggctcacgcctgtaatcccagctctttgtggggccgaggtctttgagctcaggagttcaagaccagcctgggcagcatgacaaaaccctgtctctaccaaaaatacaaaaattagccacgcatggtggcacacacctgtggtcccagctactcgggaggctgaggtgggaggatcgctggagcctgggaagttraggctgcagtgagccgtgatcatgccactgcattccagcctgtgtgatggagagagaccctgtctcaaaaaaaataaagatgtttgttgggtgaatgcacaaataagtgagctttgttcccccatccccaccctggaactgcactttcttaaccctttagaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgtgagtttggaggcgggtgaggtggtcacgggcaaagttgtgtgtgtttcggtgtgtatataccaagaggggtgtcygtctttctgtcctctcctgatgtttctttcctagctctcrctttgtsctccccacaggcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcaggtgataagctgtgggagaagggaaagaggccaggcatctggccaggctgctgcctctccrcccccaggcccttgccttgccttcagatgttgcatgcctaagtgtaagatgtgccttttctccaaacctccctccctcacttcccaccaggcagcctaggtttctagaatgactcattcttttttcacttttattttgatttttttttcaacacatagacaaatattaagaatattatgatgaatactcaaataccattcctcacctaaatttaacaattcttaatgttttgccacattttcttcttagatttatgtagatttttcttctttgtgcttaaatgtgtcacagacatcacagccctttactccctactatttcagtgcctctgccaagtgaggatatgttgctgtagaacagggtttcttagcttcagcactactgacatttggggctggttatttatttgtcatgggagaggggatgycctgtgcactgtaggatgtttctcagcattcctgacttctgcccactagatgccaatagcactctccctccatcatgacatctcaaaatgtctccagacattgccagatgtccccaggggtgccacatcactcccagttgagaactacttctgtctaacagaaacatcattttcatgctcagcaaaattaacaatcattcttaccatctcttctagttatttatttgtctctaatggtccatattcaggttttccccagctgttactcaaaatgagtttaacagctggtttgtcaggatgattctgtgtgtatggtgcatttatctacagaacagtgcatatattatctagctcggggtgtccaatcatttggcttccctgggccacattggaagaagaattgtctcgggccacacataaaatatactaatactaacgatagctgatgagctgaaaaaataaaagaaaaaaagatccgtgcataaatctcataatgtcttaagaaaatttacaaatttgtgttgggcagcattcaaagtcatcctgggctgcatatgggccacaggttagacaagcttgatctagctgaagttttacaaagtgaacacacaggtgaccaccacctgggccaagaaacagaacctagggattaccattgtgctgtcagaataattcttagtgcagtgtttgaggccaaaccatttagaatagtaggagtatgagggtgggaacaaaatagggaagggaaaaaaaaaacagttccatctgtcactttctcccttctgacactgcagttccagagtgggtatgtttgtatttgtgcaccaaccacagtcttgctaggtcatgtgtaaccttgaacttaacctctctgtgccgcagattcctgttctgtaaaatgggaatgacagcatctacctcacaggactattgtgaaccacttggcatttactgtgtgcctggcactgttttaaccaagctttaaatatatatgtatttgctcatttcttcctagcaaccccatgaaggtaggtatcactgttgtaacacctgttttagagacaaggcacagaggtaaagrtgttatcctgtgtgcctgaagtcacaaaactaggtaatacgtggcatagctggaatctgaacctgaatttctaacatctgtacactccaaaccacctcgctaatgactgcgaactgtcctaggaattctcagaggccagaagytctgtcttgtttgctattttattttttgagacaggtctcattctgccattcaggctgaagtgtattggcacaatcatagctcactgcaaccttccaactcctgggaagtgtctgtacgtgtgtgtgtgtgtgtgtgtgtaagtgtctgtgtgtacgtgtaagtgtgtgtacgtgtgtgtgtgtgtgtgtgcgcacgcacgcgtgcccgttacgttgaccaggctggttgtaaactcctgggctcaagtgatccacctgcctcagcctccaaaagtgctgggattacatgtgtaagcctctgtgtccggcctctgtcttgttttctgccaagtcctcagggcctggatagggatcattgttggtttggtctgagttttttgtgttttaaaaaactgtggtaagatatacctaattgaagtttttattttttatggaggcataacatatctagaataaggtacacagatttttttttttttttttttgaggtggagttttgctcatgttgcccaggttggagtgcagtggcgcagtctcggctcactgcagcctccgcctcccaggttcaagcgattctcctgcctcagccttccaaagtgctgggaatacaggcgtgagccacctcgcctggcactcagatcttaatacatttttaggctgggcatggcggctgacacctataatctcagcactcaggaggccaaggagtgaggtttgtttgagcccaggagttcaagaccagcctaggcaacatagcaagaccctgtctctacaacaaatcttaaaaattagccgggtgtggtggcatgtgcctgctgtcccagctattcgggaggctgaggtgggaggatcgtttcaacctgggaggtcaaggctgctgtgagccgtgattgcatcgctgcactccagctcgggtgacagtgtgagactttgtctcaaacaacaaaacaaaacagttttccacatacacagcactattgtaaccactgcccaaatcaacttcattgatttttctttttttgagacagtcttcctctgtcacccaggctggagtgcaatggcatgatctcggctcactgcaacctccgcctcccgggttcaagagatttcctgcctcagcctcctgagtagctgggattacaggcatctgccaccacgcccagctactttttgtatttttagtagagatggggtttcaccatgttggtcaggctggtctcgaacccttgacctcaggtgatccatctgccttagcctcccaaagtgctgggattacaggtgtgagctactgtgcctggcctggtttttcaattgaggtgggggaatggggaaggctagagggcttccccacttccagagtagctgtgcgccttgtacttgctttattcactgatggtccttctaataatgcctgcggaaacccattttgtcaactgtggccacatgtaatctgtttgctctgtctgcagtgggctcgggatgagtttgaaggcctcttcaagcagccagcagaaaatgtcaaccagtacctcacgtgagtaactcgagtgccctctcgccctgtccctgtccaccagccaaggcatcccggctgctttcctcatgacagtaacacttggcaccaggcacacttttcacatgaatgagtggctgttggggcctcatgttgtttggggtcgggactagttttccatggagaaagtaagattgctctggagcccactcttgaggctgacatgtaatcctatcctctgtcctcttcgattcctgatagagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccaggtaatgcccagttgttgggtccatttggcagaatgtgtttccctgaaatgggagcctgcagtgtgggtcctcccactgtggagtccagctgtggcaggtgccctgaggcatggggatctgagaagagtgattgatcctgacctgctttttcctcaccctagttcctttgagcaaagaggcttggttgctattgcccttgactgtggtgtgggctgcgtcatacctgattcccagtcagggctgtagggattatgggggagaaattctggagttaagagcacaggaatcaatatgggttcaaatccaaactctacttgaacttaggcaaatcacgtaacttctctctgtacctcagtttcctcgtctgtgaagtagaaataatagtgatctatctcatggggggtttggggaggattaactggtatttattaaaatgaagttagtacaatgcctggtaatccatgagagtttgttaaatgatgggctgtttagcacaaaatggctacccagtgattggtaattgttctctcagccagatctctggttcaacctgtgggaccctacagttgaggtattttgtgattggctccagtccgcatcgagtgcccaacccaagatagtgaattgggggcacatctggggcctaggtgaagcgtgaagattgtcagagaggccttcactctcaggtcctgttctcaaaaatctctccatcccttagctcacaagctcaggagcgccgttctggtctgggcccaaacgctgtccacacccgctcacctttgatgtcaacaatgtaagtctcctttctagggtcttctggggtcaggtggagggtgaataggtgggaaggaggtggcggctccccactcgagggctgatgtgctcacccttccctgccctgccttctcctagcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttggtgagggtgtttggccagttggccaggagtcaccccacatgtccccggcctagtccagcctccccaccagtcctctacccctggttctgctctgctctgtgaccccaggcctgaggtttacccacaccttcctttgagcctccctttgacatgaagagggtaggttggggcaaattatctccctccctcctcctccttcccactatctggccctcaggagaacttgctgttttactcttgctctgtgtatttcccttagttttgttctttcttctgtttcttcttgatctgttcatctaggaggtatgatctctaccagcagtctctctcccttgatactttcctgccttgtctccttccagatccgcccccatctgtacatctacctgcatgtttctctgtgcatcttcaccctccatagtttggggctgcggtttactgacacccccaccccaccccatctgcatattttttcaccacccctcccttctgtatatgatgcttctgtagctctgtaacgccccctacatttaccttccttatatctcccccgtcttcctctccatagatctcctcccatttccccttccatggtccccatcttccttctgaaatgtctactccttcatgttcctttatgtatgtcttccaatctttccttccatagctctcatcaccttcatatatttcttccatctttctcctcccacctgcctcgccctctgtatatacccccactctcccccttttatatcttctccatctccccccatatctttcctctatgtccacatctgtgtattccccccaacttcccctccatatatcttttttactccccttttcctccctgtatcctctgtgttccccccatcttgctctacatcattcttcccaagatctttacgtctcccatcttgatctctccatctccactttctcctaacattttcatttccgttccttagtgtctctagagagatcattcttgatagcctcagctctttctctgtgtttttcaggtttgtattctgctctgctctacctctcctccttgccccttttctctcccaggatgtctctcctttccaaatcctttttgtacctgaataccttttgccccaccctgggctctcatttccatctcagaccttagcctgggatctaaagggctgacagtgtccctttcttcatgcagatgacagtcgtctagaggagctcaaagccactctgcccagcccagacaagctccctggattcaagatgtaccccattgactttgagaaggtatggggtggggctcaggacagggaaggaggatgggcaaagcatagacaggctggagaaaacaggagtatctggagccagccccgggcctttgtggggatcagattgtgggcctgccatatggctctgaatgagtaggtgttcccagccatccctttgtgatctgggagagtccagcaggcaattgcagtggaggatacacatcttctttatctgatcctctccccactgccttcacaccctccccactcataacaggatgatgacagcaactttcatatggatttcatcgtggctgcatccaacctccgggcagaaaactatgacattccttctgcagaccggcacaaggtgaggggaatctaaatctgatgttccaccctcctccaggtttgagttacccacacttagcccctctgtagaccctgaggctcttgtacttaactaccaccttcttttgtcccttctgtctctcagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccaggtgggggcctgcatccgaagcagggtttgggtggggtgtatctgtgtagatctggttctgattcacgtcataccctgtcaccaggtgagggtttctgtctgtgtacctaccctttttgtgtatcctttttcacttattcattaatcacattatttgagtacgtgcgaaaagatgggatatttgaattgtgccctgggagattattagtaactacacaataatggcagccaaaatttattggacgcttcctacacttaagtgctttgcttgcttcattaatgaattcactcaaatatttattgagcaccttttgtgtgcagggactcttctaagttatgttcctcaagtagattatataaataacctattaaatgattttggaatcaaaaaaggataaaaagaggccgggcgcggtggcttacgcctgtaatcccagcactttgggaggccgaggcacgtggttcacctgaagtcaggagtttgagaccagcctggccaacatgatgaaaccctgtctctactaaaaatacaaaaaattagccaggcgtagtggtaggcacctgtaatcccagctactcgggaggctgaggcaagagaatcacttgaacccgggaggcggaggttgcagtgagccaagatggcgccattgcactcccgcctgggtgacagagcgagactgcatctcaaaaaaaaaaaaagataaagaggacttgagaataccagggggcgaggggatgtatttgagattttgtgtaggatggtcagaaaaggccttgctgaaaagatgacatttgagatcagacttggaggatgtaaggggacaaactgtgcaggcttggtggcgagtggggacacattccaggcagagggaccagttcttgaaagggtaccaagataggggtgtgcctggcaagttggaggaattcaaagtccccagagtgagtgtgagattgaggagggtaggagatgagaagaaaacagaatttcattgcttagggtgagataggaaccacaagaggatttcgaacaaaagagggttgtgrtctgactaaacacgtctgcatgggggtaggggggatggagacagatgggggctggaccctctgggatggtctccatcttacactcccctctttgtcttgcagtactataaccaagagtggacattgtgggatcgctttgaggtacaagggctgcagcctaatggtgaggagatgaccctcaaacagttcctcgactattttaaggtaaggcccctcccttactctgtcaccccacctcagggggcgaggtgtacacggtgacttgctggcctgtccacctccatgaccctgctgttccccctccctctccagacagagcacaaattagagatcaccatgctgtcccagggcgtgtccatgctctattccttcttcatgccagctgccaagctcaaggaacggttggatcagccgtgagttggacactggccaggctaggggaggccctgtatgggttggggagcctcatcatccagctgtcccactccagttcactgcccctacctacctgcccatcctctcttgctttctgccctcctgaccctatactcccatccccctatccccaggatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccaccmctctccacaccccttccagcccagggttcccatttggcttctggcaktggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagctgtctggttcagatgataactcagagggctcaaccccaccacacctgccagttttctggacaaagaaaatgtaattgccacctcttcctgccctctctgcctaggaagagatggaggcaccagtgaggccatagtgagcaggtacttgggtccatgtgactgttaatttgagctgggttcaattctcaccttctccatgtcctaactccttgctctgtgaagaggaaagttacggtgaccaggctgctagggcatggccagcgtgccttatgtccttagggcagatcccctcccacctggctcaaagcactcagaccctgggcagccttttgtggtcatggttcccagcaccaggaatgcctgtgctgctcttagttcaatttccttgctgcaggggtgtcttaaacagctctgccgaatgccagtgcctgcaggcatacttcgtgatttttatggaaatacttgagaacatctgtagaggaaaagcccgttgcttgccttacgcttcccccggccctgccgccgccccagccccaggtctgcctgtattccccttgaggatcttcagcctcctactttggagaagacagctggctgtggggactgaggggtgttcatcgcttagagcaggtagcaggaggcctaacaccagccccaccgggactgcagagttaccgtgctctgtccttggtyttggctgagtgctccagacaattgaaagcaccagtctggccactgctacatctttgccttcttctattgtactggctcctggtgcctgaggagtccattcatacttctgttcctcaactaaccaataatttatctaccttacttagaaacaagatccctcactcttctactcaaacctgagtgtaaggaatagctcaacctgttctgaactggcttgattcccatcacagcctgtgcccacatctgctgcctcctgggccagtagttcctggtcctgggcacagtatatgcccttgtccacctccttctgatcattttattttcttggcctgctctgcttgggtgaccttatccttccacagtttcttcttccccactaggacgttgaggacagaggcattttccctttggtatctagtggtgatactgtcaaagggaaagtttttcccaccacaggaactttcccattattgctctagagtaccctagacactccacaccgcagtccactggccacaccactacagcagctgaggcttgaacacaactgttgtcttctttctccagtatgccagctcctttgcggatactctatagacaccttgttcactgcacctcccccattacggctccatgtcttccccaccacaactcctggatctccttgacaccttattcgtgcctgacacccttctccatcaaaacaagcttttgagtcatgcatgaatcctggttgcatcttagttgttccccctccacctcattccattttacttctgcggtttgtctaccagtctaccattgttaacaccagccagatgggagatcagggcttagcaggcgggggttgcgtcattgcaccgagccccctgcacccagcagccacaaaggatagggtgggacaaaggtttctcttgtcactgcctggaactatttgcccacctccttctgatcattttattttcttggcctgctctggcaggcattcaacaaacatttgttgtgtgctgtgtgccagtcactttctaggcacgtgagacagcagtggataaaacaaagatccctgtcctcttggggttttacgttctgctaggttgacacccagaatagattataaacacagtaagcaaattgtaccttagaagttgatcagtgctcttcaaaaggcgaggaatagagcccgatctggggatctggaatgatggcagtgcaggtaggaatttttaaatcggaaaggcttcatggagatgactttgaagcaagcacctggaagaagtgagagaatgaggcacgtggatgtgggccagcagcattccaggcaaagggaaccacagcaaatgcaaaacccctgaggctggattgtgcccgtttcactcaaacagctagaaagagcgctagtatggtggcagtgagtcaggggaagaagaggaagagatgaggtcagagaagtgatgagcctgttctatgccaaggcgaggacttttatctttgtcaaatatttccactcccatcatggcccgggaaatctcactaatgtaaaccttactgaaaatcctaactgctgtgatcaaggctgccataaagggaagcccggaagaggcggggaggctgccttggaacagggtagtgtaaggatgtgccagaaggcctgctggaggttgcagccctttgagctggacttggggatagtgtggttttccaggcagaaggaagtgaaggattaggtcggcctggtagtacttggcacacaacatgcgcccaataaataaaatggaaataaaaccgcggagtgttctacttgtgttgactgacatcaaaacaaaacaaaaaaccctcagagtgaggggaggcacgggaggggctgtgccgggcaagagaggtggcaggaaaatccaacgcacggcgcctatgcaaatactcgtgtgaggcagaaaagaggctccgccccgctcgaagttccaagcatgcgcagtagcggctcctgcgcctctaaggatccgcctctttccttctttctcagcctgggttccaccccgggaggcccgctgtatgagatggagggcgggctaaaggcgggacgagactcgattgagcgcaattatgaccaatcaccttgcggaatattcggcctatagcgaaggaggagctcagaacaaaaaggagaccccacccccgccgacggtgaaaacctatgaaacctgggcggaggcgtgcggagtcgggtagagagcgaaatcacgcctcttcagtcagccacgccctttattcttgctcggcctcgccacagagagcaaatcagattggctgggcgacaacctcaaagggcggggctgcacacgttcactacgggaatgaggtagcggtggagggggcagttgggcggggataggccgtcctagctaaggtggtaaaggccaataactcttcaggctgcctctcctcgaaaagtcatcwtctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccrctgcggacgggtcctttggtacatgcagtccgaggtgagtcccctcctttccacttcacccttccgagcgcctgcgtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccggtgagcgcgtccccgaggcgtggaggctgcccctcctccttcagaacccacctcgggcggtgcccaggggtctgggctgcggggctggcaggtgcccccacccccggcgaatttcccagaatgcaccggggcggggggtcatttggggcctccctgaccttggccccgccctgggcctgtcctgggagctggggttgggtagtgctgtgggtgctaatggggacctgggggagtcaaaggaccaaagggtgtggaaatgggtgacaatggggtgaaagacttgggggggttgctgatgggggtcggagcatgtggcagtaagcctcacgccaataagtcgtgtaaggttcaaggccccgtgtgtgcttgtggaaggagggcggggtgcggagcgggtgagggacccgagggtgtataacggggggtagggtgtcgaggaagttctaagacatgctcatagggattatgtccgcagagaggcccggtgtgtgttcatgggggacagggtggcacaggtaccagaacgtgtgttggtggggtcagggctctgaggcctggtgcgtggcgatgaggccctggatggtgttaatactgcgtgtctgtccgtggggcctgcagtgtgtgagaatgcagtgtgtgcttgtggagggcaggtagctgaaggactcgagtgtggtgtgtgcgccagtgggggtcatggctgtagagggtgtatgcctgtggcctcgaaggtctaggtagtttgggacccagtatatgctaatgagggcagagtggaggaaggacctgagggtatctaacggaggaaggactgtggaatacctgagcctggcctaaaggagatgagaattgcgtgtctgtctgggcccaggaaggagtggtggggaagtgtcttagcactgtcagaggcttagtggacgaagggtaaaggtgatgtgaggtgtgagtgtgtccatggacacagggaatgtgagtctcgagggcacactaggaaggagcagggtaatagaagtactggtggttgctaatgtgggtttagagacatagaggcacttcaatgtgtgccatttcgagagtcagctgtgtgaagtctggaatatgctaataagcatcagaaccttgtgaagattgtgcccttgtgtccgcggaggaccagagtatgttgaggttccagggggtgctactcgggggtagggctgcggaggggatctagtgtgtaataagggggatcagggctttcatgaagggatctaagtgtgaaccaacaaggattatatctgtggagatatctctgagcagagagcaatagaggacaggaatgtgtgatgatctcggtgtgctaaagtggattacagctagggagggctgaagtgtgtgctaatgggagtcagggctgaatgagacctgtgtgcactaatgagggtcaggccatggtagaacagtgtgtttgtgtgtccctgcggaatagggctgagtaagggttcagggtgcactaatggggaggcaggactgtgtgaggcccggcgtgtgctaatagaaatcaggcctgagtgaagactcagtttgtgctgacagaggggacaggacagtggaaggactggaatgtgtgttaaggatggtcgtagctgtgaaggggcctgagtgtgggtaacactggttagagatctatctgtaaggttcactttatgttaatagcattcagagcagcatgaagaaggtccagtgagtgctaatgtgggtcagctatagagtaccccaagtgcatgttaatagaggtcagaatcatgtagggggaacagtacgttaatgaggggagtcagtactatggagaaggtaacaagcagctaggccagggaggggcccaagaatgtggtggcaagagttacttagaggaggctaagtgtgtgctgacagagttcagggcggtatgttatgtgttagggctttgaatgctgatgggtatatgagataatagcaggtaagatgtagtgaggcctccttgagggtctagcgtgtattaatggggatcaggacatagggtgcgatgaccaagtccttagtggttggtgtgttgagtatccttgagtatgagagtagtctgaggatgggtgtatgtctttggggatcaggaagggtcaggcaggacatgtgccttttttggggtaaggttttatgtccagtttcttgctccctccttttttgaaatctaaaaagctcattcaactgaaatgatatttaaaagtttccttgcgtataaatgttcaattatctctgttcacaggggcatgtctgagacccccatccccctttctgggagtgttatgtgatatacagattttacaccccatcttcctaaaatcccaaaaaactgaactccagagcatgtccagcccttggggtttccagttagaggtcgtggacccatggctcctcctggcttcctccccatcctccattcagccctacttccagtctcccccagcccctcccctactccctgtcacaacatgcaaagcaactgggtatctgtgccatatggggacacaaggttgtctttgggagctggccatgctttaccttccttgccttaggcccagtattcagcctcccaggtcaggatgttttgtggttatcctgggttctccatggatggacctcatcctgtatctgaggtctttctgctagggtggcccctacccctcctggggatagtgagttcagccaggtgggggcgagaactgctgggggaagcacctgatttcaaggtagcagatgacccatttctctcctcaaatccagccccagtctcatcctcgacctcctatctagctctacttcccttgggcccagggccatcttaggccctgctgtgagtccagatggttcctgggtcaggtctttccccctccttgctggcccagagcycaagaggaagcagaagacggctggcctaagccttttggtggccccattcccttcagcaatccatctaggtcatcttcctgtcgatgccagcatccctggrctaccttgtttagggttgttcaatgaatagcagggactcatcacctcagcagaggttggtcctaggccctcagccccctgattcacttatttctgccataagcactttttgagcatctactctgtgtcagtcactattccaggtcctcaggatatagccgtgacctaaacacagaaatctaccctggcggagctgatcttctagttgtggcggtgaggagatagacagtaaagactaaagaaaccaataagtaggtggtgtcatttctgaggaggtaatgagtgctggggggataactggcaaggtgagggagttcgggatggttgagattttaaatagggttattcacagaggcctcatgaaaaaggtgacctttgagcaatggcccaaagggagaggggagtgagccatttcgaaatttaggggaagggtgttccaggtaccaggaacagccagtgtaaaggccccgaggtgggactctactgggtgtggttgcagaacagcaactaggaatgatggcgggggggtgtgggggtgggggggggccgtgggcaagaggcaataggggcaaatgaggtaaagaaacacctgtgggccacattgaggactggggcgtgtatttggggtgatgaaaaatgtacattcttgagtagaggagaaatgtgacttggcttgtaaaagtctagattggaccctaggggtcctaacctgatcaaacckttctggcagccctgagaagagctggtgtacactgagacccccccgccctccacacaatcccacccagtggttgggtctgggcaggacaccctgacacacgctcccctccccccccccacctgggtagatgaatgggatgatgcagtggttgtcatgacgatgagtgctagagaagtcaggaagagggtccctgtggccacagggaatagtctgccttggcctttgagggtggtgctaggggaactatgccactctatggccgtgctcgagaccatgtcacccatccttcaattctgggcacacgccctggccgacccatggctgggcccatcactgcagctgtacctgagaagatctgcaatggagccttctgctcctgcagtggggcttttcccctagatcccaacaatccatcgttagggcccttgccctcaatcagccacctaaatctgagaactcaggtgggctacgtaggagcagggtcccagtggggctggctgtgtgggtgggcaggtactgacaaagatccccatccatgctgggtttccagaactcctgagtggctctggggtccatagtggttgagtgagcactgacaagttcatgtcagtgccccctgctaggctgtgggctttagggaacccatggtgatcaagcaaatgctaataagagacccatttccatccttgtcccttgctcagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccaggtgggtccactggctatcccctctcccatatggccccaggctgcttcccaggtgttgcctcctggtcacattcctcattttcctctaaattttctgccctttctctgccccccatgtgctctcttctcccccttccctcccatcttctctcaacaccgtctgtctatctgtccatctgcgctcctcttcttgcctttctgcccaggccccgtggtgggggacagaaggtgccttgcctgtcacagctgccccaaggctccctctgcccttctgccctctatgatggcctcctcagtcctctggtacctgcctgccctgggcctgccttcccaggacccttggcttcccctgccaccacctagctgccggctctgagctcagcttgcccttggaaggaagggttccactaggtgacttttgcttccccaccccccagttcaacctgccctagatgtacctgagcttccctgggctcaggtacatcaccctctccccgagggactccaggtttcctgtgggggccacgtgcacacatgtgtgatgatggaatatgtttcgtgggggatggggtgtcctgtggttcctgaccccacctggcctgccctacccctctccctgccaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggtgcttgaccccgtctggatggtggaggaactggaaaagggggttggacctggggaggtggagctcatgatcctgtttctctcttgccttacctgctaggacatcaacaagcgcctatcrctaccagctgacatccggctgcctgagggctacctggagaagctgaccctcaatagccccatctttgacaagcccctcagccgccgcctccgtcgtgtcagcctagtaagcaccttctgttcccgtcctctcctttttcttctctcccagacccttctcctgagccagctttaacctgcctcatttgtcccacagtctgagattggctttgggaaactggagacctacattaagctggacaaactgggcgaggtgagaggcaaataggaggcccatggtggggatgaaggtcagtgggaactcctggaatctcatagcacctctcctgtcanacttcctcacattccagggtacctatgccaccgtctacaaaggcaaaagcaagctcacagacaaccttgtggcactcaaggagatcagactggaacatgaagagggggcaccctgcaccgccatccgggaaggtacacacccccatcccatctgccccaggcttccccaacccacccctggcgcacacactccataatgagaacaaagactggttctaagaccccccaaaacactctggctttcatgggaatgcctgtcacccacatatccaggtaataatcagggtaaccaggaatctgttcccatttggataaaaggtagatgaattgcaaaccagggtttggttctgagaacacccctgaaagtgctcaccagtttatttactgtaacaatttctagtcagaatatcacatggaatgaatttgaattgcactgaaatttagtgtgcaaattcgatttcacgcgatgctgcaggcctatgtactgagggttggagccaggccccttcccagaaaccaaaaacaggttgtgaaaatctagtgtcacatgagcctggggctgcaatcccaggttcttgctccatactctcctctgagtcttattttccacatctgcaacatggagacacaactttcttctggcatgaggcgggttagagctggtggctccgaggcattaccctgaactgtctagagaaagaaagaaaacctgggcttgtccctttctagtccttgtcctcacctctgtcctgagggtaggaccctgactcttcccctgtcccactcccatgcttcctgcagtgtccctgctcaaggacctcaaacacgccaacatcgttacgctacatgacattatccacacggagaagtccctcacccttgtctttgagtacctggtaaggttgagtggcagtaggtcccagggggaggtgaggagaaggccaggagccataggaagtaaccctcattcctgtaccacctcttctttcctcaggacaaggacctgaagcagtacctggatgactgtgggaacatcatcaacatgcacaacgtgaaagtgggtgtggggcaggaagcaggggcacaagggggcccccactcacccactccaacccacaaatctcccagaaacggacttttccctttggctttttttgctaggagcccttggagggcactgggaccctgtcctcttttgtgtgacaaggctctgggcctagtgtctgtgtttgggaggggagcagtgcctgctgggggtcgggctagtggatagtctttgacctctgcctgccattcctgggtccccagctgttcctgttccagctgctccgtggcctggcctactgccaccggcagaaggtgctacaccgagacctcaagccccagaacctgctcatcaacgagaggggagagctcaagctggctgactttggtaccactggcctcccctttcttattggctccccagcctcctactttcccatgaccacttagtctcacttcccttcagccttgccagattttgcctaggacaccctcagtctcaactgcactctccccgagactttgcccatgactccctcattctagctgtcctttctctgatttccaggcctggcccgagccaagtcaatcccaacaaagacatactccaatgaggtggtgacactgtggtaccggccccctgacatcctgcttgggtccacggactactccactcagattgacatgtggtaaggacaggtgsaagtgtggcaggggccatgtggtaaagggggtggcttggtcacaacagccacccagccagctgcctttctattcactgtgccctccctgcccaggggtgtgggctgcatcttctatgagatggccacaggccgtcccctctttccgggctccacggtggaggaacagctacacttcatcttccgtatcttaggtgaggaggcatgggccctaggcgctgtggagacacacngggaggacctgtgaaatgtttgggataactcctcttccctactaggaaccccaactgaggagacgtggccaggcatcctgtccaacgaggagttcaagacatacaactaccccaagtaccgagccgaggcccttttgagccacgcaccccggtgaggctggtgggtgggtgggcgttaggggccagagtgtccaaactcattttaaatcaggtctctttgtccttgtggcagacttgatagcgacggggccgacctcctcaccaagctgttgcaggtgagaccaccttgggtcagccttgggggtatgggattccaagtgtggggaaacagggacccccccccctcaaaccaggggcagggtctgaggtgggcagagagacctacttgttgaagatatcaatactatccccctccccgcacccccactcagtttgagggtcgaaatcggatctccgcagaggatgccatgaaacatccattcttcctcagtctgggggagcggatccacaaacttcctgacagtgagtggagctggggaatggaccggccagcgtggggactgggaaacaggactgctggggccagctggcgggttgtgtaggattctggctgtgccacctctacgtggggggacatcttgttcacgtgtgtgatgggttgtatttgttatgaaaacattttttagttttcagttccttttacctttcatgaaaaatttaaaacatacataaaaatatatgcaatagcactttactttttttaaagtagacatttccttacatgtgctaaaaaatgcacaaatcataagtatactatacaatgaattttcataaatgaaacacatccttgtaactagcacaaaagtcaagaaacagaatgttaaaagctccccacccccagctcccttgcatctccttcagttattcccagccccttcccaaagggtggccactgttttgacctctaacagcaaggataagttttttctgtccttgtactttatagaaatagaatcacatgtgatgttctttttatatctggcttttaaaaactttttaatatggatattttcaaatatatgtatttatatattagtcaaagtaatatgatgagtccctaagtactccagtgagtcatcaattcatggtcaatctggttttatctatattctctctgattattttgaatcacatccaatcccagacatcatagcatttatccttaaataatttcagcatatacctataaaagatttttttaaaacaacaatattattatcaaacctacaaaaaacatttgctcactttccctatcttcccactggattaatatataaagcaaaccccaaacaccacccatcacctagacttaacaggtggtaattgcaataccataattcacttgacaaagttaataatgatttctttgtgtcatgtaatagtctatatttcatcttccctggttktagctggtttgtgtatggaattgtttgacagataaaggtcaagcctctcagagaaggggcagctttttctaattcttcccatggggtcatatggggctggtcctagatgacctcatgggtcatcccccacttctatgtctcccccatctgtagctacttccatatttgcactaaaggagattcagctacaaaaggaggccagccttcggtcttcgtcgatgcctgactcaggtaggtatagccccttgtcttcctccctgccccacccacctacctgcttacccaccaacagccatctgctctgctttcccccacaggcaggccagctttccgcgtggtggamaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttktttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaagcctgcttgcaaatccctgtaggggtggagggtggccgagctggggtgattattgggaccttggagaattcatacctcatcaccactgtctaggaaaacactgggagtgggccagggacacgtcacgactatgaaaaaggcatctaaggtattgcatatgtaacagtagaacatggagttgaagcaggtagggcaggctgaatggtgttgatgggttgagaagcagaaaggggagttagatttgcccaggaatatgaggaagcctgataagagggtggaggcagggaagtggagagacgatgtttgaaagacactggacggcccaatagaaccatggatgggaagatgaggcaaaggcccagtatggccatctgactaggaaaccatgaagaggagggaatgttcaggacggtagggggtagattttggaccactgagtaggtagagaaatcctttaatacatggatcaaattaagcagtggggccatagatggacctggaaatttcaattattagtgtccaggaagtaacagaaaccatgggcatgggtgagagagtttgcaagaggccagggatcaatgacacaacctggggtttgccctcagatatgaggataattgaaacttattttctttgtcctgtgagttccagccccagtcccaccatcttgggcaaagccaaggattgttttctaagcagaagagggggtgagcagggccaggcaaatactgcaagtaatggcaaccctaattaagtggctgtttactaaagcccagtggtgggggcccatgaacttctaatcactctactgtgtgtgtttgttttttgagacagagtctctgtcgcccaggctggaatgtggcggcacaatcttggctcactgcaacctttgcctcctgggttcaagcgattttcctgcctcagcctcctgagtagctgggattacaggcgtgcacaaccacgcccacctaattttttatttttagtaaagatggggtttcaccatattgaccaggttagtctcgaactcctgacctcaagtgatccacccacctcggcttcccaaagtgctgtgattacaggtgtgagccaccaagcccagcctctaccgtgtctttctaagcactttagtgatgtttcagcttgcagcctcatggtgccatgatgactgccatgtccccagagatggaaaagcaagcagggaagacagaacaccttccttacctgtctgtgttcttttaacggctggaacttccacaagctcctcagcagacttcctgtgccatttcttggctagaatcagatgacatggccacttctggcagcaagggaggatgggaaaaggagggccttgcaaagggggacaggattgccaggctggatttaaaaggtctagaactcacccaactgctctgggaagtggtagggtcactggtgtgggcagaggttggcctctggaaggtggaaaaaaaaaaacggtctagggctgggaaaggaggtctcttggatttacctggctgcccagataaatggggagggggagtctgcagaggggcaatggggagaatcaattcagagaatctgacaagattcaactgggcttgaagagcagctatctgccatgtgtctgactcaactcaaatgccactttctttggggacccttaagtgaaaggcctgctccctttcctcacccagagcttacacaactgagtttgtgacccctcatctatgccaggtctgggctgggggctggaatcacagtaataaagacacaatccctgccccgcagagattaactgaaaataggtaaattatgaaattgtgagggggaagggaggttcgaaattaaagtcatcatcaacggggctggcagccccagcagaggaaagaatagcatagcctagagcagtggttctcaaccagagacatttttcccccaaaggacatttggtaatgtctggagatacttggttgtcctgaggggtactacttggtatctagtaggtagaggccagggatgctgctacatatcctgcaatgcccacaacaaagaaatgacagtgctgaggttgagagaccctggcctagtccaagggttctcaaactttgggtctcgggattcctttatgttcttaaaagtttaagatattcaaaagagtttttgcttatgtcatatagcctctggattcagaagcctctggataatcacactgtacacccctgagagaatgagagtgaaaaagtattgtgaaaatagttttcattttgtgaaaccccaagaggatttttggaccggtagacaggctgggaccactgggaccacacggttggagaatgtttggcctggtgtttaaggtcacagctctgaaaccagatttctcaagtctaaactgcagctccaccactaattagctgagggacgtttctggtactcagcgtccccattgttacccatgggtgacaaggacagtacctgctgcctgaggctactattttagtccaataaagcacttaaactgggcggacagctagtttagttatgattgctatgactccaacaaacatagggcctggggctaacttgtcttcaacaccttgtctagtgaataaatctagttcaggaagagaaacaacagcccgcaggcctcggtgggtctctggaggtggaaacctcttttgcattgggttttgatggtacaatgaagggcattctgatcaggctaacaaaaacactgctcccagggtaggagtcctagcccacctcgggaacctcagcctccactttccatgccacctgtgccctaagtctacagggcgttaggaccccacaaggcacttttgtctttcttggttcccactgaagattttaccccacctagcccttcgacgcgtctgtgcacggggccatttccaatatggcagtagccccgcgactgtttggggggctctgcttccgtttccgggaccagaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggtgaggctgggctgcggtggagcctcggcagagggaacggtgggggcattgacaaccgctggggattcggcggccgagggccgcgggaaagctgctgcggggtgcgggggcgggggagtggccggcgggacagcgggctaaaggggcggggaagtgcctttgaatgaatcgcaacgtctggaaaaggggcggggcctgtgtggtgcagtctgacgcctgagaacaaaatggggtttgttgtgatgagaccagtttcggtcctggaggtggggccgggcctgcgtagtgaaactgcgtaggaacctgggaagaaggtgggttctgctacataaggcgggggcgcggcctgcgctgcgtaatgcaacttttgggggcgaggagcggtttccgattgctccggggcggctgggaacgaggcgagctttgtgacgtcagcagaagagcgggatggagccgaacggtccgagggagggagcggggacctccgtgggggaggggggaggagcctggagcctgggaacgaggttaggttggtgacgtgagctgaggcagaaaatggcgcctgcgaataagcaaagtttatgacgcgccgtggtttttgattctggcggaagccttcccgagtcgagagaacgtgcaggtgattagcaccggaggggccttccatgtttaattggttttctgtgttggtactgttttgtttttagaatcaagaaaaagtcgtttttttaaaaaatagaattttgataaatcggcttgttttactgatttcttgctaaacagtccttcttgaaatttactgcttctgagttcattttatttctcgccgagttgcatctcgttttttaattgtgaaatacgtaagacttaaaaagattatataaaacatttacgcagcccagattgacggacatcctgttaaaataaacggcctacactcttcaaaaatgtcaggatcatgaaagacaaaggctgaagaactgttccaaattgaaggaattaatgcaatttaacgagtcatgataactaaatgcaacatgtgatcctcgattggatcctggaacagaaaaaaaaattattttaaaaatcaattttttatcataagattatttttgtctcttttactgtaaaaggcaatggaaacgtcggtgaaattttattaaagtgggtagatactagtactactaataattgtgatcattgtggctgtgaaaaataatatccttgtttataggaaatactgaaaaatttagggataagaacgcatcgtgtaagcagtttattctcaaatgcctgaaaaattagcatatataaatttatatatggcgaggggaaataaaattggggagatgttggtcaaaggatacaacatttcagttagacaagaaaaataagttcagatctattgtacaactatagttaataaattcattgtatacttgaaaattactgagagaagattttacatgttctaccaccccccaaaaaataagtatgtgacgtaatggatgtgttaattgccttgacttagtcattccacaatgtatacataagtcaaaacttcatgctgtacactctaaatatatgcaatttttgtccattttaaaataaataaaaataccaaaaaatgcatgtaaagaaacaacgattgagcaaatgagtaaaatattagatttggagaatctggatgaaggacatatggggattctctgtattatttttgccatttttctcaatctatttcaaagtttaaaaattaaataataaataaaaacgtgtgaattcaccatccatgttaagattcagaacactgtcttaagaaatccttctgtgcccctcccagatggaaattcccctccttgctccatgggaaactgttatcctgaattttgagttaacagtctcttccttttctttaatgttttaccacagctgtatgcatccctaagcggtatgtattgtctaagctttcactttatacatatatggaatacatatatataaaattctactggatgcatactgtgagcccttatcttcgcatcgggtaatacatggtatccacatggcatcattggtgatgttaaccttgatcacttggttatggtagtgttggccagctttctcaactgtaaaggtaccattttcctctttacatatgcagtaattatttttaaaacatgtatcatgtccagccattcctcaaaatactcttaacagcttcccatctcttgcagcgtagatgctaaaatccttacaatgaattgcaagcctttatgaagctggtctcctgcttgcattctgatgtcttcccatatctctcctctgattacgcactccctccctgtctccatccaggccggccatattggactcttgctgttcctcaaacacatctaaccttagggctttttcgagtgaggtttactcactacagagttctttaataaccacaccagtgaaatgtgtatctctgttactggggagatgagttgagattttccaaatcgggaatacaaacccaagccgtgtttttctgccattacgtcacacttttccagcaagaaaaagcctcatttcatcctgagaataaacaaaataaccacagtgttttgtaactcatttgaagatgttcaaaagggccttgaggctttgatccttgcctcttcctacctttgtagccttgtgattgtgtcactggtaggacatgacatcctgtcatccttgataatacgctttaaaattaccccaccagtactgggttttcttttgggatgatgaaatattttggaactagggagaggttgtggttgtacaacattgtgaatgttctaaatgccgctgaattgttcactttaagatggttaatgttatgttatgtgaatttcacctcattaaaaaaattaccacaccagtgttggttcagtgttgaagccggtttgtctctgctgtcatgggtattatcatgaagcatttttgctaaactccactttgttaatgcttctctagtaagagcaaagcatctcaaggttctttattgctgtccattttccattttacaggggtttgcttaagtggccaggatatatgtgtttataaagcattttgaagtcatggactaaccccaaatcatatatcttgtatcagtattaatatttgcaccttctgtcttttgtcagctggcagatttgggtgagggtagttaattaatttggtcatcacaactgatttaatttctgggagaagcttgtattttaaggcaaattcaaatctgtaataatatagcctccttggaaattttcactttttccttttgtgggatgaaccatcttcaaacacaaatcagacacaagagaaaactagaagacagaaaataaagaattgtttagcaacttttttccataagcacatatttcatatcatttcaacaaatttgaggaagcacgaataaacctaagtgactttagcaagatcagttgtacctgtatatactggcagcaagaaactagaaaattaaaatttatgataccatttatgatagcatccaaaaaattgaatacccagctgtaaatataataatttgggtgttattgatacagaccatgacacctttgttgtgactgccacctggcctgacagagattgtgagacatcctgatttcagagatgttaacaatgatttttttaaagtgtctttgacttgaagcaatatggtaataattttctgtgaaaaattatgtaaaatgtcagtcctctatgaaatctatagaagttcagcctgtgaccaggtctggaagttttgcttaccactctacagcgtgattttaatgttattttttgttcaaaatctgctcttaaaaagaagttgagcagtgcctacctttgcattggaaggtactgttaactatagctttactgaacaaattaacttcatagactggctatggaggcaagtaaagccacaaagggtggatggtggtgtgtggggtgcagggttgggtctgagcattgagccaccggcacagaagggtttgtttccctggtgtgagtgatatggggcagggtctgtgggggtcagtgcagcaaaaaaacaaaaccaacaaaaaacccacagaaatgtttgcctatctaggtgacttgtgactattccaagatttgtctgtccctccatcctcccacctctctgatcctttcatgaacaagggaaagttgacattttaaagaatcacattgatgaggttaaattgggagaatcgcttgaacccggcaggcaaaggtcgcagtgagctgagattgtgccactgcactccagcctgggcgacagagcaagactctgtctcaaaaaatgataataataataatgaggttaaattgcttgaaaaccagccaatataatgttatgtgcatttcatcaaatttggttattttttaaaaagcatttatttgaggctgctcagtatttgggatagccttttatgtgtcagaaatgccacagcagaacaggtgtgtgtgtatgtgtgtgtgtgtgtgtgtgtgtgtgtgtgtgtgtgtgtgtttaggcaggaggaggtttatgtctgtgagcttttatgtccaagtcctgaagtccaagctgtcagaacaatgacagctaaaattcatttagcacttattatatgtcaagtattttccaaacttcaggatttctcacaaaggtagatttcaatatagttctaaatggttatccttgtagtacatataagtttcacctttaaaagagagctagttgaactgtatactgaaaaatgcttgatggtaagttttatgttacatgtttttatcacagtttttaagagaaccataagctcaggaatttactataaagccaaagtaaattctaaattaaaaaatgatgaacaatagcaatatgcagttcttttttttttttttttttttgagatggagtcactctgtcgcacaggctggagtgcagtgatgcagtctcggctcactgcaacctctgcctccagggttcaagtgattctcatgcctctgcctcccaagtagctgggattacaggcacgtgccagcacacctggctaatttgttgtattttttagtagagacggtttcaccatgtcagccaggctggtcttgaactcctgacctcaggtgatccacccgtcttgacctcccaaagtgctgggattactggcgtgagccactgtgcccggtcttttttttttttttttttttttttcagtatgcagtttttgaaggaaaaccttatgattctttttagcattttaaattctttgctccttttaaaagcagatttttcaccatttatcaaatctagttcttagctgaagaattatgcttccattgatagatcctttagaaacaaacacataatgaatggctaaagccttataaaattagctgcagatggcacatatcttgagcctaacttaactgggttatcccacagactaattcaaatgaatcatcttttattctataataaaacctcatgtttcctagcactataagtatggattttttgttggtttgtttgccattgttaaccacattttctgtttttaatcagatttcttttttaatactaagaagttatctaacatacaaatctgagtttcactgaataaattttgcttcgaatttatttttatatgatgctgaaacttttcatcttaaattataatgtgtcaatactttcagtctgttgggcatgggaagttgtatagctaaccctcagctacccatgtaacacccttgttacctgtctgggccccaggttccttgtggagaagcactggtataagcagtgggaggcatacgtgcagggaggggaccaggactccagcaccttccctggctgcatcaacaatgccacactcttycaaggtacaaggcctttgcctccttctcaccctagccctggagttcttgtcccttccgtccctacagatgatcataagcccattctgtgtgctaggtcactggtggggtggccagagtcattcgtcagtttcctttgttgattcttcctctgccacctccacccccgccccacagatgagataaactggcgcctcaaggagggactggtggaaggcgaggattatgtgctgctcccagcagctgcttggcattacctggtcagctggtatggtctagagcatggccagccacccattgaacgcaaggtataatggatggggagggtgcatggcggggagtgcgtagtaagaaagccttgtaggcccagcatgggtacagatccatgtatgctgggtaggtacacatatgtctgctctcttccccctcctagctcatcatacaggtatctttgtctgctgtgtgtgttcccctgtgtggctctctttacagaccattgtatatgtgtgtttgtatgctatgtttgtaaggcagagtgtgtgctcctctcatttgagaggtcacagcgctgtgtctgtgtgagtacacctgtgtctgcacccctctactcttacaggtcatagagctgcccaacatccagaaggtcgaagtrtacccagtagaactgctgcttgtccggcacaatgatttgggcaaatctcacactgttcagttcagccataccgattctattggtgagtctaagggtcacgcaatgggttggtgttcctagctactagtcccaactcagtgacttgaggttgcatagggttaagctgaagctgactgagaaggcactggtcagactttggaagacccagaaggcattggctaagttgggtggaggcactgaggggatctactagagccctgagggtatgtgagctacattctagtggcttacgtggtgtggcagaggatatttgctggagatctccagtctggagtgtgggccagtcatttggagactgattgaggacacaggtattggccaagcatgtgaggtccgtagggatgagtcaggtatgcccagatggattgatcattttgggyctcacaaagatcttgaatgtactccatcaccccgcacaggcctagtattgcgcacagctcgggagcggtttctggtggagccccaggaagacactcggctttgggccaagaactcagaaggctctttggataggttgtatgacacacacatcacggttctcgatgcggcccttgagactgggcaggtaagggtggggagggcttttctgttcaggtggactggcagatagactcacctggcagtactcgggggaaatgaaggctaggtacccataatgtcctccattaatacctttccttctttctctttctccaacccagttgatcatcatggagacccgcaagaaagatggcacttggcccagcgcacagctgcatgtcatgtgagcccttggggtatctggtccagagcgggggcgtcccacagtaggcaaaatgatttagcccatgagcacattgcacccccatgcagcaggccctcagctgacagtttctcatctaaccccaggaacaacaacatgtcggaagaggatgaggacttcaagggtcagccaggcatctgtggcctcaccaatctgggcaacacgtgcttcatgaactcggccctgcaggttgggccattatagttgtgtctggcacagccacgtggttgggcttcaagagctgaggattggggacagagctggggtcctgaggggactacagggcaaggggtcaggatgaaagctgaggccccacaagtctgaagtggcacgcccacgttcattcctgaactatcagcctcttctctcagcttgccctcattttccctcttctcttccctgttcccacgttcttccttctcgtgaaatcctaatgccttctctcccctactctcctgctcctctctctcctcccttccccttctctcttgttttcctctctctttcctcctggcttctttttgtgtatcctcactttgaaccttctgtctcccctctgcctcattcacctggtctctggcctctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaaggtgtgactcaaccctgggcacccccgaccccctacgtctcttggctctcctaactccctctctctctgatgaccctgcccatcttcttagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggtaggctgcccccgcatttgcagtccaattaacatcaccaaggcctctgcctcggggattttctggcctccctggggtatctaacacgccaccattttcygttaagtttctctacctgacctcaactccagccttactcttaaccttagttgcaataccatatctgcccccacagtcaacccagagtaaaccccagcgcagtctcctgccctaaatgacccccagtcttgaccgtgaacatagtctctgtgtatccctagctggagctctgcctctggactttagcagtggccttccgcttcaccccatttgaatgcaccccaagccatggtttcctcttaccctgggcaagccccaccacccaccatgacactatcaacaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctrtcagccacaagagggtcttggaggtcttctttatccccatggatccgcgccgcaagccagagcaggtgtggggcagtgggggcctggggagatgatgatggacacatagagtttgattagctgccatagctcaaggcttcttgcattaactcaccacaagcccttttggtcttttgtggataccgtttttcccttagcaccggctcgtggtccccaagaaaggcaagatctcggatctatgtgtggctctgtccaaacacacgggcatctcgccagagagggtgagactgcagaaggaggctggatgggattccagggcaaggaggcagaagggcctgggaggccgtgcagactaacagtcccctctccatatyccattcctagatgatggtggctgatgtcttcagtcaccgcttctataagctctatcagctagaggagcctctgagcagcatcttggaccgtgatgatatcttcgtgtgagtggggatggcagggaggtggtggttcctcaggaacttggtccacttccttttgtatggtcctgccttaaccaccttctctcttccctgcctctgcctcgttcactgggcacctgccctgcgcagagcttcagccacatgccttgggaggctgaggcaggagaatcacttgaacccgagaggttcaagtgagccaagatcacgccactgcactccagtctgggcgacagggcaaaactccatctcaaaaataaataaagccgggygcggtggctcacgcctgtaatcccagcactttgggaggctgaagcaggcagatcacgaggtcaggagatggagaccatcctggctaacacggtgaaaccccgtctctactaaaaatacaaaaaattagccgggcgtggtggcaggtgcctgtagtcccagctactcgggaggctgaggcaggagaatggcatgaacccgggaggcggagcttgcagtgagccgagatcgtgccactgcactgcagcctgggcaacagagcgagactccgtctcaaaaataaataaataaataaataaaaataaaaatgccttcaggctgtgaggatgagtgggtggggcagccagggcagagtcagggagtctctgggggccctgatcaggtgtgcctgctgtccaccccccacagctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcgtaagtgtcctcttccccgggggtggggggcggaggggtctgaactcygacttgggtgtttagctgcttatttgacacctcccctgtaacaaacaaaagacagtccaaacttaacatggccatagaagaacttgtagggttttttctttctctagacctctggctttgctactgcctgtcttgggtgctagggatacagaggtgaacaagatgcacaaaacagacaacttcatcttgtcttcagttgtctctcctggagactgttgtccctcctgggagagtcttggtttttttgtctttttgctgacaaattttcattttgcctaaaatctagagtctttactgtggcacacaaagcattgtgttatcagaattctcccccctcattttgcattcaaaagtcattccccagaggctttccctgatgggaagttacagccggtatgtgtcttgtctagcagtggcttattagagtaaaagtccacgctccatacctttttttttttttttttttgagatggagtcttgctctgttgcccaggctggagtgtagtgacatgatcttggctcactgcaacctccatctcccggattcaagcgattctcctgcctcagcctcccaaatagctgcaattacagccgcgcgccaccacgcccagctaatcacactccacacctctgactgggacacaagttccttcattctcaggccactgctgacagccttggcctcttcatgcatttacgcgtcaccccttcagccctctcacacctcagattcagaacggtttacatgtggatctaccaatggcttcccattatcttaagtaaaatcccgggctctatccccactgtccttgtacccgtcttgggagtctcctctgctctgttgcagacgctacgtgaccaaacccaactcagatgatgaggacgatggggatgagaaaggtgagggggctaacagtcagtgggcgggggctctgggttaggtctgacccacgtagggttcgtctaggtgtgcattgcagcttagcacttgaggctcacaccttcccatctctgacatcctcctgtcctagaagatgacgaggaggataaagatgacgtccctgggccctcaactgggggcagcctccgagaccctgagccagagcaggctgggcccagctctggartcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatggtatttcctttggctatcagcgagggctggggaggctggaggggagatttcctggcagcaggatccatgaccacctctccctcacccccagcccagccgtacattgctatcgactgggagccagagatgaagaagcgttactatgacgaggtagaggctgaggtaaatgagatcccagggatggggggtacttccagctcttgcccctcaactcttcgtacatcctccccacaactcctctagctgggaacagagccaagagatccaggtcaagcttggccttggggcctgaacacctactgagagctccagggcctgaggttcctagcttcaaagtcggtgctctgacccactcagtgtgtgtctcccccgctgggcccccactccccatttctccatctgtcctcacagccggccatctggttgtctgttcacccaatcctagggctacgtgaagcatgactgcgtcgggtacgtgatgaagaaggctcccgtgcggctgcaggagtgcattgagctcttcaccactgtggagaccctggagaaggaaaacccctggtgaggggccagagcggggcctgtgtgtgggggtttcattggatggaactactatatttagctttttttttttttttttgagacagagtctggctctgtcaacccaggctgaagtgcagtggtacaatctcggctcagtgcaacctctgcctcccaggatcaagctgttctcctgcctaagtctcctgagtagctgggattataggcacccactaccatgcctggctaatttttatatttttagtagaaacaggttttgccacgttggccaggctggtctcgaactcctgactaaagatgatccacccgccttggccttccaaagtgctgggattacaggcgtgagccaccacacctggcctatatttagctctttaagtataccttcctcctccctcctccacactcaaacccttcttgccaacctggccaccaatctcctgagcagactcctaccccagagccttggcctgtgctgttccttctccaggaatgttgttcccagtgatctacaggacttcactccttacgatgctcaggtctccgatcaaatgtgacctcatcagagagacctcctctgactaccctgttaaaaatcacccttccccaccatccctctccatcccctctctgctcttttcttcctagccaagcattactttctagctcagcgatgccacttgatgtgatgtcctgtatccacttttgtgttatttgtcatcttcgttagagtcaactcctcgagggtgaagacttaagttcactgtgtgttgcttctacctgtttataatagtgttgagtgttcggttgatgctcagtagacacttgcagaataaacaaaaagagaaccaaaaccacactccctagtctcagaaataagagcagcatgtccgtggagcagaaatggaacagaaatacaaaatagttccaaagggttaaacaagcaatcaataaatactggggagtgaatgaatgactaaaatacgaagagaggaaactagaaggatagaggtgggctctaaaataagactagcatctcatggaacagaaatcaaacaaaaatacaaaaaatagtatgagcacatatacaaaagatagtaagcacttgacgagtgagtgaaaggattttaacaggaacagagcaaactagaatactagatgggctaatagtaagagcagtgtttctgtgagccagacatggcacgtgagaggcagtacaaagggcrcacagtaggtgctcagaaaaagtctgttttggctgggcattgtggctcatgcctgtcatccgagtaccttgggaggccgacacgggtggatcacctgaggtcaggaattcaaggccagcctggccaacatggtgaaaccctgtctctattaaaaatacacaaattagcagggcatggtggtgcatgcctgtaattccagctactcgggaggctgaggcaggagaatcgcttgaacccaggaggtggaggctgcagtgatccgagatcgcgccactgtactccagcctgggcaacagagcgattctctgtctcaaaaaaaaaaaaaagaaaaagtccgtttgctgactcgggctctstctgtaggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccggtcaggggccagggagaggatggctgggggaaggcagggaaaggagggggtgtaccagtattaaccctctccccacccacagggacctggacttytctgagtttgtcatccagccacagaatgagtcgaatccggagctgtacaaatatgacctcatcgcggtttccaaccattatgggggcatgcgtgatggacactgtatgtgccaggctgtgggtggggcctgccctgggggttctgggcaggggggcgatcaggaccttcccagtgagtgactagggatgtgagccagtggtgaggttatcgtggtgggaggagtgacaagagtgaatctggacacttctgagaggcaggaagggtaggcgaggataactctccttccctttcagacacaacatttgcctgcaacaaggacagcggccagtggcactactttgatgacaacagcgtctcccctgtcaatgagaatcagatcgaggtgtgacttccatcctacctcctccccttcttcctttctgattccacctccccacccccacaatccacactgactcctgtcctctccccacagtccaaggcagcctatgtcctcttctaccaacgccaggacgtggcrcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctccccactcagcagtgtggttttttcctccatggacttaactaagcaccagttttgtgcctgtgttctgtgttcttatcaaaggccagatgtgtgatgggtgcagctctgagtggttagtgagcaccagctgtgggctgggtactgctgttctaagtgctttgaaagcaccctctgtgtgccaggcacgattccaagcaccaatggcatgcccagttttttccaaaatattttccaaatattgatacgtaatcctcacaacaatctcatgcaagagttgtcatctccagtttcggatggggatactgaggtacagaggtcacagaattgctcagggcttgtcaggaggtcagtatacctcatgtgctacccgagtcggtccctggagtgggtgcttggcttgtctggacccaggactgctactcaatctgcagacatgagctgccctacaggcaatgtggaaatggagcacgtgggacggatgcatccatgtgggcaaatttgtggtttggggacataaaaatactcctctcaggccaggtgccacctgttatctcaacactttgggaggccaaggcaggaggatcacttgggccctggatgttgaggttgcagtgatctatgatcgtgccactgcactccagtctgggccacagagcaagaccccatctcaaaaaaaggatgctattccccagaccacctcacagacccccagtagtgtcctctgagaagattttgtccccctgagacctcctttggagatggtacatgcatttggcagaccagccaacctgccaggacaaatgtgctgtctgtgtgtggcccctgtagtcagccccctctcccatcatgaccccagctcccacaccaggcaggttccctccaacctcaccccagacgacactgaacacctgccgcaggaatttggacataaataagccatccaacccttcacactgatgggtgaggggaatcctgatcggtggcagctgagaggccattctcatggccagggcctcaacactccccccagccttctgcctttgcactgggtctgggcagacccactgtgagggtcactcagccccagcatcgccacccgcaaacctcccagtcactctgctgacacaggcagaagtcaaggcagttgctgtgaggagcccagctcaaactgacttagcaaaagtaagaacagaaatactagtttcaggtatgactggatccaggaactcagaagctgtcatcgaaggctcgtgaagaccatatgactgaagcactacaatcaccccattttgcagataaggaagcaggcataaagagctgggtgagaatgggctgtaagggccaggcgcagtggctcatgactgtaatcccagcactttgggaggccgaggtgggtggatcacctgaggtcaggagttcgagaccagcctggccagcatggcgaaaccccatctctactaaaaatacaaaaattacccaggcatggtggcacatgcctgtaatcccagccacttgggaggctgaggcaggagaattgcttgaacccaggaggcggaggttgcagtgagctgagattgcgccactgcactccagcctgggcaacagagcaagactccatctcaaagaaaaaaaggatatcatactaaagaacagaaaaatagtaagtttcaaacaaacggggagaatagaatgaagaataataatccagaagaaggcaagaataaagaaatagagaacaggtggacaaatagcacgtacacaacaatttgcagataagatctctgctccctccagttcaagggagggaactgggaatgaggcagctgctttgagactgatcaagactgccatcgtgccaggcagacagtgggggaagggcaagtaaaaatgccacaatactcccattttgaagatggctttttcttggttggacagttgctgtaaactttttttttttttttttttttttgagatggggctcgctctgttgcctaggctgcagtgcagtggcgcgatctccgctcactgcaagctccgcctcccgggttcaggcctttctcatggctcagcctcccgagtagctgggactacaggcgcctgcaaccacgcctggataattttttgtattttcagtagagacggggtttcaccatgttagccaggatggtctcgatctcctgacctcgtgatccgcccacctgggcctcccaaagtgctgggattacaggcgtgagccaccgcgctcggcctgctgtaaacttttgaccattgtatttgtctgttctcgcactgctgtaaagaaatacctgagactgggtaatttataaagaaatacccgagactgggtaatttataaaaaaggctcatggttctgcaggctgtacaggaagtatggctgagaggtcttaggaaacttacaatcacagtggaaggtgaaggggaagcaggcacgtcttacctgccctgaagcaggaggaagagagtgaagtggggaggtgccacacacttttaaacaaccagatgtcatgagaactcactatggtgagaagagcaagggagaaatctgcccccatgatccagtcacctaccaggccacttctccaacaatggggattgcaatttatatgagagttgagcggggacacaagtccaaaccatatcaactattttccagcactctgacacagttagctctaacaattctgtttgctttttgatgtttctgttaaggagccagagcctggagcttcctagtcttccattttggtgacatcactcttttttttgagatggagtctcactctattgcccaggctggggtgcaatggtgccatcttggctcactgcaagctctgcctcctgggttcatgccattctcctgcctcagcctcctgagtagctgggactacaggtgcgtgccaccatgcccagctaattttttgtattttttttttttttttttttttttttttggagatggagtcttgctctgtcgcccaggctggagtgcaatggcatgatcttggctcactgcaacctccacctcccaggttcaagcgattctcctgcctcagcctcctgagtagctgggattacaggcacgcgccacgacaaccggctaatttttgtatttttagtagagacagggtttcaccatcttggccaggctggtctcaaactcctgacctcgtgatccacccgcctcagcctcccaaagtgctaggattacaggcgtgagccaccatgcccggcctaatttttttgtatttttaatagagacggggtttcaccatgttggccaggatgatctcaatctcttgacctcatgatccacctgccttggcctcccaaagtgccgggattacaggcgtgagccaccatgcctggctgacatcactcctcttctgtgttatgggtttttttttttttccacacacaacatggatttttatcttttctttttcttttcttttcttttttttgggggggtggtataggatctcactatgttgcccagcctggtctcaaactcctgggctcaagggatcttccctgccttagcctctcaagtggctggaattataggcctgagccactccactatgcctagcccgctttatcttttcttggcttatcaactataactcttagatttttggtttgggtttcttttttttaaaaaaaattattattattatactttaagttttagggtacatgtgcacaatgtgcaggttagttacatatgtatacatgtgacatgctggtgcgctgcacccattaactcgtcatttagcattaggtatatctcccaatgctatccctcccccctccccccaccccacaacagtccccagagtgtgatgttccccttcctgtgtccatgtgttctcattgttcaagtcccacctatgagtgagaatatgtggtgtttggttttttgttcttgcgatagtttgctgagaatgatggtttccagcttcatccatgtccctacaaaggacatgaactcatcattctttatggctgcatagtattccatggtgtatatgtgccacattttcttaatccagtctatcattgttggacatttggattggttccaagtctttgctattgtgaatagtgccgcagtaaacatacgtgtgcatgtgtctttatagcagcatgttttatagtcatttgggtatatacccaataatgggatggctgggtcaaatggtatttctagttctaaatccctgaggaatcgccacactgacttccacaatggttgaactagtttacagtcctgccaacagtgtaaaagttgggtttcttgtttaatttttagagacggggttttactctgttgcctaggctggagtccagtggtgcaatcatggctcactgcagccttgacttcctgggctcaagcgatcttcccagttcagccccccaagtagctaggactacaggcgtgtgccaccatgcccagctattttttttttttattttttgtagaaatggtgtctcgctatgttgccagggctggtctcaaacttctgggctcaagtgagcctcctgcctcagcttccccaagtgctggggttgcaggcatgggccaccacgcccagccaactgttggttttattttagcgattgctttagggtttatattattcacctctaacttatcatagtctaccttcaagtgatatataccactttgcatacagtataagatgtttagtgtacttccatttcttcttgctcagcctttatgctgttgtatcatgcattttacttttacgtatgttataaaccccaaaatacactgttatttttattgaaacagtccattttcttttttcttttctttttctttttattgtgagacagggtctcactctgttgtccaggctggagtgcagtggcaaaatcatagctcactgcagccttgaactcctgggctcaagcactctttccacctcggcctcccaaagcactgggattctgtacacatgaaatacaattttttggccaggcgcggtggctcacacctgtaatcccagcactttgggaggctgaggtgggtggatcacctgaggttgggagtttgagaccagcctgaccaacatggagaaaccccatctctactaaaaatacaaaattagccaggcttggtggcacatacctgtaatctcagctactcaggaggctgaggcaggagaatcgcttgaacctgggagtcggaggttgcggtgagctgagattgcgccactgcactccagcctggcgacagagtgagactctgtctcaaaaaaaagaaaaaagaaaaaagaaaaaaaaagaaatacaattttttgtagagaggagggtctctgcaaaaagctactgtgccctgactcaccttatttttttaaagatattttcatgagtatagaattttaggttgacagtttttaaaaaattttttattactttgaagattttttgtttttgtttttgagatggagtcttgctctgtctcacccaggctggacagcagtggtgtgatctcggctcactgcagcctccacctcctgggtttaagcaattctcctgtctcagcctcctgagtagcttggactacaggtgtatgccaccatacctggctaatttttgtatttttagtagacacggagtttcatcatgttggccaggctggtctcaaacttctgacctcaggtgatccacctgcctcggcctcccaaagtgctgggattacaggcgtgagccactacgcccggccgcttcccagtcttcttgtttgcattgtttcaagtgagaaatctgatgtcatccttctctttgttcctatgtatataacatgtcccatttttcccactggctgcatttaagattttctctttagcgctggttttgagcaattccgttatggtataccttggtgtaattttcttcatgtgtttgaggtcgtttgagccttctggatatgtaggtttctggtgttcatcaaattt

SEQ ID NO: 10580 - DNA, 15293 bp, Homo sapiens
ttgtggacaaatgcttatatctactctccacagatactaataaattagttcttttttttttttttttttgagactgtctctgtcacccaggctggagtgccgtagagcaacctcggctgacagcaacctccgcctctcagtttcaagcgattcttgtctcatgcctcagcctcccgagtagctgggattacaggtgcatgccaccacgcccagctaatttttgtatttttagtagagacggggtttcaccatgttggccaggctggtctcaaactcttgagctcaagtaatctgcccacctccgccttccaaagtgctgggattacaggcgtgagccaccacacccggctgaatagttcttaattctatccaaaaataagaatcacatacagtttcatgacaataattttaatttttaatttaagattacttaaaatatatcctaaatattttcctcaccccaagcacaatggactgacaaaaccaacagcccctccctgcaaccctagggttcctgttggggaaacagcagctgaactgagtagatcgctgggtcaccatgtctccccaacccccagcctcaagccccagccaggtgtgcagtcacacggctgctcctgtaaggtcagaaacccagttacctgaccacccagctgcaggagtgtggtctcctccgctccaagcaaatcttgagggctcaacacgatgttttctgctaattttcttgacatcttatgcctataccaacctttcagattggagattcaaggtagacacctttccctgctccttcttgttaaaccaacccccaccccttttagaattcttagccatatccttttcctgaaagactcttgccttgacaatttggttgagacgttctctctgtcttcctggcacgtggaataaccaacacctctaacaacagatgtattgttgctcattgcttgtcaaacttagccaatctgaaatcactgtcaccacagacaacaggcttctaaagatttgggacagacaaaaaagccaaaaatccaccatctattcagcaccaagagccctgtgggtgcttaagcacagtggacaatcagtgattgagacactgctggccagtggctgtcctgttcatggtgacctgtcaccctgctgagggacacaggatggtgaaatagagccagcctgagctttgaaattaaacagatattggtttggaatcaaatcagcttcttactatgtttaatttgggcaataacttttgcttcctgagcctcaggttcttcctttgtgagcttggtgaccttgccccactggattgctgtaaaacagcacatgcggccgggggcagtggctcacacctgtaatcctaacattttgggaagccgaggcagcgggatcacctgaagtcaggagttcaagactagtctggtcaacatggtgaccctgtctctactgaaaatacaaaaattagcaggacatggtggcaggtacctgtagtcccagctattcgggaggctgaggcaagagaattgcttgaacctgggaggcagaggttgcagtgagctgagatcacgccattgcactccagcctgggtgataagagcgaaactccgtctcaaaaaaaaaaaaaaaaaagacagatgcaagacctgagcactaagccccagtgtgagggccctggcaagggtcttcataaattccagaagggctactttggcagccaaagtggatttttctggaacattatgtgcatgctcgaagtaaacagtttaattcatcttctcatcttgttccagaagtcctcatttatcttttggggtttccggcctcactctccagccctggaagcctttgaccccagcccccttctgagttcagggctcttgcattcagtggatcatgtggcatcccacatccccagtcacttatctcgataaggcaccgtgggagggaaagctttggcaaggaccattgcgtctgcgacaggggtgcagaatgagggaggacagttacaaggttctgcagctctctactcatctgaaaatgatgaaccatttcctgccaagaccaagcaacttgctaagtaatgatctggtaatggcatctgctgtcctctgcccagcacatttgtcttcctgtgtggacacaggaaaggctataaattaagtccggcgctcttgctcatcccaagggttcctagtttgctgctgttttaaggcctggtggcttggagtaggtgccagtggtgaagggtgcatgtgtttgacaggagttcccagggatgtctggggcagagggttgccctcaaccttagttgagggccgataatgggccaagaagaaatggacaaggtctcattccattcaatctcctgggcaactccaggagaaggatgagctgggcaggattaccgccatttgggagtgaagaaactgatgttcagagcgggtaagtaatgcattcaaggttgcacaactagtaaatgcttcatcggagatttcgacacaatcagtttgattccaaaaccactatttgtaaccactgtggtacacactcctaaacaaagccagtgactgtagaatctaaacaatgcaattggagatacatacacatgtggacaattatggccataatatacacaaaattcacggtttcatggaagggaggaatgggatcttggaagaacacaaagatagcttctcaacttgagtggtaagttcatggatgttcatgttatattggatttcataactcctgtgtgtgtgtgtgtgtgtgtgtgtgcgtgtagcaaacagtatataaagaaaatatctaatgcctttttcaagacccaaacagatgccctcagggtgaataattttcaccaagaaaggtaaagaaatttattcatcagaattattgcactgaatatgatactaggtgctattagagatttaaaatacagttcctgtctgcctgatataatataaggagctgagcctaatgggtatgagaaatcattttagaggtttcacagaggtcatctgaccattaatttactttaaacggattttctctaatctagagaaaggatgctcagaaaaagactagaatcgcaagcgcactcccttggctgtgctttgtgggttggggcctgactctcgccgggtgggagagctcctgggagctctattcctgctgccccggcatcagcagccatggggctcaaggagacaatgggttggggaggatcatgtgtctctttctgcttcttaaatccttttgcaaaggagaggaaaggccctcttcaggatggaccatccccaatggtaaatcacagtcagtgccatccatgagcataggagctgttcactgtggcaaatacaaatttagtgtaagtgctcatcttggctcccctggtggaagggcaggtccttgaagacaggcacatcccaccacgtccagcctggaaactccctcagagtgcaggtgcaaacgcatgtaaaatcattgtaaaattaatgcagtgatggctgcctttagcattgctgcatcctctatcctagagaatttcagtgcctgctcacctaggcctgggcctgggccccacagacaacacttaccctcgggattccccccagccccctctcttccttctgccaccaccaatatctctcacatctgataattatttcttcctctggatgtgacaagtgctatctcagaaatcgggcggcaatatgttcatggctaataagccactagcagcagtgggtatgcaggaccccaggcactttccactctgggctacctcagaggcacggtgttgcacagtggtttgggatgggccggaaccagagccttctcattccgtccttcctcacccccagagcataaagtagccctattcctaaatgcaatgctctttcaaacaccagctgcacacaattgaaaatagcctgagaaagcctgttgtacgagcgttcacacccctgcccattcagagtgggatgaagagcaaatgacacgtgctcccagctggccctgaggctggacacagcctggactgagccagtgtccttgcccccaaagaggaggcttcccctggcctcacagacatctaaattgtctgatactttccatcccacacactgtttatggcccatccactctcctttttattcccagaatgatatctccagaacaaaggagagagtcagtggacagctttgtgttgacacacataagtaaatggaaggtgggaaggacaagtggcataaggagggagaatccgcctgggagcggattcccctgggcagggaggtcggcagtgatggtggcacagtgggggcccgagtgtgccctgaaggtaaattccccgtggagcacaccaacagttgctgacctgcatgtaaaagtttgctctttgattcctttgctagggcttcactcaggcacacaacttcatgcttgctatttgtttttgtttgtttgttttttgagaaggagtctcgctctgtcgcccaggctggagtgcagtggcgcgatcttggctcactgcaagctccacctcctgggttcatgcctcagcctcccgagtagctgggactacaggcacccaccaccacgcccggctaatttttgtatttttagtagagacggggtttcaccgtgttagccaggatggtctcgatctcctgacctcatgatccactcacctcggccttccaaagtgctgggattacaggcctgagccaccacgcccagcccactgatatttgttatgtaatcaactaatgacaaaagagtgcagaggcatgatgagtgttacatctgccaactgctgggttgtctgaatagattctcaagcgaccatctgaggcccactcagaagtttcagtagtgccagaaggtcttgacctattatttttaaatcaagtaattcttagggttttttttaagtaactcaaactaggaaaaaaacgagtcctggataaccattgtgtagcagcatcactgccaagccatttgcaataacaacttcccagaagctcttatctgcccccaaattactcttatctgcccaaaagtaaagaaagtttcaattcagcaagtcagagcaattcacagagaagaagcaatgcactgacctctggcacagaaaactagaagttggtccttctccatttcttctgttaaccaaggttctcttggcatttaattttacaagggccagagacaactccagggatctcaatgcaatcctgcttctggatgggacaaagaaggcatcagccgcacaggagaaaatcacagctgtcctttcattctgttcaagcacacatgaagctccttctaggttcatccactgtgtgccaaacacctgggacagtcagagaagaataatgatgccagccttctaagagctggcagaccagtgagagagcaggctcaagacatggcagagtcaaacacagacagaaagctatggtatctcagaggaagatgatgagatttggaaagctcccagagaagatgggactggagctgggctgcttagcactgaaacagtggatttggggagaatatttgcatgcaagtaaaatatgcaaaagatgttcaaagaacaaccaaaagtggtagaaatgtggagtgagaaatactgaaatgtccacagctcaggaaaacatgttttccaaccagcatccctgaccattcccccttccccaggtctagggcatctagagcaccaaaattaccagcaactctcatctttcctgacccctccttacttcacttttgatctaaaagtacattccggcctcatctaaccatttaaaaagccattttcaggtccatgtcagtggctcaattgagatactgcaagacagtgtggtttttcctgaagtcacaagttatcaatgaagttcagagtaagtcctgaactgcagagggaaagtgtgctgatccaggcagagttgcctaaatgaaaacgctggccaccttcctctcggtcccatattgatctcgagttggaagaggtgagtcctgtctcaaaatggaggtaaaaccgccgcctggttgcccccagcccgactccggcagtcgccgtcgccactggggggaggagggccatgatccaaaggaaccagagcagctgagaaaactgtttattggtggtctgagctttgaaactacagatgatagtttaagagaacattttgagaaatggggcacactcacagattgtctggtaatgagagacccccaaacaaaacgttccaggggctttggttttgtgacttattcttgtgttacagaggtggatgcagcaatgcgtgctcgaccattcaaggttgatgggcgtgtagtggaaccaaagagagctgtttctagagaggattctgtgaagcctggtgcccatctaacagtgaagaaaatttttgttggcagtattaaagaagatacagaagaatataatttgagagactactttgaaaagtacggcaagattgaaaccatagaagttatggaagacaggcagagtggaaaaaagagaggatttgcttctgtaacttttgatgatcatgatacagttgataaaattgttgttcagaaataccacactattaatgggcataactgtgaagtgaaaaaggcccttgctaaacaagtgatgcagccggctggatcacagaggggtsgtggaggtggatctggcaattgtatgggtcrcagaggaaactttggaggtggtggaggtaattttggccgtgatggaaactttggtggaagaggaggctatggtggtggaggtggtggcagcagaggtagttatggaggaggtgatgtggatataatggattaggaggtgatggtggcaactatggcagtggtcctggttatagtagtagaggcgggtatggtggtggtggaccaggatatggaaaccaaggtggtggatatggtggcggtgttggaggatatgatggttacaatgaaggaggaaattttgrcggtrgtaactatggtggtggtgggaactataatgattttggaaattacagtggacaacagcaatcaaattmtggacacatgaaagggggcagttttggtggaagaagctcgggcagtccctatggtggtggttatggatctggtggtggaagtggtggatatggtagcagaaggttctaaaaacagcaggaaagggctacagttcttagcaggagagagagtgaggagttgtcaggaaagctacaggttactttgagacagtcgtcccaagtgcattagaggaactgtaaaaatctgtcacakaaggaacgatgatccataatcagaaaagttactgcagcttaaacaggaaacccttcttgttcaggactgtcatagccacagtttgcaggaagtgcagctatcgattaatgcaatgtagcgtcaattagatgtacattcctcaggtcttttatctgttgtagctttgtcttattctttttcttttcattacatcaggtatattgccctgtaaattgtggtagtggtaccaggaataaaaaattaaggaatttttaacttttcaatatctgtgtagttcagtttttctacattttagtacagaaactttaacaaaatgcagttttgaaggtgtttccttgtgagttaacaagtaaagaagatcaattgttaattactattttgtataaattttgctaaagttaactgtaaagaaacacctgctgacttgcagtttaaggggaatctattctccccatttccaaaccatgatatgaatggacgccgacatgtggagagaacagataatttgtgtgtttgcaatgtgtgttttaggtaaataggattgggtatttaaattagcatttgtgaatttaatagcattaagattaccttcaaataaaaaagtctcaaaatttctttttggtttttgtgcactttcttttaaaatgtaatcacatgattttagtgtgttagacttgctgagtcctagctgtgtttagaacatctccattctacatttaccttggtcaaatttgaactgctgccataggttttgggtgtaaagaatgtttactgccctccatttaaattctgaaaaggtatagtggatgttttccctctcctacattagaaaccattcttaaaaacttttcaaaatatagaaccattaagcctgctatatctgagcaaattagtgggtaccttttttccttttttaaagcacaagaggcccataaatcttgagttatttgcattagtttacattttttgatacaacttttcagaccaagagaataaaaatcatgcgttattaaacccctagctggctggcatgctttcctgtttgtactgtatacattttgctggatgaaaccaaggatagtttaggtataattgtccaaaataacctaactgcagcagaaatgtaggacagttgcttagtacaggcttctcacttcctacagacctgaattcaaatttggatagtctgagttattaaattcccaaagacaaagaacacactcttatttcttgtgtatatttcaacataaatcatgttgttaccaatttgttgggaaggccctggttgagaagagttttagataataaggctgtatatatatagatatatatagatatataccaatgtctatatatagagatattttatatatatatatacaggtatatatatgtgtgtgtatatatataggtatatacatatatacatatatatatatatatatatggatatatacccatgtctactgttttgcttcagctagtgcttacaatttcattcaagtcctgagtatgtgtcctgctgttactccttctttggtagttgaacgttgaattcaagtctttccttctgttttaagaagtactaagcaaacaagcaataaaaaggggaatggcgcatgctagtgtttgaatatgctctcttgttgctctaattctgtgcctccgtgcattaatatttggatgcatgcaatgccagcatggaaattggccttcacacttactgcagttttccagaaacactcacaagccaataaatgtaacagacattccatttttaatgggcatatatgtgaaaagcagtgtagaaaataggctaatattagaaaatggttaagtccttaataacttcaagtgtggttatataatggacactgtcaatgttcataacttaaacctgggtacctggtcaaaataatgcttgggaaacattaaaattgagctaaattgtctcaagttcttttattcatataaataaagtttaaatgaatgggggagattttaaaaaagaagaagaaaagaaaagaaaacgctggccacaggccctcaacatcctgcacgggcatttcagaaaggcggaaggattgctgtggggctcttatacctggaacagctctgctaagagctcctctctggtgaggcaagcatgatgaaaagattactataattcattcctttttttaagtaaagcaaacacattaaaataagttatatataattcacgacaaaacagaattgctgggacagaaatgcatgtggacatggtatttgagcaagaaatttgccaaataatgaatttagttttatgccccaataaatgcctttgttttcatttcaaagagcaggctatgtccctcatgatttccaaaacactatctcagctaagtttgttttagtttagtaacaagttaatgttgtgttctctggttttgtaagtttttttgaaggtgcagctgtcaatacatgtattgctaaatgaactgcatgtttaaaaaataatttacatcaataaaccataatgtcttgattacttggagaaggaatggatactactgctatatttatcactatcaatgtttgaataactaactttaatgtcttaaattattaggctagattgattagttttacaagaagttcaaagcatacaacttattccccaaagtgggtcttacatgtagataatattttattttccctctgttttcctgtagaaaaattgttctaaattcattatagaaagttacatgccatttaactacctgaaaggtgatgttaatgtgacaattttgtaaatatttctaaaatgcccagaattatactgtatgaatacatcattatttctggtatgtggtaataaaaatattttatttgcatcatttagattgggtttgtctgcaagtaacagagaacctaacagtgctggcttatttgtctgcagcgatgttggggaagcagcccacggctgatctagaggctcaacaccgtcaccaagaccaggccccatgagtagtcctgccccgccgtcctcagagtgaggctcctgtgctgggatcacaggatggctgctgtgctcccagcatttccaggggccaagatgggaggaagaagatggacggcagaggaaggacagaggccaaaggcacaagcgagcattgtcagatcaccaaaaagatttttttgctttaagccccacccctagtgacttctgattccatccaaacacccaaaattgggtcatatgtcccccgcttagctattaaggtatctgtagagttagatacttttcagtaggtattgacatacaagggtgctcttaggaagtagagaagaatgaacattgactaagcaattagctgtttctgccacaatgttgtgattttactgacttttattgcttgtggtagaaccttacattgcatggactggttctggatttcttctatttcacgtacacaggaaggatacttccacactcccttgaagtcaggcacaaccagtgcctgcctgcagctaatgaagggtgggcagaaacgatgtgtgtagctcccaggctgaagtacctaatgcagtgcctgactgagccctgccttccccaccacagcaatcatggaaataagtgtcaagttggagcggtcttagagtgataaatacaagccaagctctcccacaacccacagtagatggagcacttgagcaagaagcaaacctttgttcttttagcccccaggacttggggcttgtttgttatcatcaaacctggcctatcctgactggtacaaattggcagtaatttctccagtgtcctcaattaaatgtatgtatatgtttgtttaataaataagtggggatatattaaaatgtagcatacatttaaaagccaatagcatttctttaaatataaagggttgaaaagtaaatgatctatccctttttcacagtttacatcctggaatgacactggtttagatgaaaagataagtataggggcataaggaggaagaagatttgaggagttaaagtggctttttgaagaggatacggaagaagatgaggacccctactaaggaaggtccctattgatgggaagcagttatccatcatggagaagctgggccctcctccatcctaataagccctaataaactgatttttactgtttgttttgaaataattttagacttacaaaaatgtcacaccaatagtccaaaggatcctccctcgacttcattcaaagcacaatctcctgcttttcctcctgctgatcaggaaatgtctctgctttcttggcaagctcatccttctttacgtacagttggaatgttagagctcctcaaggcggcccccaggcccccttctctgtgccatctgcactctgtcctcagaagaactagtgtgcacccaggcctttggttaccgcacagcatggtagtgactcgcaaacatgtaccttgagccagaccactcctcacatttccaagcttttgtctgcatattgtccttggtatatctagtaatatccaattgtatacttaatattggctcttctctggctcaaatgaacctcacagtaaagtcccaaacagaacttattcctttccccatctacccacacctggccttcctgtctcctggtgttttctgtttcactgaatgttactagtgtgcactgaagggtggaagccatggatctcgcagtgctgctcagcatctctccaacttatccttcatattctacaacgaatgtcccttttctggggaagcccttcctggcctcccagacagacctaaaactgcccatgtcaccttcactgcacttatgatacttaggattttataattatttgtatagtcacttaatatttgtctcttcagttaggccagccatcagctcattgacagaaggactgctctctgattcagggtggggtccccacctcctaactcacaagctcagtgctcagtaggtgtctattgaatgaatatatgatggacacctttccaacatatgactttgctcctgaaagttctggattcccttcctctccttggtggatcacttaagagagggaagatcagttcacttccccttcattgaatcactcttgtgtattctcaagagatttcataaggtcagacaaaatcaacttctcaagttcaagccagaactctttttttacattaccagtatttcagaaaccgaggtcctcatttgttaaaagacaaagagaactcatccttgtccaagccaacagtggacatagaagagcatgagcacacttggccaaagtgcatcctaggaggaggcccagcatacacaaaggccctgaagccagagctcacctggtatttgcaggaagagcaaggcctccagagtcaggagtggaatgggtagggaggagaggcttttccaacacgagaagccatggggctatttgagagcaccagcagaggaggtgcagagctgaatgtatgttttaaaagtcttaccatagctactatgtagagaagacattgcaggggctgactgcgagggaagaattgggagacagcgctgctacctctcctccgctactctctggctcccctgaacagatttagaaagagaaggtttatggggaaatcaggtggaggaaagaggtcagggaaacagtacagggagcagttctctggtcaacgccaagagtcgttcccttgccaggcatggcagggcttggtcgtggcctgggttttgagccatgacagaggaagttactggcctttgaactaggctgatggatttgctccatcttgggctaggagacaatgattgaggtcagctatcaaagcctttctatgaaacctccaraaagtaaccacagctcagacctaagactgctcagtggcctgagagccaacaacatgggcctgtgaggggagagatgaccacaggccccaagccgttgtccctccctatctgtcccaggctcagacactgccagcttctgcacgtgattcttggttcagccccttaggttcccatgctgtggaaattcccccaggattctgaagaccaggtgagtggcctcagtaggagcacagccctggggtccaggaagggctagacatgacacccatcgtgccccttgctggctgagtctgtggggttgtgcatgcctgggcgggtgggtgtcctctgtaagtggggtcagttactccgccaaccttgatgagctgctggaagtacccagcatgatacctggtatgcaatacacatgcagtaagaatctgttagtatccaagcgtttctgtttcttcctaggtcttttcatggaaagggagaggaggttgtatctggaattcttaccaggtgccattttccatggaaacctaaaatatattttggaatcatgtagagctagtcccttctcctagttttctttttaaagtttcctaattgcttttctatataggtttgtacagattctctaaagtagcctaagaatctgaatggtcctgggttgagtttggtgctcctggctgggaaggggtgaggcccactgctgagaagtgactgacgtctagctgtggccccaaaagaaggtggaaggaagcagcgtccggctctctgtgactccatccacacaggagggcttgcccacaccatcatgacgggctgaatatttggaaacttggaaactcagaattcagttttggtctcctccactctcaggaaacccagatgacatgtgtctgtgcatgcacatggccctttggctacacagggcaaagtgaaggctggtggggcccctggaaataagcaaataaagagcagcccccactgtcttcaggggcttggtgtcctgcagtgggaggtcagtgcccctgcagagcctgccctgtcttgccaccagtgcctcccagaagcctggccccatgcaggaagtgcttatcagtgagattgttgaagagcaaacagtcaatgtggtctctaccacaactggcatgattaatttaggggctgagtcagctggctatgacaatttttgtccccttctgcatatagaaaccaaaactctactgtaggctggttgtggggagagggcattaaactctgacaggttgcaaatgtcctggggaaaatgacctctgctccctctgctcccacccggatccctgctctggaggcctggactaattagcgtctggcaggtgtctggaaagagctgcctggccggccatggtgacatcatggctgggcattgctcccccattccactgctgagaaagtctctgtttcattaggcttccaggattactttttaattttttttaatcccctttgtaggttctggctccaatcagtcttggagaacattctgcacgctccttcccactcccactgcctcaacaactgtgctccagttaaagttactgttcccggaggagtgaggctcaccttccccaggcagcaggcgcagccctacaacccagcccccacacatcagcaccagcaacccacactgctgttgctttatactcatatactagggatggagatttcaatgtggctgctgtgttctcaactttgtgcttttcagatgtttctaaagggcttcttcatcacctcacttgttcctggattgtagttggaatgcaatttagatacttcaaatagttaagttggttcagacatttgtagtcttgggaataatccacttgataagttgtggaataaaaaaagctaaaaacctgtgttcacggaactatacaaaacaaagagtgaaccctacagtaacctagggactttaattaataagaattcatcagtattggttcatccattgtacaaacattccacattaatgcaatatgtttgtaatagggaaactggggtcaggggagagcatgtgggaactctccattgtgtctgctccacttttttaagccaaaaactgctctcaaaaattgtctgttaatttaaaaatagtaatatgagcaggagagaagtagatggtggc

SEQ ID NO: 10581 - DNA, 7765 bp, Homo sapiens
tgtaatgcagaagaagctcagggcagagctattcacactttacaccagtgctgtttcctcaccatagaggttcctgaggtcacagtgttttccaagtctcyygtgacactgggtcagcccaacaycctcatytgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgmtgatgagatttatgactgcaaggtggagcactggggcctggayragcctcttctgaaacactggggtaaggatgagtttcaccattttttgatgctttcttgtctgtcaagttcagaacttcctgccttttactctatatcccaaaacttgttttccacacttcatgagtttcttttgtcttttttttgaaagaattaagcaacaaaagcacagatttattaaaaaagaaagtacactccacagggtgggagcaggcctgccacttcatgggtttctaataacagacttcactctcctccctgagccaggggccttgagtctttgcagagccaaccctccaccccatcccatccctcacacatgcacatgagcacactctgcattctgacctcaacaacttcacttccacagagcctgagattccarcacctatgtcagagctcacagagactktggtctgygccctgggrttgtctgtgggcctcrtgggcattgtggtgggsacygtcttsatcatccraggcctgcgttcagttggtgcttccagacaccaagggcccttgtgaatcccatcctgaaaargaaggtaagtttgagatttgttagagctgaagctgcaggaaggaaagtgggaggaggctgtggacatgaatgtggttgaaagttgtaggggaattgggaagtggcatgatgatgacacaggagcccccttggacccatcgatctcatgtctgtcctgttgcaggtgcatcaccatctacagcagcggaagagtggacttgctacatgacctagcaytattytctggcccgatttatcataccctttttctcctgcaaatgtttctcctcttaccttttctctgctttttttttcttaagcttctgtatcccctcagagctcacaaatgcctttgaattctttccctgacctcctgatttttttttcttttctcaggtgttacctactaagagatgcctggggtaagccgcccagctacctaattcctcagtaacmtcgatctawaatctccatggaagcaayaaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcacaaaaatatcaaaagtaaaaatttattctcaaaactttgaatttgtaaagaatgatgacagtagaagccttcctctcccctcctcgcctttagggaataaaaattctttaggtaggaaaagaaatggaagtcagaaaaacattagaaaaagacagtaatgtgggtatctgaaaaggaacaaatacttattcctcacatagggttagtgacaatgggaaaagggataggagtagaagccacagacatatctaggagccctgaatagaggcgcagtctgcctcacctcctgaatgaagctttgctagataaccacgtagctttccctgtgccacccttgcatgaagcagacagtatagtggatatggcaggatgtttctaggaaacatgccgatacaaaacaatgccagtatcttcagaaatccccagccctttcccctcacccctcctggctaaggaaagcactagcttatgagagaaaccctaggaggaacaacacagttgagacaatgtagcagcagctgtgggtgctgtgtcctccactggattggccatttcctagcagaaactctcccagaggaaatggtcagcagtgaccccatggctctaaacagctatgaaatctgtgagggtatttctatccatgcaacctgcatcagtgagtttaaattttaattggagaaaaaagacaaaatattaacacattaattgatacagtatagtttggtgcaaagaaccctaaatccaaatcaaggattcagtactttgaagctagtattttaaactttataaatgggtaaagtatctaacatttctggccttatttttctcttccacaatggaggagtaataatactttccttgcagagctattgatggaatttgaataatcttgatatatagtcaatgccttacatatagtacataaatacacaagaaaacattgtggttatatttataattaatttatttaaaagaatggatcacgttatatgaaaagtacttttgtttttctcagccccttaatgatttaggagattcaaatgtatgtagaactatgggtgaatttcttttcatatgatcattgcaggatattgttttctccaaaatgagagaggctgagatcaattgctaagagaactcttaggatgagaaatcgtaatatttcactttggttttcaactctttaagaagggatatattccctccttgtggcctataagtctttattcaaagtatttcatatgcaacagatgtttatgcatgtttactttggggaggaggtgaagaaagttcaaggagaaaataatttaaaatgcagactaggaatcagtaagcaagggagtctgaacaagtgatcatcaaaaaaatgtccatcacagagcacagagcatttttagggcaatgaaactactctatttgataccacgatgttgaaaaatgtcattatgcatttgcccaaatccacagaatgtacaacaccaagagtgagacaatgtaaaccatggactttgggtgataatgatgtgccaatgtaagttcataaattatagcaaatgtaccactctggagggaaattttgctaatgggggaggctatgcatgtgtgggagcagaatgtatctggcagccgtccccaacgtttttggcaccagggaccagttttatggaagacaattttttcacagatagtggggggaatgtgggtatgatttggggatgaaactgtgaaactgttccacctcagatcaaaaagcattagcaaggttctcataaggaacatgcaacctagatcttttgcatgcacagttaacaatagggttcgcgctcctatgagaatctaatgccaccactgatctgacggaaggcggggctcagttggtaatgctacctcgtccactgcatggtccagtttctaacaggccaccagctggtactggtccatggcccagggggttgggaacctttgggatatctctgcagcttctgctcagtttttctgtgaaccagcaactgctttaaaataaagtctatttttttattatactttaagttttcgggtacatgtgcacaacgtgcaggtttgttacacatgtatacatgtgccatgttggtgtgctgcacccattaactcgtcatttacattaggtatatctcctaatgctatccctctcccctccccccaccccacaacaggccccggtgtgtgatgttccccttcctgtgtccacgtgttctcattgttcaattcccacctatgaatgagaacatgtggtgtttggttttttgtccttgggatagtttactgtgaatgatggtttccagcttcatccatgtccctacaaaggacatgaactcatcattttttatggctgcatagtattccatggtgtgtatgtgccacattttcttcatccagtctatcattgttggacatttgggttggttccaagtctttgcatttgtgaatagtgccaaaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagtttacagtccaatcaacagtgtaaaagtgttcctatttctccacatcctctccagcacctgttgtttcctgactttttaatgattgccattctaactggtgtgagatggtatctcattgtgcttttgatttgcatttctctgatggccagtggtgatgagcattttttcatgtgttttttggctgcataaatgtcttcttttgagaagtgtctgttcatatcctttgcccagtttttgatggggttgtttgcttttttcttgtaaatttgtttgagttcattgtagattctggatatcagccctttgtcagatgagtagattgcaaaaattttctcccattctgtaggttgtctgttcactttgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcgtgtttttgtcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcatgatgcctccagctttgttcttttggcttaggactgacttggcaatgcaggctctattttggttccatatgaactttaaagtagttttttccaattttgtgaagaaagtcattggtagcttgctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggaaaactacaaaccactcctcaatgaaataaaagaggatacaaaccaatggaagaacattccatgctcatgggtaggaagaatcaatatcgtgaaaatggccatactgcccaaggtaatttatagattcaataaagtctgtttttaaaaaggagacgaaaaggtaaccaattatgatcccaaatatataaaataaaacttttagtatgaaaaagtcacattaaaatgcgcaaatgtgctaagaaatttttagcaatagggtttcaaataaatttcatataaatttcaatgattcataaggcaagaatccagcatattggagttgtgtgcatttgtgtgcgtgtgtgtgtgtgtgtgtgtgtgtgtaatataaggggtatactgaatggcaaaatgactagtcatacagaaatctacaaatgctgcccaactcagactcattcctcaagaagtactgtggaaagcaaatttaatgatagtgcattttattaaaaggttgtattcaaaaagtatttatgtaatgttaaaatagcagaattaaaactaattctaaaaaataagagtaaatttttttaatcagctaaaaaagtagggtcattattgacattactataaatggggttacagatcaacctgcatgattttaaatcatgcgatacttaaaaattatttcagttatttgaattatttcagattatatacataaagtgtgacttcattaatatttaatatcacattatttaaaatttacaaaattagtgggtcacagaggctcgtgcctgtgatcttaacagtttggaggccaatggaggaggattgcttgaagccaggagttcaacagctgcctgggcaacaaagcaagaccccatctctacaacataaaaataaattagcgcatggtggcgcgcctgtaatcccagctactctggaggctgaggcgagaggagcgaacccaggagttcagggcttcagagggctaggattgtgccactgtgctcgctccagcctaggcaacagagcaagaccccacctctaaaaataaataaataaataaataaattttacaaaattttaaaaatcacatgaaatatttcaggtttgtacttgccacagacaaactagggatttgaagaattaaacattttattttacttacagtctgtactggcacatagtaagtagtcagtaggtgttaacaattagtgttattgttattttctggagtccaactaacaaatcccatagcgaatgacaccacagggatgaaaccaacaagatccagcatatgggaacttccactagataactcaattttttcagcaacaattcaaagacagacagagagagagagagagagaaagaagagaagagaagagaagggaagggaagagaagagaagctatacatttttaaaaggctgaagaaatatatgaaccatattgatatgaggcaatcagaaaaattgacaccgactgtattaaggaaatagctaattttagtgtggtaatagcattgctgttatgtttctaaaaagtcattatactttagattttcataataaaataattatgaatgaagtatggtatctgaaagtatcttcagaataacccagtgtgcatgtatgattaattgggtgggtttacaaaattgcccatgaattgatcattgttaaagcttggctgttaaaacatggcactcttctctctaacactgttgaagttttctgtaatacaaagttttttaaaaaatgcattccaggaaagtcccataaacataggcagagaaacattctgtttgaagttatgttagtttttaggcttttctcatttttatcacagttgggaaatcctaagtatccaaatcctgcctaagactataggaacctctcaaaaatgcaactctaaagaatgtgtatgcaagaactaataatagcaaaggaaagcaaagtactttttcctttattattggctgtactaagcccccagacttgtttatatattccttaattcatcaaaactgcaaaaatggtctttgagtaccattatagcaataagtaccatactttgttatacgtatcattaaaataatgtgaaaagagatacattcattgtcttcatagaacttacactctagtgggaagaaatatacatatattacataattccacaaacatataattacaaactctgaataatttataaaggaaaagagaacaaggtaaagtgagagagtgttgcacaggaaccaggtataatttgggggagat

SEQ ID NO: 10582 - DNA, 6868 bp, Homo sapiens
  misc_feature (1)...(6868): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggacatgtgatattctgcccttgtgtagcgcacactagagtgggaaagaaagtgcacttttaactggacaactaccaacatgaagaggggaggaagcaggggctggaaatgtccacagactgtgccaaaaaatgaagcccataatatttgaaagtcagtttcttccatcattttgtgtattaaggttctttcttcccctgttctccgcctacctgcttgtcatcttcactcatcagctgaccacgttgcctcttgtggtgtaaacttgtaccagtyttacggtccctctggccagtacacccatgaatttgatggagaygagsagttctacgtggacctggrgaggaaggagactgyctggyggtggcctgagttcagcaaatttrgaggttttgacccgcagkktgcactgasaaacatsgctgtgrcaaaacacaacttgaacatcatgattaaacgctmcaactctacygctgctaccaatggtatgcgtccaccattctgcctctctttacttaagctatccctccataccagggttcattattttcttcccaagaggtccccagatcttcttatggcaattgctgaaattttatcatctcccatctctaaaatcacatattcccatgtaatacaagggtctttccattatgcattcagcaaatccttctaggagaggtctcatcaacctcctactttattaaacatgcccacagagagaagggcacaggaataaagcagaggcaatgtgtcgttgctcccaagcagaaggtaaataagacctctttgactatcaggtggtgaaatgctggtaggagggctcttccaggatgtaatgcagaacttcagggcagagctattcacacttcacaccagtgctgtttcctcaccacagaggttcctgaggtcacagtgttttccaagtctcccgtgacrctgggtcagcccaacaycctcatytgtcttgtggacaacatctttcctcctgtggtcaacatcacatggctgagcaatgggcastcagtcacagaaggtgtttctgagaccagcttcctctccaagagtgatcattccttcttcaagatcagttacctc

SEQ ID NO: 10583 - DNA, 22218 bp, Homo sapiens
catatgtaactaacctgcacgttgtgcacatgtaccctaaaacttaaagtataatttaaaaaaattaaataaaaatatatatacattaaaataaaaaatatttttgtacattaaggttttttgtttatttgtttttaagatggagtctcactctgttgcccaggctggcgtgcattggcataatctttgctcattgcaacctcaacctctcgtgttcaggagattctctgcctcagcctcctgagtagctgggactataggtgctcgccaccatgcctggctaatttttgtatttttagtagggacagggtttcaccatgttggccaagctggtctcgaactcctagcctcaagtgatccgcctgcctcagcctcccaaagtgctgggattataggcatgagccaccgcacccagcccctgctttcaacatgatgtgtatgcaatagattagcactctttaagggaagtgtctaacctgatgggcctgaggacaaacacacagaatcctgtacatcccttcatggacgaggcaatcagctgagagagatcatccctccacaggagtgagacccagaagcccagagaaggctatggactgggagaaacctgcagggtccgagggaagacaggtctggtgtatagatcccgagactggaggtcactgtggtactaaagataacaggagtaaatggcagcacatcatgcccccaaactggccaggactagctacactgagtgaggccagcatggcagaagacaaaacaggcaagggattatttcccctgccacactaagtcagctttagttatgaacaaattcgcgaatttttttttttttttagacggagttttgctcttgttgcccaggctggagtgcaatggtgcaatctcagctcactgcaacctctgcctcccagcttcaagcgattctcctgcctcagcctcccaagtagctgggattacaggcatgtgccaccaagcccagctaattttgtagttttagtagagacggggtttcaccatgttggccaggctggtctcaaactcttgacctcaggtgatccacctgcctcagcctcccaaagtgctgggattacaggcatcagccaccgcatccagccttatgtcatctatttcttgacaccaataacagacaactactctagtcagtaattagttgtcaatatatatttttcttacttaaaatgtattatttaaatataaaattagcacatgtaaatttatagttaaaacattcatgaatttgggccaggcgctgtagctcatgcctgtaatcccagcactttgggaggctgaggcaggtggatcacctgaggtcaggagtttcgagaccagcctgaccaatatggtgaaactaaagtacaaaaattagccaggcgtggtgacatgaatctgtaatcccagctactcgggaggctgaggcaggagaatcaccagaactcaggaggcggagattgcagtgagccaagattgggccattgtactccagcctgggcgacagagcgaaactccatctcaaaaataaaataaaaagaaaagaaaagaaatagataacataaaattcttacgattatttgcttgaagtgaataaagaatgttttctgtattactcttctatgaattacagtagtcaataccattcaatctcaactgttatcactattgaaatggcctcaaaaataaactgccctttcaaaaatcaagcagatggaaaaggaaaaatccatattgatttcaaaagtacagctgccctcatctgaaaactacttcatcttaaatttcctaatatgatcatggctggctgcgattcaccacagcttccaacagccgactggagagcgtttttccagaataactagtatgtttgcttcaagacaaattatttgacaaggttaaggaaaagatgtgaaagctagataatccattaagaatctttttttaaaacttcaaggcattttatttatacttcttttttttttttttgagacagtctcgctctgtcgcccaggctagtgtgcagtggtgcaatctcagctcactgcaacctccgcctcccgggttcaagctgttttctgcctcagcttcccaagtagctgggattacaagcacccaccgccatgcccagctaatttttgtatttttagtagagacggggtttcaccatcttggccaggctggtcgtgaactcctgaccttgtgatccacccacctcggcctcccaaagtgctggaattacaggcgtgagccaccatgcctggctatacttcttagcttacttttttgttacgcgtatatattaagaacttttaaaagtccaaattaaagaagcatgcctagacatcattaaaatagctatcaatgcccatgacaatcctgtagctcaaatagtttactttagaatgtcaaaattgattttgtaatagtcaggacaggataaacagtcgctatattaagaccatgtacgtgtccctagacctagttctttccctacgtctgtttttataaatgctggtgataaaccaggtctgattaatatataatcattttgtgtgattatgtaacggctataattctaggttatctttggtcaaccttaagaaaaatggcagtatatgtaatgacttttgcaaatgatcagtgctaatttgcagacttttgtttaaagagggtttaaacaaaataagaaaatttcatgattaccagttgctattaaatgaattgtaactttttttaaaaaaaaagaatgtccaagccaggtgtggtgctcatgcctgtaatcccagcactttgggaagccaagaagggcagatcacttaaggtcaggagttcaagaccagcctggccaacatggtgaaaccccgtctctagtaaaaatacaaaaagttgctggacgtggtggcacacacctgtaatcccagctactcgggagggtgaggcaggagaatcgcttgaacccaggaggcagaggttgcagtgagccaagatcttgacactgcactccagcctgggcaacagagcgcaactccatctcagaaaaaaaaaatggtatatccagattcacattttttttcaaactctgcatttttctttctttcttttattttttaatgtttttgagacaaagcctcactctgtcacacaggctagagtgcagtgccacaatctcagctcatttctcagctcattgaagcctcgacctcctgggctcaagcaatcttcccacctcagcctcagcaataggtgggaccacaaacatgggccaccacgcccagttaaattttttttttttttttttgagacggagtcttgctctgtcgcccagtctggagtgcagtggtgcgatctcggctcactgcaagctccgcctcccggtttcatgccattctccttcctcagccccccaagtagctggggctacaggcgccccccccaccatgcctggctaattttttttgtatttttagtagagatggggtttcaccgtgttagccaggatggtctggatctcctgaccttggagaccgccttggcctcccaaagtgctgggattacaggcatgagccaccatacccggcataatttttgtattttttatagaggtgggtttttgccatgttgcccaggcttgtcccgaacccctgccctcaagcgatccccctacctcggcctcccaaagtgctcagactacagacgtaagcctccgcacaccttttggactggtgtgccagttcacacatgcctgtgatagcaactgcgttctgaactgcagggatacatttacttgtcagcacctgaaaacttcctcctgagttgagtccaattatcagcttcatgtgccatctgccaatccagatgaaacttggcaaatacaaagctgtccttttccaggtgacactccccaccttctttttcctccaccatttcattaacaactaaaaagctcctgcatgatcagacctgtgtatctatccatcatcaaatcccactcctttttcgagactgggaccctctggaggctgacccagccacgcatttgctagcatgccctgcagacatgaccctcgctgggctctgatcagccttcaggcctccactccaggtgtcactgttctgtctcccctctgctctcacagccttctctgctagatgtctcagccgtgctggccctctctatttcagaagtgaatgtactgagagggtcttagggacttattaataatgctcctggggtcggatgtagtagctcatgcctgtgatcccaatactttgagatcacttgagcccaagcgtttgagaccagcctgggcaacaaggtgaggccccatctctatcaaaaattcaaaaaagtagccaagcatggtggtgcacgcctgtgatcccagctcctcgggagactggggtgggaggatggcttaagctcaggtcaagactgaagtgagacatgaggccaccactgcactccagcctgggcaacagagcaggactctgtctcaaaaaaaacaaaacccactataaccataatactattatcacacttaagaaattcataattccttaatatcatcacatatccaattgatatctgagttcaattatttcatgtcaatgtttttaaactatttcaatcagaatctaaatgaggtcaacacgttgcaattggttggtatgtcttttaaactccttttaatctacaggtttctctttttttgccttgagtttcatttattagagaacccagacattgtcccatatagtctcccagagttggatcttgctagtttcatccccacggcctagtttaacacattcctctgtcctttctattttcttttttttttcttgagagggagtctccgtctgtcccccaggctggagtgcagtggctccgtctcagctcactgcaacctctgcctcccagttcgagcgattcccctgcctcagcctcctgagtagctgggattacaggcgcctgccactacgcccagctaatttttttatatttttagtagagacgggggtttcaccatcctgatcaggctggtctcgaactcccgacctcaggtgatggacccgcctctgcctcacagagtgcaaggattacagacgtgagccaccgcacccggccaaatgtcctttctattttctataaattaacagtcagatctaggggctcgatcagatttgtgtgtgtgtgtgtgccgtgtgcgcgtgcacagcatgttctttgactaggaggcacacctgctttggttatcttctttttgtaatctttaagttgctctttgatgtagacgtggtaactaatgttgaaacaaaattagtttcgtttcaaaacctttctttcaggaagaggttgtggttgattacttctgcgacaggtagatgcaaggttgagcaatcatctcttaacagaagtggtcacactagaataattcaagcacaacaacaaatcccacatcatcaccccctcttaataatggtgttttctttttacttgattagcttttaattgtcacgcactctgcattttttccctgaggtattatttccagaaggcagcgaaatatgactcaatggctaatttgctttttaaaaattaaacaaaacttaggccagctgccatttaagaagggctccggggcctccagactcggtgtgaccgtagccgtgcccggtgctcccctcgcggaggcgttagggcggcaggtttatctcacttgagaccattccttcctttttcatcttctccgggctccggcgcagcaggccgcaggggcgggcactcgcaagaacgcggcatcctggatggtggccgagtcaccgaagctcagaaccccgcgtcccagaatcgctgagagccggccccgcacgggggcctgggagcgccacgcgccctccacccagagaggcaggcgggcgggccggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctgggtgagggccagcgggcgccccgttatgtgcgtgcgtggcctcccggcgccggggcgcgctctcccctcgcgggccctgcgcggtcgtgggcgccggaggcccgttagcagcctgctccccgtcgcgtcccgtcgccgctcgggccgccagcccgcgggtcagcgcgggagaggctgggcgaggagcggggggagggacgggtcctcggagccgcgcagctccgacccttccgcgaagaggcgcaggcgcgtccccgagcgcgggagtccccgccaggcccacgccggccggttggggcgaagggtgtccccggctgtgccagccttgagtagatcttttcgctagaagattcctgtgccctcaggtgggcgccctttcctctcaccactccctctcctccggagcgggccgaggtgagcgggtgccggccytggggctgcctgagtgctaggcagggtgtggtcctgggcatccttgggcctaccagcgagccctgctcagggtgtcgggcgccggcgggcagtactggcgggggcggccgcagtcccggccttgggcccgttaagggggccggcgtccctccatatgccccccggggcttctcggacttgatgggccctggtcggttcacgccgcttgtcccattgatcctcacgacaagcctgggacgtaagaacggcggattcgtaggcatttttcatccatctcggttttgtggatgaaaagactgaaaatggaagacttgccaaataaggaaaatatgtggcgtggcctgctggtcccctgacagctaattgagaggccttaactctccagaggattcgggccttctgtgttacatagagaatgctcatctctcccaggctactcctaatatgctagggattgtgtggaatgctttacaaacattacccaatttcatcctcttggtaattctacttggttggtattatcgctgttttaaaaaatgaaataagaacgcgtgactaaatgctagggggattctaatgcgcattcggttgcctcttccagagcacgtgtttgttttttgtttgtttgttttttgagactgcacgtgtttgtttgtttgtttgtttgtttgttttttgagactgagtctcactctgttgctcatgctggagtgcagtggcgcgatctccactcgctgcaacctctgcctcctgggttcaagcgattcttctgtctcagcctcccgagtagctgggattacaggttcccaccactacgcctggctaatgtttgtatcttttttagttagagacggggtttcaccatgttggccaggcttatctcgaactcctgacctcaggtgatccgcccgccttggcctcccgaagttttgggattacaggcgtgaaccaccgtgcccggccagagcacgagctttttaacctctgttgaggaaacggggaccggtcacggtagctcaggcctgtaatcctagcacttcgggaggctgaggcgggaggatcgcttcagcccagaagtttgagaccatcctgagtaacatagtgagagccccccgtttmcacacacacacacacacacacacacacacacacactttttttaaattgaggaaacggtgagttgaacatgagcaattattccttatatatagtatttccttagtttttcttctcaacattcatttgcccagtgaaaagaaaaagcaagtagctgggaccacaagcgcacaccaccatgcctggttgatttttctattttttgtagagatgggtttctccgtgttgcccaggctggtcttgaactcctgggctcaagcaatctgtccgctttggcctcccaaagtgctgggattttaaaggcgtaagccactgcacccggtaactttgggttcttgaattcccttcctcctcttcttcctcctcccctacactccattagagaaagggtcttgctttgttgcccaagctggagtgcggtggttgttcacaggcatgatgatcactgcagcctgggctccagtggtccgcatacctcagcctgccagtagcaatttgtttggcacatcacttacacatacttgatatgagatagcatgatacttttttgagacggagccgcactctgtcacccaggctggagtgcagtggcccagtctcggctcactgcaacctctccctcctgggttcaagcagttctgcctgccccagtctcccgagtacctgggattacagacgcccgccaccatacctggctaagtttttctatttttatttttagtagagacagggttttgccacattggccaggctggtctcagatgatgcgcctgccatggcctcccaaagtcctgggattacaggcgtgagccaccctgccaggccacatatgatatattttatcaatgccttatctacatgttacataggaataatctagcgtcctacctgtgtaaaaaccaactctggaatactgaaactgagctacttaatattckgaaaatcaggacgggtgtggtggcttttttttgcctgtaatccgagcactttgagaagctgaggcaagaagatcgcttgaggccagttcagaacagccccatctgcacgagaaattaaaaaattagctaggcgtgcatgcctgtcccgctactcagaaggctgaggcgagaggaacacttgaactcaggagttcgaggccaacctgggcaacatggcaaaaccccatctctaccaaaaaaaaaaaaatttaattagcgggacatggtggcatgtgcctgtggtcccagctacacagaaggctgaggtgggaggattgcttgagctggggaggtagaggctgcagtgagccgtgattgccccaccgcgttccagcctgggcaacagagtgagactgtctcaagaaaaagagatgaaggaagtgagaaggtgctgattgatacttacctcacactgagccttttttccccccacagacttatcactgaaccatttcactgggaaagtaaaaggaccacatatttcttggccgggcatggtggctcacgcctgtaatcccagcactttaggaggctaaggtgggcggatcatgaggtcaggagatcgagaccatcctggctaacacggtgaaaccccatctctactaaaaatacaaaaaattagccgggcgtggcggcagccacctgtagtcccaactactcaggaggccgaggcaggagaatggcgtgaacccgggaggcagagcttgcagtgagctgagatggtgccactgcactccagcctgggcgacagagtgagcctccgtctcaaaaaaaaaaaaaaaaaaaaaagaaggactacatatttctcaatgaaaatacagtgtacaatgttttccatgcaggtgtaaatactaactcatgttctgtttcagggtgggagatggaataacctgtagaaagaatctttagatttgtttaaattatacacaaatgataagagatctttctgaaagtattgactttttggcgggggagggaaggggcctgatagaacaaccaacaattgtacactttaagtttacatttagagttcacattaaaagttcatttacaaggcatctgtttgaaattcgtgaggatgagctgggctgggtggctcatggctgtaatcccagcccttgggtggctgaggtggacaggtcacctgaggtcaggagttcaagaccagtctggccaacatggtgaaaccccgtctctactaaaaatacaaaaattagctgggtgtggtggtgggcgcctgtaatcccagctactgggaaggctgaggcaggagaattgcttgaacccaggaggcagagggtgcagtgagctgagatctcaccattgcactccagcctgggcaacagagcgagactccgtctcaaaaaaaaaaaagaatraatcacaagaaatggttccttcactgttatactttaacatgatacagctttttaatgttttattttttgagagagagtctcactgtgttgcccaggctggagtgcagtggtgtgatcataaattcttgggctcaagtgatgctcccgcttcagcatcctaagtagctgggactacaggcttgtgccacctcacctggctaattttttttatttttggtagaaatagaatctgtttgcccaggctggtcttgaacactgggcctcaggcagtctttgtgcctcagcctcccaaagtgctggattaatggtgtgagccacagcacctggccaatagctttattgagattataattcaactrtcatgatttattcatttaaagtgtacagttcagtattttttagtatattcacagagttgtgcagctgtcaccaccatataaccttagaacatttcatcatcaccaaaagaaaccctatactcattagcagtccctcatatcccctgcttctacctaggtaaccactaatctactttgtggcctatagatttgcttattctggacatttcatatacatgaaatcataaaatacctgatcttttatgattggcttttacttagcataatataaatttttttttttttttaatttgtagagacagggtcctgttatgttgcccaggctgatcttgaattcctgggctcaagtgatcctcctgccttggcctctcagagtgctggcattataggtgtgagccactgcacccagccattagcataatattttagctgggcacagtggcatgctcctgtagtcccagctactagggtgactgaggcaggaggatcacttgagtccaggagtttgaggctgtagtgagctatgatggcatcactgtacttcagcctgagtgacagaggtagaccctgtctctaaatattttaaggttcattaaaataatatattttcaataaaataatatttcaataaaataatattttaaggttcattcatgttatagcatatgtcagtgtatgattcctttttctggctgaataatattcctttgtatggatataccaggtgtttaacattttgaggaactgctgtacagttttccaaagcagctgcaccattttatattcccactagcaaagtatgagggttctaatttctccacatccttgtttttacctacctttttttattatagtcatcctagtgagtgtgaggtggtatctatggtttcagtttgcactttcctaatgactaacggtgttgagcctctttcatgtgtttcttgactgtttccgtatcttttggagaaaagtgggttcagatcctttgcccattttttaattggattattagttgtaagagttcttcatatattctggatataggtcccttatgagatacatgatttgcaaacataaccccgcttctgtggattgtctttttactttcttgacagtatcatgtgcaacagaaagtttttgatgctgtccgatttctctgttttcttttgtcacttgtacttgttatagtatctaagaaaccacaaaggccatgaagatttatttctatgttttcttatcagagttttataattttcttataaatttgggtctgtgatctgttttgagttcatttttgtgtatggtgtaaggtaggggtctgaatccattcttttgcctgttgataacargtcggtctagcaccatttgttgaaaggactgttctttccctgattatattggtagcctgtagtattggtttttatatactattacaattttgggaaaattcagtacagaattacttggagcatgttgatttgtctgagaaaactgtgaataccagtttcatgattttagggtaactacaaaatgtatattatattctatcctttgtcagatgtgttaatttaatcgttttatataaggtaagaatgctgtacctctgtctaaacacagaaataacatgtattttaatataaagaatgtggaacttctaaactttgaggctaatttttcctgcataaattctcaaattattgtgacatgatatttcataactttactagtagaatccttccctgtgttattaaatatccactaaagtctctagtaaagggaatatgatttacagaacaaatttaatgtgttagtttaattggtgttaatttaattataattggtgaactattacatacttttcttagttcctgtttttttgttttttctttacagcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttyatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccarcattcctggaaaaagtcttccactggtaagtaaaggatttgatacatattctaattttgttttttcatttgtttgttttttgagacggtgtctcactcagtcgcccaggctggcgggcagtggcacgatctcggctcactgtaacctccacctcccgggttcaaacgattctcatgcctcagtctcccaagtagttgggattacaggcgcatgctaccacgcccagctaatttttktatttttagtagagatggggttttgccatgttggccaggctagtattttgtcagtccaagcagttcattaaaaaaaaaaaaaacaaaaagagcaagaatataaatactgcatcttccagcctacttttacaaagggttcactcttgggtccttaagcttagtggttacacttaggatttatttttaattttattttttaactttatgtttttttagagacagggtcttgccctgtcacctagtctagagtgcagtggtacgatagctcactgcagcctcaactcctgggtcaagcgatcctcccacctcagcctcctgagtaggcaggattataggcacgtgccaccatgcctggctaattttttattttttgtagaggcagggtcttgctgtgttgctcaggctggtctcaaactcctggattcaagtgatcctcctgcctcagcctcccaagtagctaggactacagccacatgctatgacaggctgattttttaaataatttcttttaatcctccaaatggtttgttaaaatttttaacatttttaacatttttatagagctggagtttcctggatgggtgcagtggctcacacctgtaatcccagcactttgggaggcctaggtgagtggatcatctgaggtcaggagttcgagaccagcctggccaacatagtgaaagcctgtctctactaaaaatacaaaaaacttagctgggcatggtggcgggtacctatagtcccagctactcgggaggctgaggcgggagaatcgtttgaactcgggcagtggaggttgcagtgagccgagattgtgccactgcactccagcctgggtgacagagcgaaactccgtctcaaaaaaaaaaaaagagagagatgggtttccctgtgttgcccaggctggtctcaaattcctgggctcaagtgattctcttgccttccagaatgatgctgggattatacatacgaaccactgtgcccatccagatagttttttaacttgagatgaaaagacatttttaacttgagatggcagaattgcacatttgataagtgcttttttttttttttttttttttttgagatggagtctctctctcacccaggctggagtgcagtggcacaatctcggctcactgcaacctccgcctcccgagttcaagcaattctcctatctcagcctcctgagttgctgggactacaggcgcacgccaccatgtctggctaatttttttgtatttttagtagagatggggtttcaccatattggttaggctggtctcgaactcctgacctcaggtgatccacccgcctcggcttcccaaagtcctgggattacaggtatgagccaccgcacccagccaagtgcttaatttctatctaattagcatgccacaatttattagtatttgtaagttcctggatggcagggatcagatgttgcctttatattctatggcgtcatccatgcagtacattctttaataatatcaagttaatctaattgtatgtatttgttgttaattttacaaataagccagatatttagtcccttggaatgtgatgggagagagacctagagggtcgagtgtattcaactgctgctgaaatgtagactgctttttgtttagaattcccacagctgctgctgctgctgcttttttttttttttaagagagaggagggaggcaggtctcatggtttcccttctcagtgtttrtgtcaaccattcatcagtcatctttgaaagaacctagtaacactcatttttcatcttgctgtattttttcccttctaggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggartttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccrggcacggtggctcatgcctataatcccagcactttgggaggccaaggtgggtggatcacctgaggtcaggrgttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtwacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactrataaataaartacttactgaatttccaccattcaaattcatttttcaggtgtgttgactctcacattagaaactgctcaactgataaagactttcatgttatttcactgcagtgggaactggctgtggtctgatggtagatcgttggtctcaagtagctggtagcatgggctgttgttatgtcagcagtcttgcttacctcaaatatgtcacttggatacgtttagtgtaatatggtgaattattttaaaaatacatcagcagctgggtgtggtggttcacacctgtaattccatgcttcggaaagctgaggcaggaggatcgcttgagaccaggagtttgagaccagcctgggcaacatagtgagaccccatctttttttattttttattttttgaaatggagtcttgctctgttgtccaggctggagtgcagtggcgcaatcttgcctcaccacaacctctgcctcctgggttcaagcgactttcctgcctcagcttcctgagtaactgggatcacaggcgtgcacagccatgcccagctaatttttttttttttttttttttttttgtatttttagtagagacaggttttcactatgttggccaggctggtctcaaactcctgatctcaggtgatctgcctgccttggcctcccaaagttctgggattacaggcatgagccgctgtgtctggcccccatcttttcaaaaaataagagtggtgtggtggtgtgcacctgtagtcccagctacttgggaggctgagattgagactacaatgagccatgatcgcactactacgctccagcttgggtgacaaacaccctctaaaaaaaaaaaaaagttggctacattgcagtttcgtaaagaataaaacaacacccagaatgctgagggcggggtgaggagtagaatcctctgtgggactgccaggcctgtctcacagacctcatttcatccccaaaatactttgctttcccttcctgacccccttgcctaggaaaattcctagtatcttctaatctgttactcaaagaacaatcaaagagtgacaatagaaccaagtttacaattcagattttactcagtcactaaagtatctgcaaaacatacccctggatttgatgctagatcatagagatcatgtactcccatcaagtctatagaactctggccaatggcaccgggcgtggtggctgtaataccagtactttgggaggctgaggcaggtggatcacgaggttaggagttcaagactagcctgaccaatatggtgaaaccctgtctctactaaaaaaaatacaaaattatctgggcatggtggcatgtgcctgtagtcctggctactcgggaagctgaggcaggagaatcgcttgaacccaggaggcaaaggttgcgtgagccgagatcacgccctgcactccagtctgggcgacagagcaagacaacgtctccaaaaaaaaaaaaaaggccaggcgcggtgcctcacgcctgtaatcccagcactttgggaggccgaggtgggcggatcacgaggtcaggagatcaagaccatcctggccaatacggtgaaaccccatctctagtaaaaaatacaaaaaattagccaggcgtagtggccggcgcctgtagtcccagctacttgggaggctgaggcaggagaatggcgggaacccaggaggcggagcttgcagtcagccgagatcgagccactgcactccagccggggcgacaaagtgagactacgtctcaaaaaaaaaaaacaacaaccaaaagaactttagccaatggctgcagctgccatgtaaatgctgaaaacctccaaatctatcacttcagacctctcactacctgctggatgcacagagtgggttgtcatccctctccaaaactccagtctccacttacataaccacttctttcctgaatggaagtttcagtcttcgtagcaggcatcccgattattctggctcccatctgccaactcgatccattctttaagagagctaccaatctgggcagtaagaaggctgggccccataacctctaaagaataactccaaacaaaattatccgggcctggtgttgtgtgcatctgtggtcctaagctactcaggaggctgaggtaggagtttcgcttctttttttcttttttttttgagatggagtcctgctctgtcgcccaggctggagtgcagtggctcgatctggctcactgcaagctccgcctcccgcgttcacgccattctcctgcctcagcctcccgagtagctgggactacaggcgaccaccaccacgcccggctaatttgtatttttagtagagacggggtttcaccgtgttagccaggatggtctcaatctcctgacctcgtgatccgcccgccttggcctcccaaagtgctgggattacaggcctgagccaccgcccacggctggagtttcgcttcttgaacccaggaggcggaggttgcagtgaactgaaattgcacgccattacactccagcctcggtgacagagcgagatcccgtctcagacagtcctaagaaatcactcagtagctttgcatgagttctcccttctgttgtaaactcctttctccgtttctcttctggttcaaagtttcacaccttcaaggctcacagcagccttctgttacccacccccagtccccagcaggtcaggtgtcaatttttttgactttgagaaccaatgattatctcttcatggccctaatcataccattgtgtaaataggcactgtttctccataagttgtaactccttaagagcaggacacatcttttatttctgtttcccaaacctagcagggtgtttgacttaaagtaagtgcttgataaatggagagagaccagcagggagagtccttgaacttgagaagctttttctaaaacaaaaacacagccaaagacagggcacttgtataatctttaggtaaaagtattttatgctacaaataatggacattcaatgagaatccttacttttcactgagtcctgtaccaagtgttttacatgaactattgtacttttttgttgttgttcctttttttttttttttttttttgagacagagtcttgctctgtggcccaggctggagtgcagtgttgcaatctcagctcactgcaacctccgcctcccagggtcaagcaatcctcccacatcagcctcccaagaagctgggactgactacaggtgtacaccaccacacctagctaatttttgtattttttgtagagatggggtttcgctatgttgcccaggctggtctcaaactcctgagctcaagtgatccaaccacctcggcctcccaaagtgccgggattacaggtatgaaccacaatttattgtatttaagtctcaacatttatatgctataagcagtactattaatatcttcattttgtagatgacagaaaaggcttagagagattaagtaactggccgaaggtcacacttagtaaactgcagaaactgaacctgaaatgcagactctgtggactccagacccaaaagccttaaccatattccatttggcttacattatgagcctcgtcctgaaacagtaatgagaatgaaaatcacatgttcctattactacatacatactctactgcctcattaaccatttcctgtatgccagcattttggctaggtctctgtttttttccaactcttgaatctaaaattcaaatatgaaacattaatgtttaaatccatgcaaaaaatgcatttatgtattcatttattcattctacagatgcttttggcaggcttgcactaggcagtgaggatacaaagacaaaatgttgccccaaattaaggagctaatgctctagtgctgggaggtacatgttaagaaagaaaggacttaaaacaggagaattaggatgtggctgggactgagtagagggcacacattgctatcgctgatcagggtgagtgctctgccaggctgtacgtgcaaatattgtgctaatccacggcagcctgggaaggtaggtattgtctcccacacttttcacaggaagaaacagggttaggcaagtaactagcctgaggtcacacaacatgggccagggcctgaagctatgtgtgttaaagccaatgctttatgctattcctcttggaagctctttggacaagttcatgtatttcttgttaggaaaatcttctagaagccttagccatttggaaggaagcaagaacagtttgatgacctagggctaggaaggctctgaaaaactgtgcccttgaaatccaagaacattattattattattattattattttgaaacagggtctggctctgtcacccaggctgaagtgcagtggtgggatcatgtctcactgcagccttaaccacctaggttcaagcaatcctcccatttcagcctcgagtagctgggaccgcaggcgtgcaccaccatgcctggctttttttttttttttgagatggagtctgcttctatcacctacgctggagtgcagtggtgtgatctcagctcactgcaacctccacctcccgggttcaagcgattctcctgcctcagccttcccagtagctgggattacagacacctgccactatgcccggctaattttttttttaaatatttttagtagaggtagggtttcaccatgttggtcaggctggtctcgaactcctgaccttatgatccgcctgcctcagcctcccaaagtgctgggattacagatgtgagccactgcacccggcccctatttttattttgtatagggacagagtctcactgtgttccccaggctggtcctaaactccagtggtcctcctgtctcggcctcccaaagtgttgggatcacaggcgttagccactgcctccagccccaggagcatcactaataaatccctaagacctgctcagtacattgacttctgagacagagggccagcatggccgaggcgcctggcagaggaggctctgagagcagaggggagacagagcagtgacacctggagtggaggcctgaaggctgatcagagcccagcgagggtcatgcctgcagggcgtgctagcaaacgcagggctgggacagcctcaggagggtcccagtgttgaaaaaggagtaggatttgatgatggatagatacacaggtctgatcatgcaggagcttttcagttaatgaaacggtggaggaaaaataaggtggggagcgtcacctggaaatgaacagctttgtatttgccaagtttcatctggattggcagatggcacatgaagctgataattggactcaactcaggaggaaggtttcaggtgctgacaagtaaatgcatccctgcagttcagaatgcagttgctatcacaggcatgtatgaactggtacaccagtccaaaagcaggccaggtgtggaggctcatgtctgtagtctcagctattcaggaaactgaggtaggaggattgcttgagcccagaggttcgggacaagcctgggcaaacggcaaaaacccacctctataaaaaatacaaaggccaggcatggtggcccacactttgggaggccaaggcgggcggatcatgaggtcaggaaatggagaccatcctggctaacacggcgaaaacccgtctctactaaaaatacaaaatattagctgggcgtggtggtgggcacctgtagtcccagctactcgggaggctgacgcaggagaatggcgtgaacccaggaggcggagcttgcagtgagccgagatcgcgccactgcactccagcctgggtgacagagcgagactctgtttcaaaaaaaaaaaaaaaaatacaaaaatacaaaaattggccaggcatggtggcttaagcctgtaatctcagaactttgggaggctgaggcgggtggatcacctgaggtcaggagttcgagaccagcctagccgacatggcgaaaccccgtctctactcagaatacaaaaatcaggtaggtgtgatggcaggcacctgtaatcccagctacttgggaggctgaggcaggagaatcacttgaac

SEQ ID NO: 10584 - DNA, 36478 bp, Homo sapiens
  misc_feature (1)...(36478): n = A,T,C or G, or insertion/deletion polymorphism (see Tables 1-2)
gtgggggcacagggtgtgttcagtgatgaggtcaggagtagccaggtgccaagtgccttgcaggctgtggttgcgagtttgggtttattcttggtgtgatgggaggcgaaggaagggttttaaggacattgtatttgggggtgggagtggcttatacttcatgaaagagcgctctgctgggaaaggtggtcaggagccgtagcccagaggccagatgaagccttctgcagtggttcggactagggatagtggctggcccgtgtttgaggatgcagggcagtgggtcagcagatagagttagtagccccagggtcatgagggttctgggaacctcacctccaccctcacccccagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaaggtgtgttggggccacccccctgcaccctgccccacaatcttgtccttcctttgggccctctgtggagtccctgaatttctgtgtccctccaccccagggagcactagccgagagacagcacaccagcatggatctcccgaaattggccagtgacgaccgcccagtgagtgcccaaggcagagaggggcgggggctctgatctggccaggcctgaccgcccaccctcaccctctacagagccctccgcgaggactggtggcagcctacagcggggagagtgacagtgaggaggagcaggagcgtgggggccctgagcgggaggagaagctcaccgactggcagaagctggcctgtctgctctgccgacgccagttcccyagcaaagaggcgctcatccggcaccagcagctctcagggctccacaaggtaacagcggatggttggcagggcatgctggggcctggcccactgaggctcatcctcttcacttctcatcctgtccctcttgcagcaaaaccttgagattcaccggcgagcccacttgtcagaaaacgagctagaagcactagagaagaatgacatggaggtgaggtgtgacctgaccctgggctccctcccctgtgtcccttccaagtccccatcacctcaggcagctggagttcaatttctcacgtgttaaccccgtgagccttcttccccattttcctatcctggctgcttgtgcctgtgatggcctgaccctcaggacctgagcctcattagccagatggcatgccctgtgggaccccactccccatgcctgtgttgcctgagaaaagagaccagctccccaacattcacatacacatacaaactttcagcaaatgaagtaccgggaccgtgcagctgaacgcagagaaaagtatggcatccccgagccgccagagcccaagaggaggaagtacggcggcatatccacagcctctgtgtgagtggctgggccaggtgagggggtctggagcccggggccggggccggcaggccgaccactcatgctgtgcaccgcccctgcagagacttcgagcagcctactcgggacgggctgggcagtgacaacattggcagtcggatgctgcaggccatgggctggaaagagggcagcggcctgggccgcaagaagcagggcattgtaacgcctatcgaggtgagtctcaggcagtcctgtcccatcccccagcacccctcacagcatcccccaccagcctgacagagcctgcctccctcacacaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgcatgttggcctctcctctttctcgtgctctagcacagttgtatagcctatacagacacggggacccaagcagatggacaggggaccttatcaggccaaggtggatggcagtggtggcattcagtgtctggaacataatggctactagaacatggggttctgacctgtaccccgacccataatatcctggttatggcccctctcccttgttggttccagcaggttatgttgtaccaggaaatctagcaccaccaggcatgaagcgccccctgatcagagctaggactgggaacccccatcccctgtccttgctgccccctggctttacttagcctgcagtcccaaggctaaactgcattttgccatccctagatctggagacaatgccctcaggcatctccaagtagaatacaagaggtactcaggttccagttggcccagagccctcaacaggctgatgacagaggggtggaggtggagcttggcctgcaaatccaaggccaggtcccagggatgccctttgagaaccattcaggcctaccttctctgttgttaccacagtgccccacccctctagtcactgcaacccatgattcccaagtatgtgcttgtgctctcggcagaggttctgggtacagtggaccgtgacgctggggctgccctcttccaagcctcagagggccacagcgtgaaagggggatggtgctagaagaccagttggtgcaaagcccctcccccatttattaatatacattgtgacaccaccctgcaacagtcataggaggtggggttagaaggggacccctagaggtaggatggtgctgatctggggtggtgggtgttgcccaatgaaggaaggggatgggagaaaaaaagggtgaaggaaacaggattaaaaagaggcctcctgggcctgggcacagtgagttgcacctgtaagtaatcccagcaatttaggaggctgaggcaggcggatcacttgagctcaggagttcaagaccagcctggataacatagccaggccctgtctctacaaaaataaataaataaataaaattaggctgggcgcagtgattcgcgcctgtaatcccagcattctgggaggccgaggcagatggatcactggagctcaggagtttgaaaccagcctgggcaacaaggtgaaaccccgtctctacaaaaaaaaaagtacaaaaattagccagctgtagtggcacacacctgtaatcccagctactcaggaagctgtagtgggaggattgcttgagcccgggaggtggaggttgcagcgagccgagatcacgcccctgcacccaagtctgggggacaagagtgaaaccctttcttgaaaaaaagaggctgccctagtctcaggatgggtgtgtcttttagcagagacgcctccacattcccttccctcttcccaccccagagcactgctcccaaaatcccacaaggaaccctcaaagctcaactggcaggagtgcaaaatgatacagccactctggaaaactggctgcttcctataaagttaacatatgcttaacctatggcccagcaattctactcttagatatttagctccaaatacatgaaaacatgtcaacaaaagacttgcatacatatatttgtagcagctgtattcctaatagccaaaaactgggaacaacccaaatgtccaactagaggagaatggatacagtgtggtatattcaaaggatggactacagctcagcaatcaaaaggaacacaatgctgatacagatatcaaaggatgagtctcacatggtgagattgttcacatggtgaaagaagccagacacaaaaaacacataatgtttcattccatttatatgaagttctaaggcaggcagaacaattttatggtgatagtagaagagggttgaggtgaggagggtgtcactggaaagggttgcaaggtagctttctggaatcatgaaaagtttctatgtcttgattggggtgctggtcacatgggtgtatacctatttaaaagtccaacaagctgtataactaaaatctgagtgttttattgtatgtaaattatacaagaagttggaaaatcaccaccacagcaaacctcaataaataagaaggaaataatgaacagaaattgatgatatagagaacaaaaaatgacagattaatagaaaccaaaagcagaatctgaaaacaaaaattaagaggaaacacttttggcaagactggtcaattgaagaagatagaagatgcaaatgcaacagagcttttaaaaataaagaatgtatctgaaaatctagatgaaatgaatatattcctagagaaatatcaaatgccaaaactgttccatggagaaactgattactcaaatggagcaattagtaatatagaaattgaaatggttgtcaagatcttccctttccccacaaaaaaaaaaaaagggcccagatgatgtgtgtatgtgtgtgttcctttctttctttctttttttttttttagatggagtcttactctgtcacccaggctggagtgcagtggtgcgatctcagtttaccgcaacctccaccttctgggttcaagcaattctcttgcctcagcctcctgagtagctgggattacaggtgtgcaccaccacacccagggaatattttgtattcttagtagagatggggtttcgctatgttggccagctggtcttgaactcctgacctcaggtgatccaccctccttggcctcccaaagtgctgtgattacaggcatgagccacctcgcctggcccagatggtttttataagagcattctaccaaactcccaaggattcctttcttattaaagttaattcctttcttattaaagttgttctagatattagaaaaaagaaaagatgtctattttaacaggctagtgttagctgaagctgcgaaggaagaggcactctcatacatcgctggaggcaatgcaaaatagtacaaccctctcttccaccctccctctccctctcctttgtctattttcctgcctccacagggctcactgtgggaccacagatgcaccccactatgcccagctaattctttgattttttgtggagaccaggtggtggtggtggggtgtgtgtgtgtgtatgttggggcgtgggggggtctcactttgttgcccaggctggtcttgaactcctgggctcaagcaatcatcctgcctcagcctgccaaagtgatgggattataggcgtgagccgccgcgcccggccaagactccatttattaaaaggctaaagaattttgccaggcgcggcggctcgcgcctatagtcccagcactttgggaggccgagcgggcggtatcgcctgagctcaggagctctagtccagtctggctaacgtggcgaaatcccgtctccactatggtaacatgtaaacatagaaaagataacagtaaaattttttctgtgttataggaccgttgaccaaaatgttatgcagcacatgattgtatatccataatttatattactgtatatagtcacagatatctattataatacgggtttgtatgtgaaactataattttacttattgttatgtttatggtctgtgtatcttgctagaatgtcagctccatgagcccaaggaagaatttccagcacctggcccatgtcaaatgaacttttttggccacctgagtctcggtctccccatctgtaggatgggtgtgcctttccatgtggaggcacccacacgttccgtttcctcttcccaccctacagagcacggctccggcaattccacagctcaggcttacattttcccatattctggacgctggtgcccaccacgtgcaccaggcactggccagacagaactaccacccccagcatgccgcgcgcatttgggccgtaccacaacctgtagggtcatctgggtctgaaacgggcaccagcgacgcgggagcagggactgacgcccctctagcaaagcatctgtggtacatcccagacccggggctctccaaggccccgcgcttccgagctccgcgcaaactctggcttctcttgtacgacagaggtggtttgctcttccgttgccccgtggcttcagctcatctttggcaggaaggcgaggcttccgcccggcacagggggtgagctggagcaccgtgcccccaagcctctggacagcatttggaggagggtgcttccctaatcccaacttcggggaaacccctcatgggcgtatttggagcctccgggcccggggtgatatttagggggcgtctgcttttgagacccttaaggggtgccgtttggggacttcggggtgggatttgggagtctgtttcggggagcacccctcggaggcagggtttggggggctttggggagattcttagggtccgtgtatgggcacccttgtccgtggagcaggatttgggttattcttcaaggggagaagcaaagcttgaggttactaaagtcaaggcgggactgggggagggcttgtttcaggacggggtcctggtgacagaacaatcgggaccgacgtggcattgtggaggtgtcaggcctttgtgacctctggttttgtgatgaggtcctccccgcgcctggaggctcaggactgcgagactggacacgtcgggggcccagatgtttctagggagaggagcctcccagctcaggctagggaagggacaccggagcccagctcttcctgagctgacgaggcgccacccggcctttattcattattcataataaggtggggctgtggtaggcggcagtttttttgcctctttcgcacctggtccgctgaaggttctcggcttgtgaattattcacgaggggcggatcagcgtgccgaagggacgtgctgaaggggcgttctgaagtctgccgcgcaaacgagttcattgatgattcgcaaaagttaagtagcaccctgagttttcagtggcttttctaggggttccgtgcttaattcatgaggagcgtggcttttgcagctttgtctgcgtgatccgcggttagctttcccttgcaggtaccagagttaaaacctggcgtctagcaaagggatgaggcctcctacattgttcatttcttatggcctggtaatcccagataatcagccggctctggattcaaatcccatcgatcctttccagttgtgtgatctttggcaaatcgttttgtaagcctgaataatgggtatgaggataacgataagattagcttacactcgtttagctacttagcgcatttaatcttcacgacaatcctaggaggtaggtcattattacccccactttatagataaggaaactgggacacaggaaggctaagtaatttgcctaaggtcacacaatcagtgagtggctgggccgggattcaaattggggtctagttccgcaatctgtagtcttaaccagatgccataatgtctcccctccccattcccctgcgccgccatttgatagtactactactactaatataacacttagcatgtgccaggcactggtctaagccctttctacttatttcttcatttaaactccatcgcaaggtaagttgctgttattcctattttatggatggggaagcagtggcccaagttgggggtttctctagtggctgagtattcataactaattttatattaatgtaaatatatatttacatatcttaacatattacttttatattaatatataatattttaaaaatttaacagtgccttgtgccagcaatgttctaaggctcatcccataatttatattctctgattttcttttgtttgagacggagtttctctcttgtcgcccaagctggagtgcaatggcgcgatctcggctgactgcaacctctgcttcccgagttcaagcgattctcctgcctcagcctccccagtagctgggattacaggcgcccgccaacatgcccagctaatttttgtatttttagtagagacagggtttcaccatcttggccaggctggtctccaattcctgacctcaggtgatccacccgcctcggcctcctaaagtgctgggattacaggcgtcatctgattttcataataacacattactatcctcattttacagttgtggaaactgaggcacctgccaaagacatgtagtgagtttgggtttgattggaccaaggcagcccttgttcctgaggcggggagaatggagggaggcgtggagaggggaggtgggggcagggagtacacgtcccctgggttttctggtggcactgcagtgacatctttcattattcatgaacaggaaggcgtgctcactttgccttggctatagcatcgtaatccctatttgctgggcagggcagtcttgggtgtttcttcgccttatgcataattcataaattgggtggaacctttcttgacctctctgagtttccaggttgagctactgcagcagcataattcattattcaggacctgggagagtgtgttttccctgcagcagccccatttccctgcttacagtgtattagatgcagcaataggcgggcgtgccccttttattccaacccactgggcctcatgcattattcatgagtaagttgtggcctgggtctccttggcttccgggcccctgcaagatcatcattattcatgaatgggggtgtgtggcttccatgttttaacatctgctttctggttgctggttgttagtctaccaaccactcaacttcatgcataacttataatcaggaagcatggccttaacggtttttcttcgcttccttgacagcctggctgcaacaattcattcattagtcgcattccatgaggcgtggcctctgttttacctgttttcgttgttactgccacaatgtccaccaggtggtgctgttccacttctaaccgaatgaatcgcaaccgagtagggaactttatgcatgattcataagtaggcgcggcccgcttgcatccgggtttctgggggtggggcccaaggttttgttccggccccaggctcagcgtccgccatcttgtgtcggcggctcggctgtaaggaggtggcagggacaaccacaaccacaacggccgggggaggagaaggcggcagcggcgattctaggcggcccaggcggcggggaggaggagaaggaggagggtggcggccgggcttggcttcggctccttgaggagttggcggcggcgcgacccggggaaccggcattggtaaaaaaacgtcctttcactgcgcctcgccctgggcaggggtttcggggaggcactggagggccctgagccacgctgctgtcggggcgggccgcggtgactcgggagccaggaatcagcggagtagggagggggagcggatcctggggcggggccgactttccccggccaggaccactccggctccctctggttgcaaaatctgaccttggagtcggacccccaggatgtgcttttagagactcacgcccaacatctctagtctgggacctgactccgtcccgaaccttgtatctcagatcagaactcttccccagtctccaatagagatttacgtggatcagcattgctgatcagagctcctcaccattgaatgccgttaaagacctgccccagaatctcctttgagacacttcctagcttctcagtatttgtcctcaaggcttccaggacgggctagatctcgaaggggtccataggccctttatctctgtaagagagtcctctttagcattttccttcagacccccatcccacacacatgctagccgcgctcagagcttccaggggtactagaccctgtgaaaggccatttgggcctggcctttgtgtcgggggcccctcttcgccacacgtcaggtctcctaaccccaccctggccctagcatcttccatcagagactctgcccagtatttctactcagagacccctcttaccatctgccttgagagactcttcaattcctagactctgtcctttgacactttctctacttttatggaatttctcgctttttatacttccagtattcagagactactgagaggcctcagcatcttccccatcaggcaccttgaacccccagagccttccagtgcaccagataccagggaggaactgtttggatacataatcctccatcaaagagcccctgcgagcatctgctcttgcagatcccgttggcttctagccccttccatcagagactcgcctccccaaccccaccctagacccagcctctgccttcaaaaaccaacctgggttctagctgcttttttcacagatcccttatcctcacatcaggcctcagaatctgccctcagatcgtttcaaggtccctaacgtctgcagtcaggggttttcagcttctgctttcagcctccttggaccccaggatcattgtcagatgtcccttccccccacaggccttcttgttttctttttctttttcttttttccgagacagaattgtttcactatgtcgtccaggctggagtgcagtggcgccatctcagctcactgcaacctccacctcctgggttcaagcgattctcctgcctcagcctcccgagtagctgggattacaggcatgcaccaccacgcctggctaattttttgtatttttagtagagatggggtttcaccatattgcccaggctggtctcgaactcctgacctcaggtgatccacctgcctcggcctcccaaagtgctgggattgcaggcgtgagccaccgcgcctggccatggccctcttgttttctactgcagtagaaaaccctcttctcagcatctaccttcagcgcctccatggggtcctacataattggtcagagaaacccaaccccatttggggacctagccagtgtttgcttattaacctttttaaggcctgcactatctgggcccagcttcccgtttccacaccctcagagcagctgtgatacctagcatgtcctgtcagagattgacacagggcctttgtgttccattagaaacctctcccagcccctcaccatccaccctcacagcctcctgggactctgtagtaggaatgtcagatacacctctcctcttgcatgtccctatctattatttttggttaaagatttctctctgctaccagcatctgtctccagagtcctccagagcctcaacatcctcctgatggaggctgcctctccccccagaccccaacatcttcctgctgcctcctcagactctagaatcccccacccattccctttgcagcttccatggggcccagcaactgtcctcctacctccttgcagccttgggggcctccactgcaatttttcagcctttctccaaaagatccttttccagagatccgaatttgagtcttttcctaataccctagcctagtcctttccctcccaggacttctaacatctcctttcccatttgtctcagagcctccttgctcttagacacccacttcctgattctcctctcacgttcccatggacttctcagttaacccctcccagaaagcttgacatgctccagccccccttctctatgccctagcttctccatcctgctaacctgcctcctctcacacctccaagactcctccctcaaaccctctggtttgggaatagagaatgcttacgcttgaaaatcttcagtttggagactcaggtatgtttagaaactaagccacagctcagctttgccaaacagttcacagtgtgtatgttatggtgggggcctgagcaaatgttgaggtaggaagggtgtagattgtttttctgctgggggtgggggatctttagctcctctgcagagtttctgtcccagactcctgcttgccttgagacagggctgttccaaacctttgcagtcaaaatccacttgaacaatcatctgaaacttcttagactcttgctgcctgcactggggatccagaggtgaaatgtccagatattaaagtgctctctggccctggatcatctctaatttatggagtgaggaaatggcatgtcccaaacaaactgaccaatgacaaggcaaggagataactaagtaatagaggccactacacgtgcccagggaggaactcacatcctcaggtcagtgagttctgaccacagaccttggcttctttaaccctgccagcagccccttgaagacagtttcatttgtcccagcttttggagaaaatgaggctcagaggaaatgagatctctaccccaggtcagtcagagagtcagtaaatggaaaatatggttcacctttgtctctactaactcaccaagcctcttgctacccaggttggctcttagcattctaagcaattcacctggctatctcaggggctccagccagcctgctgcctcccctcatctcccattccttagccctgtggactgggccctgagcccaggggcatttggcaaacagtcccccaccagctgcatgcctctgggcgagtgaatggggttctctaagcctttcttttcccatttgtgatttgggcatagggttatctgggtcatggggattgttaagattagacaaagccctttcctctttgattgacacacagtatgctcttggtagatagtagggagctcttgtcattgtggttggtgctagtgacaagtgccaagatggaatcttaggtacattgggatacttagtgtcataaaagtctcagtgtgggaggacttgtgtgaacagaagactcagtgcctagaggagcacttggggtgaggggaagtgacgctgggtcctcccatctccagcatgtggacccagtcacccccaccaccagatttcacttccacagcaggctttattgttctgtctctgggacctagcaggtgaccctgggcaagttacttctcatttgtccggcaaggacactaaactctgccttgctgggtcagggtcatggaggggatgaaacgtgataacacgaggaagcagcctgggcttcagagtcagcagatcctggtctggtcccagctcagtgtgtgggaaccttggtcaccgaacgtccctgagtgaatttttttccatcactttaaagttgggggtattattgatagcagtccaaaccccacaggagtaccctgaggacagagtgagacgaggtttagagaagtgcttactatggcatctggcacaaggaggactcctgatcaatctaatactcatttatcattgtggttaacctgtttaagggactccgcatgcagatgaggcttgggatgtgtttgttttctatctttttgcaacctcttttattggtctgtgtcggttttcccctcccaaagctgggggcagggttgggctttataaaacttgagcccctctggggactgggttctcagcaagttaccgctcctgccatcatgccaccctgatggatgtccaagcctcacttccctcctgcactccccgctcccgccgccytccctgggattaagggagaggagaatggctgcttgttactgcctacctactctgtgccaggttctatgctctgtgttatttatcatctcgataaccccgtggggaaggtaagtggtattatcacccctgtttcacaggtgagaaaactgaggcctgtggsggttaattattactgttagtgcgtggcaggctcaagatttgaaaccaggtctgtcctgaatccacatccttcccctgacctcgacacaagtacattcttgtcattcctttcactccaggattggagtctctccctcrttatgctgggctgggaagaagcaaatggcttagtggtcagcagtgtggatttgcaaatcagaccacctgggttcagatcttaggtctgacagctgtgttaccctgggcaagtcctcacctttctgtgcctgtcccctctttgctgtaaaatgggggtactaatacttaagtcttcccttcccccacagttgctactaacaaacagaaaaacggtacccatgtgctccagggtcacctctgacctttttttcctccagatgtccagctcgccgctgtccaagaaacgtcgcgtgtccgggcctgatccaaagccgggttctaactgctcccctgcccagtccgtgttgtccgaagtgccctcggtgccaaccaacgtgagtgtcctctccgtggagactggcagacgaggtggtgggtgggaaagtcttttgtrtcactgtctgtctatccatgctccactcctgtgtgtctccctaaacttgttcttttcctctattcctagggaatggccaagaacggcagtgaagcagacatagacgagggcctttactcccggcagctgtaagtggggccaaggccgggctgaggggtgtggaatgggacattgagaggataaggttgggtggggcaggccctgacctagagtaccccctaacctggcaggtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccaggtacctcttcctagcacccttccccctttcccccttcccgaggcaccactgttcccggtgccacagccatttcatctttttccctactgcacacccttamagttctacctgcgggaggaggacatcggtaaaaaccgggccgaggtatcacagccccgcctcgctgagctcaacagctatgtgcctgtcactgcctacactggacccctcgttgaggacttccttagtggtttccaggtatcttgggggtactacscagccttctgcccagttttctcagagcccatctctggtttattcagtagtgttcaatattgatttaatgggtcggcctgaatgtcaggttttgtgctgggggactagagtatgcaggcagcagttagcccctggccctgccttttcttttcttctttttttttttttgagacggagtcttgctctgtcgcccaagctagagtgcagtggcgcgatctcggctcactgcaagctacacctcctgggttcacgccattctcctgcctcagcctcccgagtagctgggactacaggcgcctgccaccacgcccggctaatttttttttgtatttttagtagagacggggtttcactgtgttagccagggtggtctcgatctcctgaccttgtgatccgcccgcctccgcctcccaaagtgctgggattacaggtgtgagccaccgcacccggcctggccccgccttttcaagtggggaagatgtgtacagacagtacagcatagtggttgtgggcacagactgtagagccatactgccttgctgcaggcctccagccttggtagtgtgacttcaagcaggttgtttcatctcctgtacctttgttttcctgtttgtagtcagtgcgtggtagcagcactgacttcatggactttttgtgagggttaaacacgtggaattgcagctggcatataaggactggatgggtgtttgttaattaaaaagtccaggccggaaagaggtgctctggaagctgagagttgtccctggagtatcccaggttgccagggcactgcagctaaatcctgatggaggagtaggagctcaccctggtggggaaggatggacattcaggcagagagcaaaatcccaaagatcatggcggagcaggcgtcgtcttgagaattggaagcaggtgggtgtggtaggagtgagctcagactttggctggagacagagttttactccagtgtctcacagggcatggcagacagacagcagcgggtgtttgtcaaataaatgagtcagctcttctccaaactccctcctcccagctacctcttcacctttcctggtatagtccaggggttcattttcgacccccacagagtctgatacacagtaggtgctatgtgtttgtgaaagaggctgacccagcaaagcctggatgtgtttgccttgaggactgcctgagtcctccacaccagccctccattttttccccttcaccccaatgctgggcctgagcctccatctctccacaggtggtggtgctcaccaacacccccctggaggaccagctgcgagtgggtgagttctgtcacaaccgtggcatcaagctggtggtggcagacacgcggggcctgtttgggtgagtggcagcccacctccctccctgtccccttttcccccaactcctaccaagcccaggccaagactctaggctctccctgccctcatcccttctcagctacccaggttttgggttctgtgttttcatctctccccatgtggcacaagtaccatcttacatcccagcagtgataggctgagtttgctcagcaagttttcactacatcttgagggacccgtgggacctgtatgtgcatgggacacaggcaccagccctattgcttccctctacaggcagctcttctgtgactttggagaggaaatgatcctcacagattccaatggggagcagccactcagtgctatggtttctatggttaccaaggtaaggagaccagccctagggttcctggcaggcaggtgggctgcagtagtccttcctgtctgctcttggtaccctgggsctgtttctgagactcactcttcctttaaccaggacaaccccggtgtggttacctgcctggatgaggcccgacacgggtttgagagcggggactttgtctccttttcagaagtacagggcatggttgaactcaacggaaatcagcccatggagatcaaagtcctgggtgagctgsgaccatgggggaagcagaggggaactagaagatatgttcctgggttctggccggggagttgaagggagaagacatggcccttggttcagagttgggaagacacatcctggtgtttgagatgaactacagacaatcctgtggggtccaataagagctggtgggcatgggggagaggtactrtgtttgagctattcctgggagantgtgtccctrgtatctgagctgagtggggaaaaagtctctggtgtttgaacagggcagatcagcggatctacttgtgtgtgagctgatttggatgggaagcagagaaggtcttcccgtgtagacttggagccagggacacagggtctcacggggtctgagctgagtctggggcacaggagagatggtttctgatgtccaagtggagcctggagctgagggaagacagcttctgatgtctgagctgagtcggggcaggaggttccttatcttgcaggggttgtggattttagggagaatgggtagactgacagctctcttcctgccctctgtaggtccttatacctttagcatctgtgacacctccaacttctccgactacatccgtggaggcatcgtcagtcaggtcaaagtacctaagaagattagctttgtgagtgtgtcgatgggatcagtgggctgtggggggtggttctaggcattccctagttctccattcctctcttctggttctgatgacctctccccccgccacagaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggtgggtgagtgggcgagccagccagcgcagacatgcctggcactgcaggctcaccatgcctctctgcgtgtccacactccctgccctcactgtggcctgacatatcctctcttggttctttctggcccaccaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggtcagcacgggtggggagaggcaggattggggtgggccaggtncctccatgactctgtcacttgctctctgtctgtgtcaggcccctgttaaccactgaccaccccctctctcccttcccctctccaggcctgctccgggaagttcatgcccatcatgcagtggctatactttgatgcccttgagtgtctccctgaggacaaagaggtcctcacagaggacaagtgcctccaggtatgtgggtggsacctgtggggagggcatcattggggacatttctggggaggcctctctaaccctcctccctttgcattccttagcrccagaaccgttatgacgggcaagtggctgtgtttggctcagacctgcaagagaagctgggcaagcagaagtatttcctggtaagtggtccccttggatgtctgctcccctcatcttggcctctggccatcacccctggggcttccttcggcatctcaatgcaaccggtggcgcattctctttgccattctccttatcttgaagggaagcccagtgcatccctcgtttccccttctggtgcctccttcctcacatgactgygtgtcatttcttagagtcctgcaacctgaagatgtggtgttagcccctctccccgtctctcaggggagtgaggggtgatgggtagcttcacactaacctgcatcaccctgaccagcctctgcctgtcttcttggttgcttcttaggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacggtgagtagggtaggaggttggggctttgtcgtctcactttcctcctttttcttttttttttttttttttgagacggagtttcgctcttgttgcccaggctgtagtgcagtggcgtgatctctggcccaccacaacctctgcctcctgggttcaagcgattctcctgcctcagcctcctgagtagctgggactacaggcatgcgccaccacgcccggctgattttgcattttaagtagagacagggtttctccatgttggtcaggctggtctcgaattcccgacctcaggtgatctgcctgcttcagcctcccaaagtgttggtattacaggcgtgagccaccacacctcacccctcctttttcttgttcccattctttctgtcagagatctttctgcctctgccagaagcccttctttttggcctttctttccctcagcttctgtttttttttttttttttttttttttttgccttaacctctttttagtgctggttgggacagtgtgtctggggtcctcaaaactactctcaagctcaattcacctagagtacttacaggactcagcatatagtcgtgcttgtggctacaatttattacagcaaaaggatacagaccaaaatcagcaaagggaaaaggctggtgcaagtttctaggagtcttctcccagcgggagttaaacaaggcggcctttatttccccagtagcaacagtaactacagaaataacagcaacaaggtgtaacaagacatgaaatgttgccaaccagggaagcttgttagactcagcaccacctcttttacttggggctggtcatgtaggcgcccccttcctggcacataacaaaatttccagactcccagaaggaaaggtgttcagcgtaaactgtattgtttgcatgaacggtttaggcacagtgaaccactgataccaggtagggagcggtgggaaccttcctgaattccaagttcccagacaccagccaaggagccgaccttggaagcaggcctttccaagggttgtagtttcagtctcctaggcttacacttctctgcacatatggaaactgggttggttatgcagggttctctgagaagctttctgtaaggagcagtgtcgtttttgcttacccaggatttattccccctttcatttatttcatttattcaccagatagttttagtactgttttaggtattggggatataccaaggaataaaacaagattcctggagggagaggggaacggacagcaaacaatagacacaatacgatcgtgaggtatatagttaatgttggtgatgagtgctcctcaaaggaaacaactaaaaccagacaagggaagtcggggtgtcagggagaatggtttgtagtattgatgacaatggttaaggaaggcctgagttctgcaaagacctcaaggatatgagggactagagtgccctctgctgtggaagagcctgcgcaaagatcctgaggtgggaggggtcagggagccaactcattttacggtaagtggaggtgggatccaggggaggattctgagcagaggagggacgtggcccaatttgggctttgaaaggatcctgcttgtctgtgtgccagcatcctggtggtggttgggggagtctgcatcaatcctgggtgctgttacctgaaaaaatagcaggtgttagacgaaagaacagatgtctggcccattgtctccagtctgttcctgtccacagcttccctttatgctgagcccctgccacatgcatcatcatcctggccatgtggcattgtcacagaccgtctctcctgctagcctcctaactcagggcctgggtcttccccagcattaagtaaatcagtctcaggcagacagccctttataggtgtttgggccaggtgcggtggctcacgcctgtaatcccagctctttgtggggccgaggtctttgagctcaggagttcaagaccagcctgggcagcatgacaaaaccctgtctctaccaaaaatacaaaaattagccacgcatggtggcacacacctgtggtcccagctactcgggaggctgaggtgggaggatcgctggagcctgggaagttraggctgcagtgagccgtgatcatgccactgcattccagcctgtgtgatggagagagaccctgtctcaaaaaaaataaagatgtttgttgggtgaatgcacaaataagtgagctttgttcccccatccccaccctggaactgcactttcttaaccctttagaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgtgagtttggaggcgggtgaggtggtcacgggcaaagttgtgtgtgtttcggtgtgtatataccaagaggggtgtcygtctttctgtcctctcctgatgtttctttcctagctctcrctttgtsctccccacaggcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcaggtgataagctgtgggagaagggaaagaggccaggcatctggccaggctgctgcctctccrcccccaggcccttgccttgccttcagatgttgcatgcctaagtgtaagatgtgccttttctccaaacctccctccctcacttcccaccaggcagcctaggtttctagaatgactcattcttttttcacttttattttgatttttttttcaacacatagacaaatattaagaatattatgatgaatactcaaataccattcctcacctaaatttaacaattcttaatgttttgccacattttcttcttagatttatgtagatttttcttctttgtgcttaaatgtgtcacagacatcacagccctttactccctactatttcagtgcctctgccaagtgaggatatgttgctgtagaacagggtttcttagcttcagcactactgacatttggggctggttatttatttgtcatgggagaggggatgycctgtgcactgtaggatgtttctcagcattcctgacttctgcccactagatgccaatagcactctccctccatcatgacatctcaaaatgtctccagacattgccagatgtccccaggggtgccacatcactcccagttgagaactacttctgtctaacagaaacatcattttcatgctcagcaaaattaacaatcattcttaccatctcttctagttatttatttgtctctaatggtccatattcaggttttccccagctgttactcaaaatgagtttaacagctggtttgtcaggatgattctgtgtgtatggtgcatttatctacagaacagtgcatatattatctagctcggggtgtccaatcatttggcttccctgggccacattggaagaagaattgtctcgggccacacataaaatatactaatactaacgatagctgatgagctgaaaaaataaaagaaaaaaagatccgtgcataaatctcataatgtcttaagaaaatttacaaatttgtgttgggcagcattcaaagtcatcctgggctgcatatgggccacaggttagacaagcttgatctagctgaagttttacaaagtgaacacacaggtgaccaccacctgggccaagaaacagaacctagggattaccattgtgctgtcagaataattcttagtgcagtgtttgaggccaaaccatttagaatagtaggagtatgagggtgggaacaaaatagggaagggaaaaaaaaaacagttccatctgtcactttctcccttctgacactgcagttccagagtgggtatgtttgtatttgtgcaccaaccacagtcttgctaggtcatgtgtaaccttgaacttaacctctctgtgccgcagattcctgttctgtaaaatgggaatgacagcatctacctcacaggactattgtgaaccacttggcatttactgtgtgcctggcactgttttaaccaagctttaaatatatatgtatttgctcatttcttcctagcaaccccatgaaggtaggtatcactgttgtaacacctgttttagagacaaggcacagaggtaaagrtgttatcctgtgtgcctgaagtcacaaaactaggtaatacgtggcatagctggaatctgaacctgaatttctaacatctgtacactccaaaccacctcgctaatgactgcgaactgtcctaggaattctcagaggccagaagytctgtcttgtttgctattttattttttgagacaggtctcattctgccattcaggctgaagtgtattggcacaatcatagctcactgcaaccttccaactcctgggaagtgtctgtacgtgtgtgtgtgtgtgtgtgtgtaagtgtctgtgtgtacgtgtaagtgtgtgtacgtgtgtgtgtgtgtgtgtgcgcacgcacgcgtgcccgttacgttgaccaggctggttgtaaactcctgggctcaagtgatccacctgcctcagcctccaaaagtgctgggattacatgtgtaagcctctgtgtccggcctctgtcttgttttctgccaagtcctcagggcctggatagggatcattgttggtttggtctgagttttttgtgttttaaaaaactgtggtaagatatacctaattgaagtttttattttttatggaggcataacatatctagaataaggtacacagatttttttttttttttttttgaggtggagttttgctcatgttgcccaggttggagtgcagtggcgcagtctcggctcactgcagcctccgcctcccaggttcaagcgattctcctgcctcagccttccaaagtgctgggaatacaggcgtgagccacctcgcctggcactcagatcttaatacatttttaggctgggcatggcggctgacacctataatctcagcactcaggaggccaaggagtgaggtttgtttgagcccaggagttcaagaccagcctaggcaacatagcaagaccctgtctctacaacaaatcttaaaaattagccgggtgtggtggcatgtgcctgctgtcccagctattcgggaggctgaggtgggaggatcgtttcaacctgggaggtcaaggctgctgtgagccgtgattgcatcgctgcactccagctcgggtgacagtgtgagactttgtctcaaacaacaaaacaaaacagttttccacatacacagcactattgtaaccactgcccaaatcaacttcattgatttttctttttttgagacagtcttcctctgtcacccaggctggagtgcaatggcatgatctcggctcactgcaacctccgcctcccgggttcaagagatttcctgcctcagcctcctgagtagctgggattacaggcatctgccaccacgcccagctactttttgtatttttagtagagatggggtttcaccatgttggtcaggctggtctcgaacccttgacctcaggtgatccatctgccttagcctcccaaagtgctgggattacaggtgtgagctactgtgcctggcctggtttttcaattgaggtgggggaatggggaaggctagagggcttccccacttccagagtagctgtgcgccttgtacttgctttattcactgatggtccttctaataatgcctgcggaaacccattttgtcaactgtggccacatgtaatctgtttgctctgtctgcagtgggctcgggatgagtttgaaggcctcttcaagcagccagcagaaaatgtcaaccagtacctcacgtgagtaactcgagtgccctctcgccctgtccctgtccaccagccaaggcatcccggctgctttcctcatgacagtaacacttggcaccaggcacacttttcacatgaatgagtggctgttggggcctcatgttgtttggggtcgggactagttttccatggagaaagtaagattgctctggagcccactcttgaggctgacatgtaatcctatcctctgtcctcttcgattcctgatagagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccaggtaatgcccagttgttgggtccatttggcagaatgtgtttccctgaaatgggagcctgcagtgtgggtcctcccactgtggagtccagctgtggcaggtgccctgaggcatggggatctgagaagagtgattgatcctgacctgctttttcctcaccctagttcctttgagcaaagaggcttggttgctattgcccttgactgtggtgtgggctgcgtcatacctgattcccagtcagggctgtagggattatgggggagaaattctggagttaagagcacaggaatcaatatgggttcaaatccaaactctacttgaacttaggcaaatcacgtaacttctctctgtacctcagtttcctcgtctgtgaagtagaaataatagtgatctatctcatggggggtttggggaggattaactggtatttattaaaatgaagttagtacaatgcctggtaatccatgagagtttgttaaatgatgggctgtttagcacaaaatggctacccagtgattggtaattgttctctcagccagatctctggttcaacctgtgggaccctacagttgaggtattttgtgattggctccagtccgcatcgagtgcccaacccaagatagtgaattgggggcacatctggggcctaggtgaagcgtgaagattgtcagagaggccttcactctcaggtcctgttctcaaaaatctctccatcccttagctcacaagctcaggagcgccgttctggtctgggcccaaacgctgtccacacccgctcacctttgatgtcaacaatgtaagtctcctttctagggtcttctggggtcaggtggagggtgaataggtgggaaggaggtggcggctccccactcgagggctgatgtgctcacccttccctgccctgccttctcctagcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttggtgagggtgtttggccagttggccaggagtcaccccacatgtccccggcctagtccagcctccccaccagtcctctacccctggttctgctctgctctgtgaccccaggcctgaggtttacccacaccttcctttgagcctccctttgacatgaagagggtaggttggggcaaattatctccctccctcctcctccttcccactatctggccctcaggagaacttgctgttttactcttgctctgtgtatttcccttagttttgttctttcttctgtttcttcttgatctgttcatctaggaggtatgatctctaccagcagtctctctcccttgatactttcctgccttgtctccttccagatccgcccccatctgtacatctacctgcatgtttctctgtgcatcttcaccctccatagtttggggctgcggtttactgacacccccaccccaccccatctgcatattttttcaccacccctcccttctgtatatgatgcttctgtagctctgtaacgccccctacatttaccttccttatatctcccccgtcttcctctccatagatctcctcccatttccccttccatggtccccatcttccttctgaaatgtctactccttcatgttcctttatgtatgtcttccaatctttccttccatagctctcatcaccttcatatatttcttccatctttctcctcccacctgcctcgccctctgtatatacccccactctcccccttttatatcttctccatctccccccatatctttcctctatgtccacatctgtgtattccccccaacttcccctccatatatcttttttactccccttttcctccctgtatcctctgtgttccccccatcttgctctacatcattcttcccaagatctttacgtctcccatcttgatctctccatctccactttctcctaacattttcatttccgttccttagtgtctctagagagatcattcttgatagcctcagctctttctctgtgtttttcaggtttgtattctgctctgctctacctctcctccttgccccttttctctcccaggatgtctctcctttccaaatcctttttgtacctgaataccttttgccccaccctgggctctcatttccatctcagaccttagcctgggatctaaagggctgacagtgtccctttcttcatgcagatgacagtcgtctagaggagctcaaagccactctgcccagcccagacaagctccctggattcaagatgtaccccattgactttgagaaggtatggggtggggctcaggacagggaaggaggatgggcaaagcatagacaggctggagaaaacaggagtatctggagccagccccgggcctttgtggggatcagattgtgggcctgccatatggctctgaatgagtaggtgttcccagccatccctttgtgatctgggagagtccagcaggcaattgcagtggaggatacacatcttctttatctgatcctctccccactgccttcacaccctccccactcataacaggatgatgacagcaactttcatatggatttcatcgtggctgcatccaacctccgggcagaaaactatgacattccttctgcagaccggcacaaggtgaggggaatctaaatctgatgttccaccctcctccaggtttgagttacccacacttagcccctctgtagaccctgaggctcttgtacttaactaccaccttcttttgtcccttctgtctctcagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccaggtgggggcctgcatccgaagcagggtttgggtggggtgtatctgtgtagatctggttctgattcacgtcataccctgtcaccaggtgagggtttctgtctgtgtacctaccctttttgtgtatcctttttcacttattcattaatcacattatttgagtacgtgcgaaaagatgggatatttgaattgtgccctgggagattattagtaactacacaataatggcagccaaaatttattggacgcttcctacacttaagtgctttgcttgcttcattaatgaattcactcaaatatttattgagcaccttttgtgtgcagggactcttctaagttatgttcctcaagtagattatataaataacctattaaatgattttggaatcaaaaaaggataaaaagaggccgggcgcggtggcttacgcctgtaatcccagcactttgggaggccgaggcacgtggttcacctgaagtcaggagtttgagaccagcctggccaacatgatgaaaccctgtctctactaaaaatacaaaaaattagccaggcgtagtggtaggcacctgtaatcccagctactcgggaggctgaggcaagagaatcacttgaacccgggaggcggaggttgcagtgagccaagatggcgccattgcactcccgcctgggtgacagagcgagactgcatctcaaaaaaaaaaaaagataaagaggacttgagaataccagggggcgaggggatgtatttgagattttgtgtaggatggtcagaaaaggccttgctgaaaagatgacatttgagatcagacttggaggatgtaaggggacaaactgtgcaggcttggtggcgagtggggacacattccaggcagagggaccagttcttgaaagggtaccaagataggggtgtgcctggcaagttggaggaattcaaagtccccagagtgagtgtgagattgaggagggtaggagatgagaagaaaacagaatttcattgcttagggtgagataggaaccacaagaggatttcgaacaaaagagggttgtgrtctgactaaacacgtctgcatgggggtaggggggatggagacagatgggggctggaccctctgggatggtctccatcttacactcccctctttgtcttgcagtactataaccaagagtggacattgtgggatcgctttgaggtacaagggctgcagcctaatggtgaggagatgaccctcaaacagttcctcgactattttaaggtaaggcccctcccttactctgtcaccccacctcagggggcgaggtgtacacggtgacttgctggcctgtccacctccatgaccctgctgttccccctccctctccagacagagcacaaattagagatcaccatgctgtcccagggcgtgtccatgctctattccttcttcatgccagctgccaagctcaaggaacggttggatcagccgtgagttggacactggccaggctaggggaggccctgtatgggttggggagcctcatcatccagctgtcccactccagttcactgcccctacctacctgcccatcctctcttgctttctgccctcctgaccctatactcccatccccctatccccaggatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccaccmctctccacaccccttccagcccagggttcccatttggcttctggcaktggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagctgtctggttcagatgataactcagagggctcaaccccaccacacctgccagttttctggacaaagaaaatgtaattgccacctcttcctgccctctctgcctaggaagagatggaggcaccagtgaggccatagtgagcaggtacttgggtccatgtgactgttaatttgagctgggttcaattctcaccttctccatgtcctaactccttgctctgtgaagaggaaagttacggtgaccaggctgctagggcatggccagcgtgccttatgtccttagggcagatcccctcccacctggctcaaagcactcagaccctgggcagccttttgtggtcatggttcccagcaccaggaatgcctgtgctgctcttagttcaatttccttgctgcaggggtgtcttaaacagctctgccgaatgccagtgcctgcaggcatacttcgtgatttttatggaaatacttgagaacatctgtagaggaaaagcccgttgcttgccttacgcttcccccggccctgccgccgccccagccccaggtctgcctgtattccccttgaggatcttcagcctcctactttggagaagacagctggctgtggggactgaggggtgttcatcgcttagagcaggtagcaggaggcctaacaccagccccaccgggactgcagagttaccgtgctctgtccttggtyttggctgagtgctccagacaattgaaagcaccagtctggccactgctacatctttgccttcttctattgtactggctcctggtgcctgaggagtccattcatacttctgttcctcaactaaccaataatttatctaccttacttagaaacaagatccctcactcttctactcaaacctgagtgtaaggaatagctcaacctgttctgaactggcttgattcccatcacagcctgtgcccacatctgctgcctcctgggccagtagttcctggtcctgggcacagtatatgcccttgtccacctccttctgatcattttattttcttggcctgctctgcttgggtgaccttatccttccacagtttcttcttccccactaggacgttgaggacagaggcattttccctttggtatctagtggtgatactgtcaaagggaaagtttttcccaccacaggaactttcccattattgctctagagtaccctagacactccacaccgcagtccactggccacaccactacagcagctgaggcttgaacacaactgttgtcttctttctccagtatgccagctcctttgcggatactctatagacaccttgttcactgcacctcccccattacggctccatgtcttccccaccacaactcctggatctccttgacaccttattcgtgcctgacacccttctccatcaaaacaagcttttgagtcatgcatgaatcctggttgcatcttagttgttccccctccacctcattccattttacttctgcggtttgtctaccagtctaccattgttaacaccagccagatgggagatcagggcttagcaggcgggggttgcgtcattgcaccgagccccctgcacccagcagccacaaaggatagggtgggacaaaggtttctcttgtcactgcctggaactatttgcccacctccttctgatcattttattttcttggcctgctctggcaggcattcaacaaacatttgttgtgtgctgtgtgccagtcactttctaggcacgtgagacagcagtggataaaacaaagatccctgtcctcttggggttttacgttctgctaggttgacacccagaatagattataaacacagtaagcaaattgtaccttagaagttgatcagtgctcttcaaaaggcgaggaatagagcccgatctggggatctggaatgatggcagtgcaggtaggaatttttaaatcggaaaggcttcatggagatgactttgaagcaagcacctggaagaagtgagagaatgaggcacgtggatgtgggccagcagcattccaggcaaagggaaccacagcaaatgcaaaacccctgaggctggattgtgcccgtttcactcaaacagctagaaagagcgctagtatggtggcagtgagtcaggggaagaagaggaagagatgaggtcagagaagtgatgagcctgttctatgccaaggcgaggacttttatctttgtcaaatatttccactcccatcatggcccgggaaatctcactaatgtaaaccttactgaaaatcctaactgctgtgatcaaggctgccataaagggaagcccggaagaggcggggaggctgccttggaacagggtagtgtaaggatgtgccagaaggcctgctggaggttgcagccctttgagctggacttggggatagtgtggttttccaggcagaaggaagtgaaggattaggtcggcctggtagtacttggcacacaacatgcgcccaataaataaaatggaaataaaaccgcggagtgttctacttgtgttgactgacatcaaaacaaaacaaaaaaccctcagagtgaggggaggcacgggaggggctgtgccgggcaagagaggtggcaggaaaatccaacgcacggcgcctatgcaaatactcgtgtgaggcagaaaagaggctccgccccgctcgaagttccaagcatgcgcagtagcggctcctgcgcctctaaggatccgcctctttccttctttctcagcctgggttccaccccgggaggcccgctgtatgagatggagggcgggctaaaggcgggacgagactcgattgagcgcaattatgaccaatcaccttgcggaatattcggcctatagcgaaggaggagctcagaacaaaaaggagaccccacccccgccgacggtgaaaacctatgaaacctgggcggaggcgtgcggagtcgggtagagagcgaaatcacgcctcttcagtcagccacgccctttattcttgctcggcctcgccacagagagcaaatcagattggctgggcgacaacctcaaagggcggggctgcacacgttcactacgggaatgaggtagcggtggagggggcagttgggcggggataggccgtcctagctaaggtggtaaaggccaataactcttcaggctgcctctcctcgaaaagtcatcttctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccrctgcggacgggtcctttggtacatgcagtccgaggtgagtcccctcctttccacttcacccttccgagcgcctgcgtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccggtgagcgcgtccccgaggcgtggaggctgcccctcctccttcagaacccacctcgggcggtgcccaggggtctgggctgcggggctggcaggtgcccccacccccggcgaatttcccagaatgcaccggggcggggggtcatttggggcctccctgaccttggccccgccctgggcctgtcctgggagctggggttgggtagtgctgtgggtgctaatggggacctgggggagtcaaaggaccaaagggtgtggaaatgggtgacaatggggtgaaagacttgggggggttgctgatgggggtcggagcatgtggcagtaagcctcacgccaataagtcgtgtaaggttcaaggccccgtgtgtgcttgtggaaggagggcggggtgcggagcgggtgagggacccgagggtgtataacggggggtagggtgtcgaggaagttctaagacatgctcatagggattatgtccgcagagaggcccggtgtgtgttcatgggggacagggtggcacaggtaccagaacgtgtgttggtggggtcagggctctgaggcctggtgcgtggcgatgaggccctggatggtgttaatactgcgtgtctgtccgtggggcctgcagtgtgtgagaatgcagtgtgtgcttgtggagggcaggtagctgaaggactcgagtgtggtgtgtgcgccagtgggggtcatggctgtagagggtgtatgcctgtggcctcgaaggtctaggtagtttgggacccagtatatgctaatgagggcagagtggaggaaggacctgagggtatctaacggaggaaggactgtggaatacctgagcctggcctaaaggagatgagaattgcgtgtctgtctgggcccaggaaggagtggtggggaagtgtcttagcactgtcagaggcttagtggacgaagggtaaaggtgatgtgaggtgtgagtgtgtccatggacacagggaatgtgagtctcgagggcacactaggaaggagcagggtaatagaagtactggtggttgctaatgtgggtttagagacatagaggcacttcaatgtgtgccatttcgagagtcagctgtgtgaagtctggaatatgctaataagcatcagaaccttgtgaagattgtgcccttgtgtccgcggaggaccagagtatgttgaggttccagggggtgctactcgggggtagggctgcggaggggatctagtgtgtaataagggggatcagggctttcatgaagggatctaagtgtgaaccaacaaggattatatctgtggagatatctctgagcagagagcaatagaggacaggaatgtgtgatgatctcggtgtgctaaagtggattacagctagggagggctgaagtgtgtgctaatgggagtcagggctgaatgagacctgtgtgcactaatgagggtcaggccatggtagaacagtgtgtttgtgtgtccctgcggaatagggctgagtaagggttcagggtgcactaatggggaggcaggactgtgtgaggcccggcgtgtgctaatagaaatcaggcctgagtgaagactcagtttgtgctgacagaggggacaggacagtggaaggactggaatgtgtgttaaggatggtcgtagctgtgaaggggcctgagtgtgggtaacactggttagagatctatctgtaaggttcactttatgttaatagcattcagagcagcatgaagaaggtccagtgagtgctaatgtgggtcagctatagagtaccccaagtgcatgttaatagaggtcagaatcatgtagggggaacagtacgttaatgaggggagtcagtactatggagaaggtaacaagcagctaggccagggaggggcccaagaatgtggtggcaagagttacttagaggaggctaagtgtgtgctgacagagttcagggcggtatgttatgtgttagggctttgaatgctgatgggtatatgagataatagcaggtaagatgtagtgaggcctccttgagggtctagcgtgtattaatggggatcaggacatagggtgcgatgaccaagtccttagtggttggtgtg

SEQ ID NO: 10585 - DNA, 24070 bp, Homo sapiens
  misc_feature (1)...(24070): n = A,T,C or G, or insertion/deletion polymorphism (see Tables 1-2)
tggggaatgactggcctggtaccttgtctacacagttcccttataaagttcctgatcttgtggtaagaaaagaatatcagtttctggccacatatggtggctcatgcttgtaatcccagcactttcagaggctgaggcaggtggatcacaaggtcagcagtttaagaccagcctggccaagatggtgaaaccctgtctctactaaaaatacaaaaaaattagccaagcatggtggcaggaacctgtaatcccagctactctggaggctgagtcatagaattgcttgaacccgggaggcggaggttgcagtgagctgagattgcaccactgcactccagcctgggtgacagagcaagactccaatttaaaaaaaaaaaaaaaaggatatcagtttctgacaggcacaggaacctcaatatattttgagacctagagaagagaggaatttatctagtttgtacaggtaagacaggtacagtctgatggcgaatccttggcttggtcactgcactccagcctgggtgatggagtgagactctgtctcaaaaaagtaaaaaaattagctgggggtgatggtgcacaactatactccttgttaattggtgttctcacacacacacacctttggacactaggctgattatctctttaggatgagcccatggaagggtactcactgggtcactggatgtgctcacaatgtgctccttacctttctggctgtgagtcccttcccttaaagttctcactaccccaggccccccaagggtggtcttttcagaaaaaggcctgttcctgtcttatcctgtataaaaccttccaaggcttcccattgcctgcagggaaaggtccaaacttcatcctggcccagcctcttgccagccttggtgctgcccactggctggagcaccacatctccacttggccttgagttcatctgaaaaatggggacagattacaccatccccttcacattgccaactggctaaagaagtgaggaagttaagcatttagcacagagcctgtctctttgtaagttttagctggtagtgattgaaaccgtgaactccccattgctgagaccagctcggctggggagaccctaacccagtggcgctagaggaattaaagacacacatacagaaatatagaggtgtgaagtgggaaatcaggggtctcacagccttcagagctgagagccccgaacagagatttacccacatatttattagcagcaaaccagtcattagcattgtttctatagatgttaaattaactaaaagtatcccttatgggaaacgaagggatgggccgaattaaaggaacaggttgccctagttaactgcagcaggagcatgtcctaaggcacaggtcgctcatgctattgtttgtggcttaagaatgcctttaagctgttttctgccctgggcgggccaggtgttccttgtcctcattcccgtaaacccacaaccttccagtgtgggcattagggccattatgaacatgttacagtgctgcagagattttgtttatggccagttttggggccagtttatggccggattttggggggcttgctcccaacaccccattttgagtccttaatctctattatcagtaaataatgttcttttcaaatgattgacgtaactcctgcaggctctgcctacatctgtccactggcaattgacactttgttcaagccccacacaggagcacttatagtggagtgtactaagagaggatgtctcttagtcttgggccacagaagtgaaattgatattttagttcagataggaaggatggagaggagttggccaggacaagagtgggggcccaagttaggcaagcagaaggaagagcccagggcagctcctgcatgggtccagctccctaggtggtgtgaagcttggtgagcaaggggctaaggaagccgctggggcagagccacatgagctctggccgagggagaggtgaggatggcaaagcaggcaggaaagggtggagggcccagcaggttaggcaaggagttcagacagtcgagggatgatggaaagccaatgggggcaactttgctttgggatccaacaatgactgttggtacccagctctgctatttactaggtgagggaccaaagacaagttacgttctctgagccaatttcctcatctgcaaaatgagaataataattgtaccttctttggtggtgagagctcagtgtaatgatgtatgtaaaaggctctgcatgtcctctggaatcagcaaatggtagccatatataaataaatgcagattctggatccagcccccaaagtaaggaaagactggtccttaggtgcccttgctggaaaaagtgggatggaaaaagtgtgatggaaaaagtgtgattcttttgttttttgtagagtctcactctgtcacctaggatggaatgcagtggcgcgatgtcagctcactgcaacctccacctcccaggttccagcaattctcctgtctcagcctcctgagtagctggaactataggcgcacgctgtcacgcctagctaatttcttttgtattttagtagagacggggtttcactgtgttgcccaggctggtctcgaactcctgagctcaggcaatccgcccgcctcagcctcccaaagtcctaggattacaggtgtgaaccaccatgcctggccatgattcttgataaagtggctttgtaggattcttggctaaaactcggctcaccaggccaagacaaggcatagttgaaaggaggatgcaaaggagcctgactccactttagtctaggagggacgcttgtcagctgttctatccttagcatccagaagtgagtagcacgcagtgggcctttggtcaatcactggtaaattggtaaatgaatgcaccatcctgagaaattttcttaaaaaaaaaggccctaattgaatgagagagatacattttcctcccttagctttccaattcctggagttaataaatagaaacatatgtttttcctagaaaataatacatttgttaaaacagattcaacctactttcattttctatgtcagcaaatagtgaggaaataatgtttttagtgttctaggtgatgtacttttctaacatgctttttatttgtatgaaataaaaacaggattatttggaaacaaatagctatccaaaggcacataaaatatgtctctcatactttccgtatcagtttctggtggcagatgtcaacctaagcagtacattagaaccacttgggggctttaaaaaatccgaatgccaggaccacacttagggcaattaattcagaatctctgaagctgggacccaggtaccttcactttgcttttttttttttttggtatttatttcattctattttctgtataactttaagtacataaagatttatttccacaggatcaggaaatgggtagaaatcacaggacaatctctcttcccaccaaaaaagttgcgtattttggtaagtgtttgtcctagagggaaaaaactgaaatttacattagcagtgctgtgcaagattcttacataaatcaagacctaaaagcagcttgcagtggaggttttggtcccctgttcaggtgcttggacagaagccataagctggtgagtgtgacagggaaaaggaggcagtgaagacaggtgacaggcacctagcagggaaggaggattcaggaataccagactccttggaatggagtgttgtttttcctttttttttttttcatctctgtaggaaggtgctgggcagggatcccagagaaagaaagggttgaatactcctttaactgccctggatgaagggcactgctacagcagctagtaccggagactctcctatctcatggttgaggcagacccaggatagaatagtgaataaaaggaatgcttataggaaacaattttgcgtggaatgctagatggccaagcctcagcctttggtccagtgcaatccttgcctcacttgtcaatagtgaaaaattagtttggttagaagaaccatctggaaacacaccagcttctgctaccttcatgctcattgtcagaaaaagattaaccagtgtgaacgttctgatctgttaattcctgggactgttttcttcccagtggactgtttgttggtagaataacccccaaagctcaaagctaaaatgcatcattagtcctcgtcggcagttgagctgatttggaaaagctgcaccttcctgcagaagatcaactgacctgctatcccactgcacatctgaggtatatttcagtgaaggcaggtagctgtgcttttcagagcagagaagcagttttaagagcagaaaggtagaggaaatctagaaaagaaccgtcttgatacagatttatcccatggtgtgaagggagggcaaagaacccagtggcacttcgcttatccagcaatttctgtcactgtggcgacaaacttctgcccattccagagggtcttgaactgctcaggaactgggaattcattaaagtcaccgccttctgtaggaatgaggacattcatctcagaagatttggcactggctatttcacaatccagggaattcttgctcaggtaagcatggcagccatctgttttgttgatggaaatggttggcactttactcatcacctgaactttgacatccctactgttgattatctccacaatgcccaccatatcatcgaataccagaccaagtttcttacaattatctactgtaatggagttaattttgcccttgatttgcaacatcgtgttgacacacttgtatatgtaagccgcctgtttcagctctgtgtcatcaatcaccagattggaaacattttcctgattttccactctccacttcttgccctccagttcaagtacagctggctccttctttgtggctggtttggggtttaggtgcagagaatggcttggggccactgcgtactggaccactctgagccttcagggtagggttcttgtgagtcttcatgtcatcagatacacgtttcagggcatgtgtgatgctctccccctgattaatctgcgcaaacagtgctgagagggaagcggactcatctgagcctgaactgacagagactagtggaggaggggggcctggtggtgggggaggagtagctgatccagcagagggtccagatggcagtccactcagttcttttgtcacaggccccgttttgctccaggcagtccggtggtatggaactccttaatgtaagcctgcagctctgtgcatatacttaaataagctttgactcagtctacatgcttcttatccacatctttgtactctttaaggactcagtttgtataaaacacagcagcatgattcatttctttcacataagggccaggattgggagccatagccacccagcctagggcctggatactttcactgacagctgacagctgattaaacaacttgctgcctcggttcttctcccaaaaggttatcacttctttgatctgctctgagataggtgccaacagatcggaaagcttattacctgccggctattgacactgagaagctgtaaccaagagagctcactccaacttcaaaactgtgtgtaccatctccacatctttctgcacgtcttccccaatctctttactgatcttcaagtactctgccacagggcaggcaagcagcgagtcaaatgcctgcgcatatggagctgctcctgcttttgaaggactatctccatatccacggtgcatgtcagaggtatgggatactgcctccaggcggcccactgccctgtccaattttttaccagattttgcatgtcagtcataatgtatcacctcccgactgcgatcagccgctctccacttcccgcaccttcacttttcaaagattcccaggtgatgccaacctgctctgcggatggagcccctaagaccccaagcggcccagactacgtttcccagaggcctccgcggcctcagccacttccgcttccggtccagcctgtctccgcgtggtgcgagcgctgcaccagcccctggctggtggttactgtccgaacggcgtggtgtggtcgctgactctctgggcgtgcagctccgcagccctgccggctcggttcggttcgtgagcggccggggtcaggctgggtccctgaagcctcgagcccctggcgggtgctccccgcctttcccaggggcgggtcgaggggcgagccggggtgggaggggaaggcggcggtgggcagtgcccacccgcagtggctgcgccgtgtggagcgaccgctcgaggctggtgcatcacagagcgctccagccttgcgccccggccgacagattgggccactgacaaggccgtcccccggtgctgccaaaagtgtttggcgtggagctggctgcagtccaggccggatcccagcagccgttccctttcctttcttcccgagcgtacccacctggacctgtctgcccacctgtggagggaacgggcgggcggggacctggtctagagggcagattctagctaggctagggcacggagggacttcctcaatttcctctcttctttcccagattgacttacgcaggattctcagcccttgcctgggagaacagttcaggagacagatggccccaagagcccagatccaggcaagtttgatttttccatttcttgagaaaccacgtgtttcagcgaggtggggtttatgcctcttgcccggacaatgccctgccctgtgtgtggacaaagctacccgaaccaatcctggatgggtcccgcgatttccgtcctgtctacccattacgtagtcattcaccaagtagattattgctacccatgttttctagagtgctagaaacagaaaagtgctttgcaaactggcagacgatgaaaaaaatacacgttagcatgtaaagacgtaggccataaagacatagggtgatagcagtgctctcttgacctttagtgtgtggtagggtgggaggggtggagtagtgggcgccttagttcttcctgaagaataaatgagatttgcataattgcagaggatactaggggaaagcgctgcctgaatgaagtcattatggcgggaccatgaacaaactggtctgagaaagttggaaacattcatggtctagaatcccagactggagtttgcttttatcctggagaaaactaggttttgaaggattttgagaagctgattaaataattggtattttgaaaggaagtgataaacatttgagtgtctattatacaaataaaattaaaaaaattaaagatcacctacatttctactgctctaagtcaagtaatttcatttgaaacacacttttcatttttttaaggcttactcattttttcttttagtatttcatagccattccaatttgttctagtttcattaccactttttgtggcttccttttatactgtgccttcaaccagccctgggaccttgagcaagttcttccaactctctgaacctttgtgtctttagctacgaaatagattttactttatatagttacggcagaaatttagagagatgatatgtatctcagggtttagcaccgtggctggtacatagtaagttgttactcttatgaaaagcaatttttttttcttttttaaaaatattctgccccagagtcagatcatactccctgtaaattctcggataaagctaatcactttccatgtcttttcaaagtttctattcatttgttgattgaataaagcctgaacacttctgtgtcaggcagtgtttttgactgggaggcagcagtgacccacactgtccccctggagctcacattagagaggatgctgacagtcagtgcaaacctctcctgccaggtggtgagaaatcctgtgaagaaaagtgaaatgggtttcgagactgagtggcagaggatggggtggagaaatagaagacctttttgatgaggtgacatgaagggtggagtgagcagaggctaggcctggaggagggagcaggacaggcatgcaggaagaaccygctcaagggaggagtcgcacatcccctsagccctcagcttttacttgttggtttccatgagcactgttggaactgtcagaagctggctttgaccaccttgcttccttctcttgggatgcctccctcaggggttcccggatgagcagaattgggtttggttttgcagggaccgctgacatttggggatgtggctgtggcctttaccyggattgagtggagacacctggatgctgctcagcgggccctgtacagggatgtgatgctggagaactatgggaatctggtgtctgtgggtgaggatggctttctccttgactcaggattggtctgctgggcaactttgtgttttcacagggtgaatggtttggggtattgaaaaaatcttaaatgatgtgctttttgttttgtttttcttaagtatgggcttagaggctggagtttatgccccttacacccctcaagaaaggtcagagccatacagagttaagatgggtagctttgtggtgccaactagcccagttctggaatgtttctgtgtcatgattcatctgcctcccaaaataggagtttctcgtcctccaggaggacctggttttctagttgactttgccccctccctttgctttacttcatgagttggacatcctgggtgccaccctctaggcctctctgacctgtccatgctcattgcagatgctcaagttgacactgaggtctggagtgactgcttgtgcttgtaaccgccatcacattccttttcattcattttttttttcttcctctaagatcctttttctttatgaacagggcttctctcttccaaaccaaaactaattactcagttggagcaaggggcagagccctggactgaggtgcgagaggctccatcaggcacacatgcaggtgagtgggtrgggaacatcccagcagaagctgagcacacggagcagtacgggggttcctgagtggaagctcatctttgagtgccctgttggtgcrgaaaggcactggtttcctcttttgatgtcatcctcctgtcaagtggctggccgcttttctccccagtctttctgcacttgggagggctgctgccttcctgagggcctcaggcccatctgtgccatctcccagccttctgaaatcctcaarctctttatgtgatttttctctctctctttccaggcattcaccaggtatcttttgtttctttctacttctgttccattttctttctttcttttttttatattttttgagacagtctcgccctgtcgcccaggctggagtgtaattgtagctcactgcaacctcaaagtctggactcaagccgtcctcctgcctcaggcccctgagtaggagtagctgggactacaggcgtccaccacaatgcttggctaatttttaaatttttattttatgtagagatggagtgtcgctatattagtcacggctggtctcgaactcctggcctcaagtggtccttccaccttggcctctcaaagtgctgggattacaggtgtgagccaccacgtctggcccatgttcattttccattccttacccactctctcatggaagcttgctaactcactatataccacttcctggtggtagttgcagattccaaacataagcatggttttttagctctcaggtaattgcgatttttggcaaacacattgttggggaagcattttctttccttttcttagggatcttcttttatttgtcttttctactgtcctttgctcttggctctcatttttttctgtgtatactttgtatatgtttttgtatgtcactttctctgtgccatagttcatttctaaatctctaagcctgaatatttctctcacctaaaatatttatcctgccagtattttttcttctaaaactctaattgtcattttgcctctatcctcttcaggagaatgtttataactgtatttcatgtaaaataccagtaatacatagtcttgcttaacctaggtctttgctggttgtgggtgggatgcttttgaagtaattccttttattcttactgtgtttaacatttcccccctaaattcttgtgtagattctttatatagtaacaaaagtcactcagtcttctttattctttgttctttctgttttaattttggttgttatttgaaatagaatgtttaaaacttggatgtaatgaaaacaagcaatgtttcccctaatatttctttcatctgcttagaggactagtaaatctttctacaaagacttcacaaccagtcagtattttatgtttttttttgtgtgtgtatatttccctttctgttagttgttagacatgcttatggtaccacattcagatggttcaaatggtatgcagtctccttcacatacctttctcatcactcagttcccctccccagaggcatccctgtgtcagtttcttgtggagatttgtaggtgtgatgtatactttgtgagagtatccatgaattctttaagcacatggtagcacactcttttgcctgttactttggcatttatgtcttagaagtcatttgacataactatattgtttagagcttctctctctctctcctctctctctttctttctttcttttggagacagagtctcactgtttcctaggctgaagtacagtggtgtgatcatggctcactgcaaccttgacctcctggctcaagtgatcctcctgcctcagcctcctgagtagctgggaccacaggagcatgctaccacacctggctaaatttttttatttttaattttatttatttatttttaaatttttttttgtagagatgagatctcgctattttgcccaggctggtctggaactcgtggcctcaagcaatcctcttgcctcagtttcctaaagtactgggattacaggcgtgcatcaccatgccagcttatctttctttttgatgcctgcatagtgttccactttatggatgtcctataatttatgtaatcagttatctttagtggacataatgactctgaacaatgttgcagtgattatcctcatacacatcaattctcttgtgtacaagtaaatctatagaataaattcctataagaattgttaaaggttaaaatttttaaatccaccaaatttggtgggtatttccgctattcataaagataatacatgtttayactcctaatgacaacatatgagtgccacttttatagcttgtcagcagtgtcttatatgctttgatccttgcaaatctgagaggtgaaaatattttattataattttaatttgcctttctcttatcaggagtgtgatttagcatgtttcaacattttcagcaacccttgtatttatctttcctgagaactgcctgttcagtcctttgcccgttttactgttagattgttggtctttttattgtcagtgtgaagggttctttatacattcaggaaattaattgtatatcatatatatcacagattttttttaaaagtttgttttatatcagctttatattaacaaaggtaatgatggatatgcttgtctttgcatctttgcattgtgtctggccttctcatttgagctggctgttgagttgggatacacatacattgttatttaaaggaagtatttcattcacatgttttgttaagaaattttagttttttaaatcaagcatgattgctgaattttattaaatgccttttcaaggtatatggaaatatctgtcttttccattttgatctgtttctgtggtagattttattctcatttatcttggccatgacacattatatcattctctgaatatgacagtggatgattctgtctgccaatcttttatttaaatttttgcactgatacttaaatgtatttatgttttctttttcatctgcccattttcattgggctttgattttaattttgtaatactttcataaaacatttttttggtctttcatatttttatcctttagtctagtttaactcacatgatagctgttccctaaaggtttgggtcctttgtcccgtttttgcttatttattgtgatgtggagcagaggggaggaattgggggtactttttttgacagtgttgtcaatactgacttgtccaaatagattttctctctctaggaaacagttttagtaatttataatttcctaaaaagcatccagtaattcaaggtcataagttacttgtgttgaacaaagtagctttttataactcttagtaatattctcyacatctttggttacttttccctgatttcttactttgtcttttttccatttcctatattttcctatttcccctttattagctctgttttatttttttgaacaaaagcatttggatgtatttattagtgttactgttttctgtgttttgaatcttaagttccttttcccttttgctttccttgggtttatttactttctcctaaacattttagttattcattcattgatttttcttctttcttactgatgtaatataaatatttaaagccttaaactttgtctatgtaatgttttagttatattcagtaggttacagtatgtagagctttcattatcattttttagatattttacaatttgtgttttgatttctgtgattgaagtactaagagattgataagctagactctccttttcttaaagcctttaaaaaaattaacacatatatagaaaagctgataaaatatgtatacagcctaaattagtattttaaaactctgtacccatgtaaccaaaacttaggttaaaaaatagaactttggcaatacccgagtaaatcacattataattcctcccaattattgtccattctcctccccttgaactaacactatagtttatttttgcctgtttttaacttcatgtgaatggtatcatatagtacatataatttttggtctggcttatgcataacatgttttcaaattcatttttagttatttctttgctgtggatcaatgcttctgaaaactgtagcgtgcctcagaatgcatgctgcagtacagttgcggggccccctgcagagttctttattcagcaggttctcaggcatgctgatgctggtgctgtggggctggagcccatgcttggaaaatcactgttctagagtgactcantgtgtgactctactgcagtttctctcttacattcagatgcatatatggcattttccagcttttggctattgcaagtgctgtaaacattcttatactttattttttggttcctacgtggctacatttctgttgggcatgtattcagctttagtatataatgtcagataatcttccagagttttgttcccagttatactccttcatcagtgtgtgagagcactccttgttccatgtcctggctagcacttcctgtggtcaatcttgtgaagttagtcattctggtggatgttctgtgtgcctcattgtggttttcatatccatgtctctatatctaatgaggttaaagacattttagggctgggcatggtggctcacgcctgtaatcccagcactttgggaggctgaggtgggcggatcacctgaggtcaggagttcgagaccagcctggccaacatggtgaagccctgtctctactaaaaatacaaaaaattagctgggtgtggtggcacacacctgtagtcccagctactcggggagctaagacaggagaatcactcgaacctgggaggtggaggttgcagtgagctgagattgcgccattgcactcagcctgggcgacagagtgagactccgtatcaaaaaaaaaaaaaagaccttttagaatatttattggtccctatagagcatctctgattgggtaactatttgaagagcctgttattgattacatgtattgtaccatccctctctctgttgttactgactgttaatggtcttgatgaatagcagttcttcctttttctgggctcaagcaatcctgtctcagcttcctgagtagctgggactacagacacatgccaccatgctcagctaattcaaaacatgttttttttctgtagagatggagacttgctatgttgcccaggtggtgggtctggacctcctggcctcaagccatcctcctgcctcagcctcccaaagtgctgggattacaggcatgagccaccgtgcccagcccagttcttccatttgatcaatccctttcttttttgtcagtgcttttttgtgtcatgctttatttaaaatgtttattttaaattatatattaacaattatttattaacatttattatttttgtgattttaatattttttcttttcccgagatcatgaagatattcttctgtgttaatttctagaagctttattatttggtttttatgtttacatttaccatcctcttagaatggatttctgtgcatcatatgagttagggtttatatattttttttctcctaaaatgtactaatgcagaatctcctcttcctcactgctttgcaagaccacctttgtcatagaagaagtgcccatatgtgtcttcacgttgccagctttacaatcagtatcttgaaattttctctagtttgatcataatacattaaacacatatcccatcaaaggccattggaagaatgtgggctgtttctgactgggcttcaccttcaacttacatttccttgaaaaaataagtcttagctctaatatccattgcatggaatttctccccagactactaagtataaatacatataaatatatgtatgtgtatatatctttaggtatagatagatacaacttatgtttataagaaaagcgcatttagtaaaataattggttggtgattgttaattttactacaagtttggctctattagtttttcagaacgtttttgtctgaatcatttcgctctgtctgtcttaggtcttgtgtctgtactttgtaaaaagctagagaaaattcacatagtacacccattgattggtaattttttttttgttttttgagacagagtcttgctctgtcacctaggctggagtgcagkggcatgatctcagctcactgcaacttctgcctcccgggttcaagcgattctcctgcctcagcctcccgagtagctgggattaaaggcatgtgctaccatgcctggctagtttttgcatttttagtagagacagggttttgccatgttggccaggctgggctcgaactcctgacctcaagtaatccacccgtctcggcctcccaaagtgctgggattacaggcatgagccaccgtgcctggcataggtatgttgttttttagatatgttaaaaatttagtttatagtaaaatcttattggcctgagaactatttttgttccttgaatattttttctgttttcttttttccactgagcaattaaatattggttcactcttaaatcctcacagagaactatttttctcaagttcttggtgacatcataatgttctcaaatataccacctgcagaaatctgccctagtagtaattatagcttgctttgtgactctgggctttctcctcaattttgtatttattctcacattgtcttttttcttttttagctgtttcctgtgttgtcttcctaacttggcaacttcttaggggctcactgcattctttaaatgcaatgtttatagtacagattcttttcttttctttaaaatcatacttccttttcctgcccttagtctggccatcttttctcagcaagaatcacaagtgggacacattaataatttttcataacctttagttatgtagaatagaacattattcaagtccttgcacaactctcactttcagcatttcaacataaagaacatttgaatttttaaaattttctttcagtcgaggattactggtttgaaacaaagatgtcagccctaaagcaaagcacttctgaagcatcygttctrggagagcgaacgaaaagtgtcatgatggaaaaaggcctggactgggagggcagaagctccacagagaagaactataagtgcaaggaatgtgggaaagtcttcaaatacaattcgtcctttattagccaccagagaaatcacaccagtgagaaaccacataaatgtaaagaatgtgggatcgcctttatgaacagttcatcccttttaaatcaccataaggttcatgcaggcaaacagccttatagatgtattgaatgtgggaagttcctgaagaagcactcaacgtttatcaaccatcagagaattcattctagggagaaaccccacaaatgcattgaatgtggaaaaactttcagaaagaactcaatccttttaagtcatcagagaattcatactggccagaaaccntacaaatgtaatgactgtgggaaagccttcrctcagaatgcagctcttactcgtcatgaaagaatacatagtggagagaagccttttaaatgtaacaagtgtgggagagctttcagggataattcaactgtgttggaacatcagaaaatccatactggtgagaagccatatcagtgtaatgaatgtggaaaagcctttaggaagagctcaactcttattagtcaccaaagaatgcatactggggagaaaccctatcactgcagtaaatgtggaaaatctttcaggtatagctcatcctttgctggtcatcagaaaactcacagtggaaataaaccgtatcagtgtcgtgactgtgggaaggcctttacaaagagctcaacccttactggacatcagagaattcatactggagaaaaaccctatcactgtaagaaatgtgggaaagcctttcggcacagctcaggccttgttgaacatcagagactccatactggggaaaaaccttataaatgtaatgaatgtgggaaagcttttccccgaagttcagcccttaagcaacataagaaaattcataataaagaaagagccatgaaatgtagttagtgtggcaaattgtgcagagtagtttattccttctgaccatcatagaggagacattaaataaattatgcatttaacagaaatactctgtacttctgagagaacacatcacttgtgaggatattcattgtgaggttctactagtgaaatatttgaagaaactaaatgtatgtcagtatggaagtagttatagcatactgtgtgctaattgaaaagaatgaggtggagctgtaaatactgtacaaagccaggcatggtggcatatgcctgtagtcccagttacttgggaggctgagacaggattgcttaagcccaggagtttgagtctgtaatgcactatgattgtgcatgtgaatagccactgcactccagcctgggcaacatagcaagactccatctctaagtaaaaaaatacaacagtagaaatatacccatgataatatacccaatatacccttgttaaagaagcaagtttcaggaaatctatattatatgcattcaaaaagacctggacaaataaagaccaatcttaacagcagttatctctctctctctctcttttttttttttttttaaaagaaactagctcttactctgtcacccaggctggagtgccatgtgatcatagctcactgtagttttgaacttgggcttgaacaaccttcccacttcagtctctggagtagctggggctacaggcacgtaccaccacactcagctaacagcagttatytttgatgaggatgtagtataggttgagcatccataactggaaaatctgaaatctgaagtgctccaaaatccaaaatttgtctgagcaccaacaggtacaaaattctacaccagaccttatgtgatgggttgcagttaaaatgcacccccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcrggaggctgaggcaggagaatggcgtgaacctgggaagcggagcttgcagtgagccgagattgcaccactgcagtccgcagtccggcctgggcgacagagcgagactccgtctcaaaaaaaaaaaaaaaaaaaaaaaatgcacccccaagattccttattatttgcatgcaaatattgcaaagtccaaaaaagtctgaaatcctaaatacttctggtctcacgcatttcagacaagggatactcgacctatattggtatgatgaagtgaaattatgactttgactgagttctttgaaatgaaatatttaatcaagcatcattcatgtatcttctgtaacttagtatagttatcttcctatataagaaaactcagaagtcataaaaataagacaaatgccacacagaaactaaaagcttttagtttctgcaactagaggcttcgtagtattaaaatacaaagggctggacttggagaaaatattaccatcatcatatttaacaggtaacacttagactatttagagagtccttaaaatacataaatataaaaattccagtggagaaatggtcttggatgtgaatgtacagttgtcagaaaaagaaatataaatgattatgcctaccaactttgaccttttgacctaacatttctacttaaaatctaattaaaaagtaaaggtggtctttacagcattgtagtaatgaagaggtggaatcactgtaatatctgtcatcagaggaatgttgaagatacatgcagtctttggactaccatgtagtcactcaacatttaattaaaagacagtcctttaattaattaacatttggtgagttagacttttatgagctgacaggcaaagttgtctatgacattaagttgaaaaagatccaaagtaaagaataatggtatagtacttcttttgtatagtcaatgcattgcctgaatattttgtgataaaaatatatcatggatatagttcacaatgtaaaagcaataaagcaaacttaggaatgttataaaatagaaaagaaaggatctaagtattcaactgatgattgcagagggccagatttaatcaaaagaagcacggctgcacacacatagatgattgttggtaagaactggttaagctgctttggataacagtttggcaacatgaatgtaaatgtaaatgtatgttctaattgacccagaaatgccaccctcaaacatttaaggaaataatttgactaacttacagagcttgtattgctcatcgtcattggttatactaatatcctggaaagaggtgggagaaatatctaagtagggaaatgtttaaataagttatgaaactctcataggctagcatcccagttactacagatgtataataaaccgtcacacacttagttgccagtatttgtgttcacagattttgtgagtcaaggattcagaaagggcacagcaggaacagctttgtaactccatgatgtctggggtttcagttgggaaaactcaaggttggaatcaacagttggtcagtggggtcatttgaagcggccacactatgatagccacaagtggctactgagcagttgaagtgaggccagtctgaatggagactagtgtgttgattgaaaataggactgtaagtataaaatgtgcatcagatttcgaagactttgtataaaaaaagaaactaaactatcttaatggtttttatattgattatattttagatagattaaactcaatgtattaaaattgaattttaatgtgactactagaaaatttaaatttacatatgcggcctacatgtatggttcgcatgttgctatcagacaacacaactgaaggctcyatcacaaattgggtggttgatgctgttggctgggacctcagctagggcagttgcatatgaacacctacatgtgacctttttatgtggctgcataggcctcctcagcttggtgcctgggttctgaggagtcaggcagagaaactgttattgcttgttgtgatctagcatcagaaataacagcatctcggctgggcgtggtggctcatacctgtaatcccagcacttttagaggctgaggtgggtggattgcttggggccaggagttcaagaccagtcttggcaacttggtgaaaccctgtctctacaaaaaaatacaaaaaaattagccaggtctgtggcacgtgcctgtagtgctggggaggctgaggtgggatgactgcttgagcctgggaggcagaggttacagtgaaccaagattgcaccactgcactccagtctgggcaactggagtgagaccttgtctcaaacaaacaaacaataacgacaacaaaaaattcagtgtctctttctccatagtcaagcctgtccaaactcaaaggggagggaacatagaacatacttctttggaggagtatcagagtcacattgccagaaaagtatattcgatggaatatattattgcaataattttggaaaatatgatctatcatggaatatgatacaaccattaaaaaggataaagtggatatgttggatgaagaaataggttacaggacagtatctgaaagcttatggcagcaactttgaagtataatctttggagtcagggtgcaagatgcagcttacctcttaatatactttgtgaaaccactggctagttatgtagcctgttgaattgtctaccatgtacagataaaaaaaaaactagttttgtttaaaggaggtaattttataaagtgcttagctgaataccagatgcaaagtgcaaggtaaatgttagctggtgctgtgttagtgatactcatttctgtttttttttaaaaatgtatagtatgtatatatgtacatgcacacatatatatgtacacatgtatatacatatatttcacctatattttttttaaaatataaaattaaaatttctgcataaaaatataaaataaaaaaatttctctcatatatatatatgagaggtctcttacagaattgattaaagatctcaaaagaacatgctccaccatcatctatatcgtgtgcacaaggctcaagagggaccagtggttttacccactgtcaaacaccatgaacaaagcctgggtactggcttgtcttattgaggaaacctactttaacatatgaaaacgaataaaatatttcaaaatggtaatgataattatgggatttttggtaatgtatttcatttaagaagttttcatttaaaagaatagggtgtttattcaaaatgggacaagacaggacaataaaagaaagctgaccaatattccttatgagcatagaagcaaaaatcttgaatagaatattagcgaataaaatccagcaatatatagaattaataatatagaatcatgatcaaatggggttacggctggttcagtgtttggaaatcaatcaatgtaatctacattaaagaagattaaagaccaaagaggaaaaaccacctgatcataccaactgatgcagaaaaagcatttgacaatatacaatatccattcatgatacaagctcttggcaagctagtagaagggaagttcctcaaccacatagaggccaactatgaaaaacctacagttaacctcatacttaatggtgaaagactgaatattttccctataagatgaaaacaaggttaggatatctgctgtcactactcttatttaacataggactggcaatcctggccagtgcaataaatcaaaaaaaggaaataaaaatcatacagattgtaaaggaaagactgtaactgtctctgtttacaaaggacatgattgaatatgtagaacatacaaaggaagctataaaaagcaaatccctggccaggcgtggtggctcaatgcctgtaatcccagcactttgggagcccgaggcaggtggatcacataaggctgggagttcagaccagcctgggcaacatggtgaaaccccatctggataaaattacaaaaattagccaggcattaaagtgcatgcctgtagtcccagctatttgggaggctgaggcaggagaattgcttgaacccagaaggtggaggttgcagtgggctgagattgcaccactgcactccagcttgggtgacagagcaagactgtttcaaaaagaaaacaacaacaacaacaacaacaacaaaatctaataactaataagtgagtttagcaagattataggacccaaggccacatacaaaaattgtttctacacactagcaatgtacaattgaaagctgagattaaaaactgtcatttgcaatagttcataaaataatgaaatccttaggtataaatcaaaacatgcatagtacctgtacactgagaactataaaatgctgatgaaagtaataaaagacctaaataaatggagagacatgtcatattcatgaatgggaagattcaccatagtcaagatgtcagttctccataaattgatctttagatttaacaaaatatcagtcaaaattctggaaggattgttttgtagatgtagataagtggattctaaagtgttatccaaggcaaaggaactggaatagctaaaacaagttttcacaaaactagaaaaagctttgactcactttacacaatttaagactctaaagatacagtaatcaagactgtggtattggtggaggtatagaaatacacatcagtggaacaaaatagtcaagaatggacccacagaaatatgactagttaaaaaattttaaacgtgggtgcaaaaacaattcaatagagaaagcatagtcttttcaacagatggtattggagcatttagacatgtattaaaaatgatctttgaccaatacttcacactttacacatagattaactcagaaaggattatagagctgaaagtagagcacaaacctgtaaaaattttagaagcaaacacaggagaaaatcttcatgatctgggttaggtacagaattcttagacataacacaaaaaccataatccatgcagaaaaatattgataaactgcagttcacagttctggaaggtgggaagtccagtattaagtttctggcatctagtgaggaacttctcgctatgtcatcccatggtggaaggtaagagagtgagagagagaaagtgaaagtgaaagtaaaaggggttgaattccctccttttgtaacaaacccactgccgtgccaacagcattaatccattcactgtacccacatggccttatcatctctcattaggccccacctccccaaacttgcattgggaataagtttccaacacatgattttgggggaacaaattcaaaccatagcaacaataaaatatttgagataaatttaacgaaataaatgtgagacttgtacactgaaaactacaaccattccagaaagaaatttttaaaaatctaaataaatgcagggacactctgcattaatggagttgaagctcaaaattttaagattgcagaactcttcaaattgatctataggttcaatgcagcacctatcacatttgcagcagagttgttctgaacaattgacaaactgattctgcaatttatactaaaagaagaattgagaatggtcaaaacaatcttgaaaaagaacaaagaacaaaattcatcccagtttcagagcgtactatacaactactaagggggaaaaaacaaacttttccatctgccctcacaccacgacagcaatcaacacagaagacttctgtgaccaaatgtgtggggatttttcctgacagatagtgtcagaccccacaggttgagggctcaagcctataagactgcctacaacctctcagatgctaggtgcatctggaggcattctggaggtaagccctggccaccaaaacttctgacccaccagcttcaagttggggcccccacaatcacctctttgggttccatttacataactgctgtcaccacacaattaatttgctagaacagctcacagaactcagggaaacacctacttaaatttactggtttattcttaaggatattacaaaggaaagtgatgaggaggtgcctagggtgaggcatgtgggaaggggtatggagctttcatgc

SEQ ID NO: 10586 - DNA, 51269 bp, Homo sapiens
  misc_feature (1)...(51269): n = A,T,C or G, or insertion/deletion polymorphism (see Tables 1-2)
gctgacactgggaagttctgttttatctgtcaaaaataaacacacctggttgggtgcggtggctcatgcctatatcccagcactttgggagaccaaggtgggcggatcacttgaggacaggagttcgagactggcctggccaacatggtaaaacctcatctctactaaaaatacaaaaattagccaggcgaagtggcgtgtgcctgtaatcccagctcctcgggaggctgaggcagaagaattgcttgaatctgggaggcggaggttgtagtgaaccaagactgtgccactgcactccagcctgggagacagagcaagactccatctcaaaaaaaaaaaaaaaagacagtagaatattaaacgtcattataggccaggatcacgacgcctgtaatcccagcactttgggaggctgtgatgggaggatcacgtgaagccaggaatttgagaccagcctgggcaaccccatctctattttttacagatttaaattaaaccttaatttagccatagttttattaaattacactgggtacttgatgactctcatctttcttattggttctcctttcccttagcatggtaggtgaggatgcctgatgtggcccctgcctgcctctccagctctctgcccatgctcttccttcttctgtgttcagccttctttcaattccattatgtgcttggtgccctcccaacgtaggacttttgctgagggagtcatccatctataatgttctctgccatttgccccccagcccccagacacataagactttataactcctcatcccactaatcagctctagctcaaaaaaaaaaaaaaatctgtggggaaaacttgactccttactaggtcagttcttgatttgacactcttgacaacctatgctttttcttcataacttagcatttcacaatagatgtttaatgtctgtttcctccactagattgcaagctctgaggtatcaggaaatttgtgctgtgcttcttaaatccctagcatagggtaggctaaaagatgaattaatcccaaagcaaaactttgtctcgtaattattatgtgtataagctataatataacatccaattcagtctatttttttttttgtagacagggtctcactgtttcccaggatggtcttgaactcctgggcccaagcaatcctcccacctcagcctcccaaagtgctaggattacaggcgtgagtcaccatgcccagccttccatctattctttggtgcatttaactgtctgacttcatagtatataagtattttatttttaaaatttttctttttatatccacccatctgcacattggagtgtttgattttaaacacttgcttcttagtcctaggttttattcaaaaatttaaattgagcaataaacaagtattgacaatccacagttcacactgaaatgtcaacataaacatttcattttatatttattgtaaaagcaatatacagtaaaaatacagaatagcataaggttacattaagatggaaagtaaaaattttcctccccccaccccaacagtctttcaatgtcacaactataaagtttctttaaaatactacttaatacattctaacaagtcaaaaggctttgtttcttcttggttttattgttgagatacattaaaatattaagcattggcccagtgtggtggctcacacctgtaatcccagcactttgggaggccaaggtgggtgttatcacttgagttcaggagtttgagaccagcctggccaatatggcaaaaccccatctctactaaaaatataaaaattagctgggcatggtggtacatgcctacagtgccagctactcaggaggctgaggcaggagaattgcttgaacccgggaggtggaggttgcagtgagctgagatggcaccactacactccagcctgggtaacagagcaagactctgtctcaaaaaaaaaaataattaagcatcactgctgtttagatgactgaaactattttataataaaatatggttaacactgttgccaaaagcacaatttctttacaattaatattcctcattaaatattgcccaaatacttatatatcctactcctgctgatcaccaaaattgtacagtcttatcttgcaaatatagtacatatacaattaaacagttggaaaacatatagagattgaccacaaataaggcccacaaggtactgctgtgtaatgtatctaccatcaggttgatcaggccagttgttatatttgacagcaagaaaaatattaactgttttctgtttagagctgtgattaaacaaagactgggttccattctttcggcttcagggactagagattctgaatgctttttatttgtaacaggtgactggataagtttccaagaacatggtactagagctcctttaattagaaatttggcaaaactcaaaattatatcacccagtaataaactactaagaaggatcaggctagaagcaactatccaaatacaaaaggctaaatttgccattcttcgagatactgcttctacatttacttgaactacgtaaagagatatgaagaggctaatagctgccagtaaaagaaaacaggctacttttatcaagtctttgatatgtgatcggttcttatgcatatataaccctgtttgcacaccagccatgtgtattgccacataccccagggtagagattattccttcgcggttggcatttaatagaccaacccgtgtgccactaccatcagtgccatataatattaacctcttcagtgaggtaaagtcaagggctagctggtataatacagtaatgccgagggcaataatccaggacttatttagggggaaaataatcaacagcagtggtgttatcaatttcacaactattatggtaaagaaaaagttccagtgaactccatactctgttaaatgttcctgatagcctattgattttataatggctaatcgtccgattcctaggaagactaatcgcccaaacagagtaccatgagtttggtaagtaatgccatttgggaccttccatatattgcgtctcctgacctctagaccaacattgcagacccaaaaacaaggcacctactccaaatccattgctcctgtccatagagctcagttttggccaatctctgggaataggtggaagtcacagccaaatagcaatggcgtgagcgccnnnnnnnnnnnnnnnnnnnntacaatgagtttgtaaagtaatgcaatttggacccttccatatattttctcctcctgacctctagacaaaccattgcagacccaaaaacaaagccacctactccaaaatccattgctcctgtcccatagagctcagttttggcaaatcttctgggaaaaagtgggaagtccacagccaaaatagcaatagcagtaaacgcactggtaattacacggaaacaggagatggctggattgtattctgattctagactgatgttcaagaatttttcaaggatttttaggaaaggcagtctggcatagcaggtcctccttcggtatatttgatacaacagccctgccccaaagataattacaccgagaagctcaaggaggataaatgaagcccaaatggtcaaagtggctaccatgggaactattaggacaacaaagtcagtgaggaatctagttttccaggtaggtgaaaaagaacacaagtactgtgagaaaatgatcaggaaccctctgcacaggatacagaatgcaggaaagcacaatccctgggtgatttccagcacggtggttccattgaggttactgacaaaagcttccttcatctgcttttcagacatttttcttcctgtgaaaacaagagcaaaggaatggatttgtgaaaagcagcattcttgtgtaattagcatacctggcttaattttactcttattactagatttcagagcagaactttgggccctaatgagttcacctaggatttgtgattccccttccaaggattgtgggaagaagcttaacactaatgtgttcagatagaaatgtcatactaataatatgaaattattggttacaaagcttcagctattccctgtacaagacagactcacaaagaaagtgaatttggggccaggcgtggtggctcacacctgtaatcctagcacttcgggaggccgaggtgggaggatcacctgaggtcaggagttcgagaccagcctggtcaacatggtgaaagcccgtctctactaaaaatacaaaaattagccaggcgtgatggcacccgcctgtaatcccagctactttagaggctgaggcaggagaatcggttgaaccggggaagcagaggttggagtgagccattgcactccagcctgggccacagagtgagactccatctcaaaaaaaaaaaaaaaaaaaggaaaagaaaaagcaaaggaaaagagagcgaatttgggatataaactctgagaatggcatcataggcagatgggaatttctattatggagcacagtacgtatcatgaagattctttgatgcaaattgaataggatttactaatgaccttaaagcaaattcaaacgctaggggccaagtacattttgaagttgggggccttggttccagttcagagcctctccaaacctactgccttggtacaaaacgtgacccctgcagtgatttctggatccccaggctgctcctttcctcatttacagacagctatgttttcaggttaggatggaagtaggtacggtgggtgcattaagaatggatgtatagcacatactagtgttagttgctcttttattaagggttgtaaaacacctctgaatgccacacatcattgtctgaaaaacggcatactggaagaacacatttgttggttaaacatgaacctagagtttctaaatgtaccatgagctgaataagtaagtgaatgcatgcgtgcattatggcctgtctggaacctgtgacaatatctcacagtaaccaactcaaatcagttgaccattaaaaataaaagtcctagccgagagaagtggttcatgcctgcaatcctagcgctttgggaggagagaggatcgcttaaggccaggagtgaaaaaaaaaaaaagaaaaattaaaaattagctgagcgtggtggtgcgcgcctgtaatgccaggctgaggcgggaggatcgcttgagcccagaggtggaaggcagcagtgagccgagatcgcgccactgcactcctacctgggcgacagagcgagactccgtctcttaaaaaataaacataaaaataaaaagtctttttcctaacagacgcccgacctggccgcgccctacccgtatacctcacgtactccaaatggtgccggcgcccccagcagacggtctacgtgggaagggcagccggactgccgctgcacccgccaaaccacgcgggaaccagccgcttccgcctcccgcgcggcacttccggccgacgcaggcagctggcacttccgggccggccgattccgcgcgtctccgcccatcatggcgctcgtgccagtgtcccgtgggctacccactcctgtcatgtcctttgggctggtgcaggccagatcttctagggccgtagccctgagaggagcgcctggagaggaaacggcgcgccatgcacctcacacggcccctcagacctcacggcgaggccctatcagggtaatggtgtccgccggactcgcacaacactccgccgcactcgcacaagactccgccgcggcgacctctactgaaagacccccagtcctggtgtcgcccgaaggcccaggaaaccgtgcttccgcgcttctcccccagaacgtgggaagctgccgctttaccctcattttaccccagggtcgcaaaacatctcaccgtagttgaagccagcaagccggaccaggcgtcccggccaagccacgtgcgcgcccckcgccgcgagtgctcgccccgcccmtagggaggagccggccgacccccggccacttagcagtgccgcagccgacggggtgcggttcggcgctcccaggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccggtgagtgtcaacccgaacctatatctgaagcccttcagacgcggaaggggcttgggaggccagtttgccccgcagcggtgaggaagaagtrggcgtctccacctccccttccaaagcgccgtttccctcctttttgccttttccttttgaccctcttgtgtctcacgagggggtagcccagctcttggctcttgcttgaaacaagtcwttcttgatcaccctccayctttccacctggcyggcagggggcggcctggggggagagggtccttgctccactcttcgcccagctgaggaccccgggagggggcggctggtcccgggaggtgtcagggcagctgcgcccttggctggggtcacgtccaccttcctgggaaggacatactctccccgtgccaggtgcttccggaacggcatcccagccctgggtttgcggcacgacgcccggaccttgagtccccggttcccgccgggaacctgggggcggagccagctggactgatgagatccttacccagcgcttctcagcgtctgccctcccactgtcctccatgcctagaaagaaacagtctgagaaggagggactggtgatcaggttgccacttgccttgattcggtgttccatttactcattaccgtctcctttctgcccacagtgttcacaccctttccagaaattcttggctggtaascgcgaaaccgactggagcaggagctgggagaactggagaaaactgctctaatctcacttgactccagctaggagctgatgctgcatcgtaataacatttgcagagcgctttcacaggtattagcccctttaacgcttcatttagccccgtgagatctggatattatcactccgttttgtaaacgaggaaacagagtraggcttagttcttgggttctgtgccaggggccttgggttttggattcaaaccccaaacctgttgtgctgcccctctggacctattgcttgagatgagttcccagttgaaagagctttgttctctggagccctctgcatggctgtcccttggatggggtacagtcagtgtccagggtcaggatcttttagggctgtagcaccacaccttaagtggtccagcacggtcctgatacctgtttccgcctcaattgtcctttttccagcttctatggaagtccctatccctgggttctttaaagacttgatgtattcagagcctcaagaaagtctccaccagggttaatccattgcaggcacgcttcaccctcagcctcatctctccttgctaggggtggtgccaaggcctagaaaattccaagtctgagggtcacttaaccattcttcaaagattggcttaggcccagcctcacaacaccccacctcccagatggattcatctccctgaaatcctcaccttcttgaagttgacactggaccgttcacctgattagcgctcccaaatggatcatcaacccttagtcgtagtgctaacagtgtttatcctctgagtgaatactcagattcgtactttgtgtggtgctgtcaaaccatgacctcattgaccttcacaaccactccttatgaggcagatttaactgtccccattttcaaggtaagaaattgaggtaggtgatgtgcctgacccaggatcacacacccagtgagtgattgaactgtgatataaactaccacaccacacctttcctggagcagcgagagatgactccagcctctcctcctcaccaacgactgaaataggatatttctgtctaatgtagaggatagggcacaaggcttctctgtctccccagtgtcttactcctcctccatggcacactgacccagagggtttgcagccccaccccaacscaaaccctaaccctgtaataaaactggcccagggagcctctgaggctctcataaaagtttccctgtctcctaattggcaagggaaaggacaggcccactctccgcccaggcctgccttgcatctcattttggttgcttctgctaggtgggaaggagtgagtgagtcactccagaaaagccctcacctgtgtgtggtccttgtcttctctctcatgccacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtaaaacctcaaccttagataacccaggccctcaagcacctgcagcatctgttgctagccctaacctggaaggaagggaaagcccccttaaaggtctcttttctctcctcaaattgtctctccagtgccttttactcatcatcaagaaactcttcctgatacctaatttgaatctgtcttgtggtttttagctcctttctttgggataggtaaggtgggatgggtaagggaatccttagggcactttggggattctgcagaggaagtcctgagagatgtccctgccacctgaattgttgaggcatagtagaagcctggggcttccaagaggatgtgttccttgaagctaagccttaaagaactagaaagaattagccacttggagaaggaaaataagcactccaggcaaagaggtcagcctgtgcagaaatgtaggagactatgaggaaatatagaaggattctaatgagtggatcatgggttacatgatccccatgtctctgcctctctgaaaaggctactgttgccccaggcctgtaggattccaaatcaccttttacagcggagctctctctcatacccatatcatccttcatgtgtaactcttggtcctgagagagtgccagtacttatttgctgactttttattttaccaagtgttgccaggcactgggctgaggcagatgttgaggttggtgcttgccctcaaggagctcagagtctagtggagtcttgggtaggtaagtgcctgacatcagcaaggtagcagccaggtgtggggcctgccagcrtcaagggagccatagtagacactgcagcttgaccttccagccatatggctcctggaacaggtttgaaggtaagaagtgggcaaaacagttgactgctctgggcttttttcttgcttatttttaaactttttttttctcttattaaaaaaaaggtatatcaatacaatggaataaagcaagttacacaaaaatataatacttttcaatgtttttaaagtatgtaggggaaaaaacctatgatattctctaaaatattggttatttctgggtagtatgattatggatttttatgctccttttgcttatctctattttccaatttttttttttttttttttttgagatggagtctcaccctgtcatccaggctggagtgtagtggcttgatcttggctcactgcaatctctgcctcccaggttcatgctattctcctgcctcagcctcccgagtagttgggactactggtgctggccaccacgcctggctaattttttgtattttttagtagagatggggtttcaccgtgttagccaggatggtctcgatctcctgacctcgtgatccacccacctcggcctcccaaagtgctgggactacaggcgtgagccaccgcgcccagcctccaaattttttttaataatttttgtttatttatttttattttagagatggagtctcactctgtagacaaggctggtctcaaactcctgacctcaagtgatccgtctgcctcagcctcccaaagtgcttttacaggggtgagccaccgcacccagccgtgagaccctgtctcttaaataaataaataaataaggccaggcacggtggctcatgcctgtaatcccaatactttgggaggtcgaggcgggcagatcacctgaggccaggagttcaagaccagtctggccaacatggcaaaaccccatttctactaaaaatacaaaaactagccaggtatggtggtgcatgcctgtgatcccagttacttgggtggctgaggcatgagaatcacttgaacctgggagacagtggttgcagtgagccgagattgtgccactgcactccagcctgggcgatagagcgagactctgtgtcaaaaaaaaaaaaaaatacaaaagccacttttacgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaagccacttttagaagaagaatagctaaccccttttggcagattccagatggcctttctaaatccttcgtgtgtttttgtgcttgtgagtatctgtgaggtaggtaccattatcccattttacagaaaagaactttaaataattatttagagacagggtctcactttgttgcccagtgcagtgatatccccatagctcactgtagcctcgacctcctgggctgaagcaaccctcctgcctcagcctctagaatagctggggttacaggcacatgccataatgcccagctaatttttaaatattttttatagagacagggtcaccttggcctccctaagtgctgggattacaggcttaagccactatggccagctggaaatttttctatttttattttttactttagagacaaggtcttgctctgttggccaggctagagtgcagcggtacaatcataactcattgcagcctcgaacttttaggcccaagtggttcttctacctaagcctcccaagtagctgggattacagggaccagatgaggagaattgaggcagaaagagattaagaaattaacataagagtatataactgtaagagatagagtcaggattcagagccagacaactaactttcaagtccaggtacttgatcactatactcagatgcctctctggttggatcagaactcttcataaattgtgtctgtgtttgtgaatggtttgtgtagtggtggtttttttttccccttcataaaaggagagggatatgcatagatatagctgtgctctgacctccgcagttactctggaggccaagagcctaccttgtgcattatagtgggcccaaagttcagagaacaggcaacagttttggaagaaatgcattactgggcctcttggaggaaatttgccaccatggcttatttctatgagagatttgaaattttaggctcaccattctcattggaaattcacctgttgtatcacagacctcttccttcaaaagcacatttcagcaagatacctgtcttcaacccccactctgtctttcctgcatccccaaaggagacagtaggagaaatgggaccacaggaggaagtggagggatgatacatcaagaatgggcaaaggaagatagggtgactcatgcctctagtcccaattactcaggaagctgaggcagaaggatcacttgagctcaggagttggaggctgcagtgagatatgatcatgccactgcactgcagcctgggtagcagagcaagactccatctcttaaaaaagaaaggaaaaaaaaaagataggcaagggaggagaaaggacctgttcccttggtgcttattcttgacctcagacagccgtctgagccaggctttctctcaagcagactcgggccaagggaaccaattcattagccagcctaaatttaagccacaaaaggcaggtgatgaagacatggggctacctctctcagaaggtacagctgttttacatcaaaagctgaactgtctcttcccaaaaaggcctaacccatggttcttttcctttgcaacattcctatagccttatttctaataaggctagtagcctggaagtgctacttgcaagtggccggagctcttggcagaagagatagcatttgttgagtacatgctgtatgccgggcactgactaaatgctttgtatatctcttcttttcttcccaataaccttgtcagttgagtttattttcctttatttacgaataaacaaactgtgactcaaagagggtaacttacccaggctcacagggctactaagaggcagaactgaaatttgaacccaaccagactatgataccagagtctccttctactatacaggttcccacccttctgtagctgccagctgttttgagtaccagctgtcgcggccttcatgttttttggttttttttttttttgagacagagtcttgctctgtcgcccaggctggagtgcagtagcacaatgttggctcactgcaagctccgcctcccgggttcacgccattctcctgcctcagccttccgagtagctgggactacaggtgcccgccaccatgcctggctaattttttgaattttttttagtagagacggggtttcaccgtgttarccaggatggtctcgatctcctcactttgtgtcctgcccgccttggcctcccagagtgctgggattataggcatgagccactgtgcctggcctcaccttcacgttatctcttccaggtcartggccacaatccrgggtctgatggccaagccagggagtacctcagagaagacctgcaggagttcctgggtggggaggtcctgctgtacaaactggatgacctcaccagggtgaatcctgtgacactagagacaggtatgggcctcccattcctcaggagtatcatctccaggaggttggaggtgtaatgagagtagtcagcacagcttctccaggtcagacggaggtcggcaggactcctgatctggagccaggtgggctgctccagacctccgcctgagggagcatgacagctgcacctgggctccccagggcatgctttgcttcagatttggagctcatcttaattagatcttgtatcttttcttcagggagctgctgggatttaatgattcttggctaattgcagaargagggctgttacttaagtagatgtgtgtctgtgtgtgtggtttgactatatttgagcccgagtttgctaaaggcatctctgcctcagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccaggtaaggctctgccgctgcctgtggcctcagggctcctctacctcccgctaaacctctttgcagttacccctgtccttattcatctattcaccagcaatgtggtcattcagagtctgctagtgccacggcctgcccaataggagctggcagaattttgaaccatgaagaactgactacaggacagaaggtgcaaagtggggaataaataaatatttgtttaactgagtttggaacctaaaataagagacataagagaaaggatttttttttcttgtttgcggttttattaacaggaaaggatttataaaggtattatatatttgtttatttaacaaactacctttttattttttattattatttatttatttatttatttatttwgagatggagtttcagtcttattgcccagactggagtgcaatggcatgatctgggctcagcgcaacctccacctcctgagttcaagcaattctcctgcttcagcctcctgagtagctgggattacaggcatatgccaccacacctggctaattttgtatttttagtaggcatattggtcaggctggtctcaaactcctgacatcaggtgatctacccaccttggcctcccaaagcgctggaattacaggtgtgagccactgtacccggccctatttattttgagactgagtctctccctgtcacccaggctggagcgcagtagtgcgatcttgactcaccgcaacctccgcctccagggttcaagtgattcttgtgcctcagcctcccgagtagctgggactacaggtgcccaccaccatgcccggctaatttttgtatttttagtagagatggggtttcaccatgttggccaggctggtctcgaactcctgacctcaagtgatccacctgccgtagcctcccaaagtgctgagattataggcatgagccactgagtccagcaaaactacctttttaggaaagaatgaaattatacacgataaggattgccctggaaaattcagcatatgtttatctctgctgaggaaagtaacttattcttttactgagaaaaggataagttatttggggtggggtggtggaggtacagacagataatgagcttgttggtgtaaaagtgcatgatgcattcagggagaggtgagagaaaacttgctggcaggagggaggtcttgggggcaagagggagtagrtgagagcaggaagacgagaaagccagggttgtttgtgaagagtctgaagcaccatagcaggcagagagaatctgcagagcatcttcatccaggtagaggtgggactgggaacagaacccactagacgaataattactgtgggagttgggttcaagaaggtgaggcaggaggcagagacaacagttggaggctttgtatccctccaggtgataggtggctggggcaagggcaggtgtagagaggagtggctctgacgccatatggaacagttgccttctccctcagcaagctgtgggtaagtgatcactgctggctgggttagctaggcattgtggagatggcgtggccctccagaagttcatgcgtgatgaggtatccagttggaatccaggggcagtctgtcctgagagccctgtctgctgtctgccctgcctccggaaaagtaaaagccaagtcgtagtcccctatgtttcctcagcatccagcttgattgatgcctagtacattgaagacagttaatagttgttgaagaaaaggggaacagtggctttggaatttaaatcacatggatatacttacttgctgagtggccttgcaaggttatttaactcctctgaacctcacattccttatctataaaatagggttatatttccaattagtggacaggcttcttagtagtttatacgaactttgcaaattgcaaattatagtaatatgaagtaataggcagaaggataagacaattaaagcaagataagatgggggtataaagtgttaatgtcataaactggtcaaggctagccctgcttctaggctgagagaaaatgaataggtaaagccaacataggggttctaaagttgggcctaacaatgtgacatccagaaaatttttctggaggaagcatcccaccactgctattggcagcctccccatctcagtcatcattggctcagtcatcattgaaaaacaggcattccctcacatgacctttcactccttgatgttccagaaactgaagccccatgtgttcactgtgggtgaacagacctacaggaatgtcaagagcctgattgaaccagtcaaccagtctattgttgtcagtggagagagtggtgctggaaaggtaggaagacgtctttcccatcctgtcaactcacgactggctgggtggacagggaggcaggggtcattccttggccttccttgtggagttgtttgcttcctaatcattcccacataggctggctgaagctggggttggtgcacaatggtgggctagcactgagccggaagtcaagagacaggataccagtccaggctctactgcaagctctgccatcaccctgggtgaaataggaatgaagtttcctttctaagccttattttctcatcgaaagtgtctcccagctcttgacactactggaaacaaaagtcagctgctggggattccagcatagtggttaagaacacatcagaaaagtacgtagcttctgcaaagctctcagttcttccacttgtaaaatggaagggaagggaggaccaacacctgactcataggacttctgtgagagttaaatgagtcactgtacatatggcacctggtggcatgcttggcatgtggcagtgctcctccaaagtagctggggttcttgtgggaaaaagtttattggagtaaaccacctgaaccctctgggttgcgcatggtggcaagggcagtatattgggccaggtgttggggaggacagaagctcctggtatggccacgtggccttctgggtagcaaaaccacaacaggtgagacaggatgttgcatacagatgagtggggagttgcacagctagtcaaaggagactattggccaaggccttgccaccttcttgacaagcctcacccagctgcctcgccctttccacaacacttttaccttcatgaggaactctttggaccataaactccttctgccttcactcacatatgagaattgctgaacactgagaacttgccaggttctaggcttctggctgggcactgaggggtggcagggggatgaaaaatgcaacatgtagctttcagggggcacttagtctgctgagagacagataagaaaacaaagacagtaagttgcagggatgagggcttggacttgggttaggaggggatctctaggagctatatcaaggtggctagtgaagtggcttatgcccagcttctcaacgaagccttgtcccccagaattgctctggggaactgaagctgaacctggtccaagactcattcaaccagagagctaggtaaccctttattgagcagccactgtagccctgggctgggcctggtatattttcaaaaatttatttttaataaatagtaatgtagttacatagttcaaaaaatcaagcaatactacaaggcttataaagaaaaacagcaaacctgctccttgtctttcaaccttgttccctgtctccagatgcagttacttgcacatcttttatcagtttatttgggtgtttacatccgtatttttaaactactgcttatgttgttactgactttttggttttggaccttatctgttcacttcctactttgatgaggatttaacccttatttccctgccctcaaaatacatattctgtatataattatttcataatttctaattaagttaataagcagtatttacatggttatggtcatgtgtatatgcatagcagagccatataatatactatatattcttgcataatttttattttccctctgttttccctgtttaatagtggtgtacaaaaactaaaccagtgaaaaagtggggcaagtaaaataaataataaataaataattgccccattttttcacttgtttagtttttatataccattattaactcattaccagacttgtcaccaaatctggaaaacacctgtcaaactggcaagcaaatcagcttctttcattggagatacccttcctagagctctcagaccatatcttttcttctgtctggattggtgcctgctgagggctgctgccacacagctgttgcatggaagcttctttgcttctgcacatccccagattcccatctgtcctaggataaatcccccatggcaggaacccatagcgttctctttattttgtttttgttttttttttttttttttgagacagggtttctgttgcccaggctggagtgcagtggcacaatctcagcccactgcagcctccgcctccccagttccaataattctcatgcctcagcctcccgagtagctgggattacagatgcataccaccacactcagcaaagttttttttttttgttttttgtttttttttttgagacggagtcttgctctgttgcccaggctggagtgcagtggcacaatcttggctcactgcaacttctgcctcccgggttcacaccattctcctgcctcagcctcccgagtagctgggactacaggcgcccgccactacgcctggctaattttttgtatttttagtagagacgggtttcactgtgttagccaggatggtctcgatctcctgacctcgtgatccactcgcctcggcctcccagattgctgggattacaggcgtgagccatcacgcctgacctgctaagttttatatttttagtagagtggggtttcaccaagttggccaggctggtcttgaactcctggcctcaagtgatcttcccgcgttggcctcccaaagtgctgggtttacaggcatgagccaccacgcctagtctccatggctttctttttcttcatttactgccttgttttgtttttatgaaccatattctatttttttttttcttttttttgaccaagtctcgcactgtcgcctaggctggagtgcaggtggtgtgatctcggctcactgcaacctccgcctcctgggttcaagcagttctctgcctcagcctcctcccgagtagctgggattacaggcgcctgccaccaggcccggctaatttttgtatttttagtagagacggagtttcatcatcttggccaggctggtcttgaactcctgacttcgtgatccacctgcctcggcctcccaaagtgctgggattacaggcgtgagccaccacgcccggccaaaccatattctttagtggtttcctgaacaaggtacctggagggcaaattgttgcacatctgaaaatgtctattctgcctcaaatctgatggatattttggctgggttttataattccaggttagaaataattttctttctgaatatagagactttattttcttttttctttttcttttctttttttttttttttttttaaagacagtcttgctctgttgccaggctggagtgcagtggcacaatcttggctcactgcaacctccgcctcccgggttcaagcaattctcctgcctcagcttcccaagtagctggaactaccagcatgcaccaccacacccagctaatttttgtatttttagtagagatggggtttcaccatgttggccaagatgatctcgatctcttgacctcgtgatccaccctccccggcctcccaaagtgctgggattacaggtatgagccactgtgcctggccgaggttttattttcatatattgctgttgagagagccagtccataatggtgatttcttttttcccccaaaggttttaggtattaaaattcacagtgctgtgttgtggtatagcctttcttcacttattatgctgggtactttgtgtgggtctttttaacttggaaactcatgtccttttgttcaggaaagtatttttgtgttatatctaataatttcctcccctgttttctccttctggaacttctgtgaggaaatttggttagttgtgtaatcatgtttttctcacctatcctcctttctctttatttttttaatcttctgagagatattcttttctttaccttccaattctttggaacttcgaatatttgttaaaaattttaattctacattctagtttttttctaacatttatgatatttgtcatttcacgtaaaagaggcttatgaaataatgatcctagagtgtctgttcatatttaaaataaggcattaaacaactgattagaatctgtgtttacgtacaagattgtcaaccaatggggcctcactgtaagtagctttttaaacttgtgggatccctgaatggccataacttttcccgtgagcttattggtgtctccagaaaagattcctccagtctttcagcagataggtggaaactataaagaatcaaatggagatgataaaaatttaaaacatgataaatctttgggcatatcaacagactagacatgcaaaagaatgcattagtgaacttaactgttggtgaatagaaattatccaaattgaaaaacaaagaaaattgcatccaagaactgtagtacaatatcaaatggtctgccattgaacaatgcagaggttaggggcaccaactccccacgcaattgaaaatctgcatataatttaactgctgattaactactgttgactggaaacctgacaaataacataacagtcagtacgtattttgtgtgttatatgtcttatatactgtattcttccaataaaataagctagagaaatgaaattaagaaagtcagaaggaagaaatatatttactacttaagtgaaagtggatcctcataaaggtcttcatcactgtcatcttcactttgagtaggctgaggaagaagaggacagtcttgcttggtcttgctgtctcagaggtggcagaggtagtggaagtataatagaaggggaggcaggagagatttattgaaaaaaaacccacgtataagtggacccatgcaattcaaacacgtgttttcaagggtcaactgtacttgtaattggtgtcctaggagtagagagaggacatgggtcaaaagtaatatttttacaaaattaaccaaagatggcaagcacagatccaaaaagctcaaaaawtgccaagtagaatgaatacaaagaaaacacatttaggcacattatggtcaaagtgctgaaaactaaatataagaaaaaaatcttaaggaccaggtgcagtagttcacgcctgtaatcccagcactttgggaggctgaggcaggcagatcatttgaggtcaggagtttgagaccagtctgggtaacatggtgaaatcccgtctctattaaaaatacaaaaaattagcagggcatggtggtaggtgcctgaaatcccagctacttgggagctgaggtgggagaattgcttgaacccaggaggaggaagttgtagtgagccaagatcatgacagagtgaaactctgtctcaaaaaaaaggaaaaaaagtatcttaaaggaagccaggaaaataaatattacataaaaatgaacaaagataagaatgaccataggaatcttgacaaaaactgtaagcccacagataaaagtgacacctttaaggtgctgaaagaaaaaaatctgtcaacttagaattctgttatcagcaaaaatatttttcaacaatgaaagtgaaataaagactttaagacaaatagaagttgagggaattcattgcctgcagacttgcactgcaagaagtgataaattctttagtgcaaaagaatatgaaaaccagataaatatttggatctacacaaaggggtaagtttcagcatcacagatgtaaaatcttttttttttttttgtctctttagaagataatcactataaggcacaaatggtaacaatgcttatatgatagaatggaatcattaaaatgccaaatttaatcaaaggcaataagaaaaaagggaactaagatcacatgggacaatttaaaaaaataagatggtagatttaaacccaggcatagtgacaattacgataaatataagtggtctactcgtggataagttcaaactaaatggatgggaaaaaatataacatcctaacattcataaaggaaagctgaagtggttacattagaacaagcaatgttgctaaggataagatgagacatttcataatgataaatgggtgaattcatcaagaaaacagttctaaacaggtgtgtacctaattacagtttcaaaatacatgaagtaaaatctgctctcattgaaaggaaaaatatataaaatcaaaactacattttgaggccaggcacaatggttcacacctgtaatcccagcactttgggaggccaaggctgatggattgcttaagttcaagaccagcctgggaaatgtggggaaaacccatatctacaaaaaaatacaaaaattagccaagcgtggtggcttgtgcctgtagtcccagtttactcacacagagcaagcaagactctgtctaaaaacaaaaaacaaaaagattaaaatgatacaaactatgttccttgagctgaatagaattgaattagaaataaacaacaaagacacctagaaaatcctaaaacattgggaaattaaacaatgcacttctaaatatcctatgggtaaaagataaaatcacaatgatactataaagaaaaaaaatctatctatctgtctatctatctatctcactatgcctgggtttaaatctaccatcttattttttaaattgttccgtgtgatcttagttcctttttttattgcctttgattaaattcagcattttaatgatgctatgctgtcatataaacattgttaccatttttgccttagtgattatcttctaaggagacatatatatacatacttttatatatatatacatacttttatgtatatacatatatatacacatacatatatatatatatatatatatttttttttttttttttttttttttttccctctgagatcctctggcccaggctggagtacagtggtgtgatctcagctcactgcaacctccacctcctgggttcaagtgattcatttgcctcagccttctgagtagctgggattacaggtgcatgccaccacacctggctaatttttgtatttttagtagagactatgtatttttagtagagacgttatagtttcactatggtggccaggctggtatcaaactcctggcctcaagtgatcagctcgcctcagcttcccaaattgctgggattccaggcgtgagccactgtgtccagccttgtctgaaatttcattaccaagtcggtattagaaaatattttgaactaataaattaaaatgaaagcacaacatcttcattacctctttttttttttttttgagatagtttcgctattgttgcccaggctggagtgcaacggtgcgagctcagctcactgcaacctgcgcctcccgggttcaagcgattctcctgcctcagtctccctagtagctggaattacaggtggatgccatgacacccagataagttttgtatttttagtagagacagggtttcaccatgttggtcaaggctggttttgaactgctgaactcaggcaatccacccacctcagcctcccaaagtgctgggattacaggcgtgacgaccgcacctggcgtcattaccttatttaatcttaattacctcccgaagatcccttctccaaatgcagtcacattgggagtgagggcttcaaaatatgaatttgaggggaacacaattcagtctgtggcataccttaagaagctagaggggaacagaataaacccaaagtatgcagaagaagggaaaaagtaaagatgaataaaatagaaaaattaatgaaataaaagacttttctctgaaaagatgaataaaatgataactcactgggtgcagtggctcacgcctgtaatccagcactttgggaggccaaggtgggtggatcacctgaggtcagaagttagagaccagcctgaccaacatggtgaaagcccgtctctactaaaaatacaaaaattagctgggcatggtggcgagcgcctgtagtcccagctcctcaggaggctgaggcaggagaatcacttgaaccccggaggcagaggttgcagtgagccgagatcgtgccactgcactccatcctgggtgacagcaagactttgcctctaaagaagacaaacaaacaaaaaaatgataactctccagtcagacttataaaaagagaaaaaagatgtaaatcaccagtatcaggaatgaargagtagacatcaatatagatcttacagattaagataatattttgaataactttatgccaagaaattatacaatttagatgaaatggagaaatattttgagaaacgcaaactgctgaagatcacacaagaagaaaaagaacctgaatagcccctatttctgaaagaaattgaagtcatagttaaaagccctcccacagagaaagctgtaggccctggtggcttcacttgtgaattctaccaaacatttaaggaagaaatgttaccagttctacataaagtctttcagaagatagaaatatctctgatcccaaagaaaaatctaaagaatctacaaagtaagttgccaccttactgcaactaaaaagttgtagagcgtttagtgaggtgataggatacaaggtcaatatgtaaagacagtgtatttctatgtcctagccacaaacaattagaagttaaaatgaaagtatacctcacttcagctgattaagaacaagagtatgaattaaaattagactgcttggggccaggtgcggtggctcacacctgtaatcccactttgggaggccaaggtgggcagattacgaggtcaggagctcaagaccagactcaccaacatggtgaaaccccgtctttactaaagatgtaaaaaattagccaggcgtggtggcgtgcgcctgtaatcctagctacttgggaggctgaggcaggagaatcgcttgaactcaggaggcagaggttgcagagagttgagattgtgccattgcactccagcctgggaggcaagatgagactccgtctcggaaaaaaaaagttagactgcttgggtataaatgggagccctgtcattgagtagatgcatgatttttaataaatttttaaatttctatgctttggttttattgtttataaacaattgtataatcacacctttgcagagtttgcaaaaaaaacatacacagaaagcctcgatagctcagtgtctgccacagagctgagagaaacagatgtctactcccattttacaaacagaggtagaggaagtgccttgcctgaggccagggttgaattctgccttcacccattttgtcagcaacacactggtggagaagagagctctggtgggcactgttctctcaggcaggctcagaagtgggcgggagcatagatacagctcccacagggctgtttctgccacagacatggacgtctcgytgcctratgaagttctatgctgtggtggccacctcacctgcatcttgggagagccacaagattgcagagaggatagaacagaggatcctgaactccarccctgtcatggaagcttttggtgagcttgggctcctttgcacagtatctcagtcccatttcctctgggattttccaccttccagggagagggacagtgctttgagaccctctcttgggtgggggtggaggatgagtgtatccttcactgcctcagatccccaacctctccctggtactccttagcatcattctaacagaggtcatgtcattcagtcctcttcctcgctccagcctaggcacacataacagtcgtgctggagaagacctggtggcttagctcgtccaaattctgtctttctatccagtttcctgatggttcaatgaagggtacttgttaagggatacaaggtgattagtgtttgtgttggcactggaacccagatgtgccttcctgtctaaagtcagtagtgacagctgattgtttttgacctttcccttcaaagaaaggtccctgactgcctaggcttgctcattccaatttcttgccaggaatttcttctaactcccctgaatcccacttgctaaagcatgagggcccattttctagtcctgtcccctatgacatgaaaaccaacaaaggggcctttaggtgacttgagcacgggaacatgacctccagagacctgcagccaccttggcttatgaggactctgcaaacccaggggagtgaaataaacataggtgtgatctgtagggaatgcgtgtacactgaggaataacaacagcagtcgctttgggaagttcatccagctccagctgaacaggtaatagctgctgttgccctggctagtgggaggatgggactggggaggttgaaagtggctggggcagtatctggcctgggccacccctatgggcaaaaaccctgctcctcctggtgcatgccctttacctcaggtgtgagctctgagggtgatctttgcacctggagaactatagctcctctccccttggggaaccctggggcagtgcgcttattcaggcctgggttcctcctggcttttactcttgctcagggacttcaagctaaattgccacctctttggaccatatccctgagcttgaggctgagacttcgactcctgtcttggggtagagcaaagtgatgtgcagaggccttggccctgcccacctgagctagatgcaggggaatattccaggacacccaaggacattctgagtggtccccacccctcagtgcccattggctaagtggaagagcttggcggggagttgccaggtagcaggcaatctggcacacccagattgccagacatggctatggaatgaatgggcaactaacgggctctggcctgtgtgtgtcccagggctcagcaaatgactggagccgcagtccagacctacctcctagagaaaactcgagtggcctgccaggcttccagtgagaggaacttccacatcttctatcaggtttgtgccaaatggggccacagccccccagatgcgagacagggatgggtccgtgtttttcaaccccccactccccagaatgctccatacctggttccttcacctagcttttgatggagccaccactttatcctgcagactttacatgcaacacttctgcctcacactgcgccttggctcccagcacagttgtggcctgggagtatgttttacctcctccatcagaccagaaggtccttgaggctgggactgtatctctagggtggaagccgtgtcactcttatcattttaagggcyctcctagaatggcatctgtcgctaacagaacaagggcttccctagagttgtgccttttccatcggactgggagtcccccaaggcatggataggatatctccctttctctcaaaatcggagcatccttaggtgatgggtatgcctcccacgtcaagacgacggactccctgggcaggagttgtccttttttcaccagactgcaggtttccctagagcaaggttcttttgcatcaggttggagacatccagggctatgtttacggcatcttttgcccccatacctgccgtgggctctcggaagggacctctgagccttgtgatgttgctaccaactctcctcttatcccaaccccatgcctgcctatgcaggcctgggcttttctcagaccccctacccagcctcccacctacccttctccacagatttgcaaaggagccagtgaggacgagaggctccagtggcaccttcctgagggagctgccttctcctggctgcccaacccagagaggagcttagaaggtaaggggagccccatccagcaccttgcgctgacccagcatcacccacccactctgtacagagcctgcctccctcgcatcttgctgctgctgacctctgccccgaacttggattctttttcagaggattgttttgaggtgaccagagaggccatgctccatttgggcattgacacccctacccagaacaacatctttaaggtcagaagaaaagccacgccacttaagtttggcagagatgacgggcagccctttgcatagagcttttccctggacttggagttggtctttccctgaggatctaggactttgggcccntctgtgctacctccaaggaatcagtcacctctgttctgctgagtctggagaccaggtggtggggtggacggggcataaggaagagtgatgcatacacagtgctagagtacagaatgcagtaagtgatccatgggggcagagagcaaggtaccgcatgatcagaagagagaactagtgctaccgccttgcttgtctagtacattaaaacttacaagtcatgttcacacttctctgctcacttagttttttaaacagtcctctgtgtgtgtttatttccctttatgcctgagaaaaccagagaggtaaagtgacgtgcccaaggtcagataccactaagtggtgatacagagtaccagacatagtaattccaagttcctaccctctctgtcttcccccaacccgtgccccgtcgtcctctggaacatgagactgccccaggtgagctgggctcctctcagtcacactaggggggcctcccttctgtctttgctgacagagctgactacctcctctcatcttcctcaccctctagagcagcaggaggggatagataggatggcctggcagtcgagaaagggaggccacttcagggaggtagcaatgcagtggaaagtgaccctcacctccagatgggggctgctcagacactgccaggtaagaacttgacagaaggacagtacctggggacaagcccaggataagtggacaacactgggagtcggggcaggagtgctttgggggtgggcatgaccctctgccacagcccttctgcctggtgggcatggcagtcttctggagcaagttgtggccggaagaccagtagcacatggaggcaccctgcctgggaccatataggaatggtgggtggggtccctgtgtcaggtctgagggtggtggttttttcttttttttttttttttttgagatggagttttactctagttgcccagtctagagtgcagtggcacaatctcagctcactgcaacctcctcttcccgggttcaagtgattctcctacctcagcctccgagtagctgggattacaggcatgtgccaccacacccagctaattttgtgtgtgtgtgtgtgtgtgtgtgtgtgtgtgtgtgtgtgtttatttttagtagagatggaggttcaccatattggtcaggctggtcttaaacttctgacttcaagtgatccacctgcctcagcctcccagagtgctggaattacaagcgtgtgccaccatgcctagctgggtctgagggttttgaagttgctgggccttggtggggtgaggggagcttctgtctatagccccagggggcttgtcggtgtggaacattgagtacaaaggcaaaggggcacccatcggacacagaccaaggtcacagtgcctccagcaggctgggctctcagaagcctgacagtgggaaagggctcaaggaagcagagacaagcctccagcaggcacacagaagcagccctgcccccagtcaccagtctattcctagagagcagggggcagaaatgtagaggatgggtgggcatggaggcccacaggctgccccaggagacatctgaagtcagcctgggttctcatcccacctttcccctcaggaagcacgtgtcctcagtctcatctctatcataggcagtggcgtagcacataccttacaggttgttgaaaagttgcaatgaggcgatgcatgtaacttgtatagaattgtgtctggcagagatgggcacttgggccatgattgggagctgcccttctgctgtcgtgattgtactcagcagaacggcccttcccagagtaggcccacgtcaygccctctcctactcccacccatccttttctttcccccaggtcctagctggactgctgcaccttggcaatatccagtttgctgcctccgaggatgaagcccagccctgccagccgatggatgatgccaagtgtgagggtcagggtgtaggatggggcaggccctgtcaggaaggtagccagcattgctggggttgggtggaaggctggatggtgaaaattggaatctgatgcccttgcttatgccacccaccatagggcctggccctggatcatttactcctcaccctgtctggtgaggcagacagtatcgtccccatcttaaagatgagaaaatgagtcagaggtttgtaaagtgatttgtcccatacatggcagcatggactggtacatgaaagtgctgggtttgagttctgactgcngtttatggagtcctttgggtgagtcacttcactgatcagaacttaggtttcttctgtccagttgggcaagtcatggtcccgctgtgatgacttcacagtgcctcgtgaagaggactggatggagagtgatttgcctaaagaggatttgcccctcccagactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctrgccaaactgatctatgcgcggtgagcagttactctggccccttgttggggaggaccccnacaagtgctcttcctgtccggggttgggccagacaacatcaggcaataggcacaggcccagggtgggagataagacagactggttcctctccctgctcctcaaacccctggacacatcagggcacagctcccaggtttcaccaagcagcgtctgtggcctctttctgagtgggaaagttgctacattcctggccagaattcagctcattattaaagttcaggaggctgctttagcctcagcaaggtgaagagaacctgctcagctgtctgctggcaaggcaggccccaaaggtgatctagagccttcgcagttcctgcttcagatccttggctgaatgggcctctctgtctccctgtgcctttgtacatcacctaggagtttgatagattgtggtaaagccagaggctcagcccacagcatgtagcacagtggtgaaggtggggtcctggccttttctggtagattacgtgggtacctccaccctctggccatgtggttaaggatgatctctcaccttgagttctgagattcttcagcaggccttgtaagggcttcaggggcccagaatcctctgagatgagccagaatgagtgtatgtgtgtgcatgtgcacatgagaccttgggcacctttctggggagagggtcccctgctttcataaactccacaaagagccaatagcctgagaagctctgctgggggaaccagatcgtccgagttgaaaatggtccagggcagctgaggccagactaaatccatttcagcaagagactagttaccactgcctcaagctaatttcaggtcacaatttgaggtcaaaggcttttaaagcctttgcctacaagtcactccaagatgagcagataaagtgtgatgaacacagatagagtgagcttctgaccacaggacatttgcacagcccctgttgcaaaaagagccagtttatttactgaagggaaaaaagttgcagagcaattactttaagaaaaaatgtgaggaagaaacccctgtatagtgctgtacgtgtcagcgtcttgtgtggtagtctcatcttctctgggctggggccggttctagagtggaggatgccattgttgacctcgggactgggggcccacttgtgcagaactacatcagggggtatggtggggccttgagctctgggctccaccggtagagttttgcaggggtgttcaatgaactcagttatttacaaaccacacccaggcccatctgccccttcccaagacactagctgggtctcgagccatgtgactgagctcgactgattccctccccagcctaggagctgagcttgtcctgtgctcagtcttcccataaggacatgccaggtttgtgtgtacctggcaacatgcatgcccatagcctgcatctgtagtaggtcaagacgtgayaggccggaagcaagaggagaggatttggtctttgacctgtcaggctcagaatacaagggccccccagggtgtagcaccctgatggggggagcaattttaccacccctttgactcagccagaccctcttaccagagtccactctcttcccccaacaggttgtttgactggctggtatcagtgatcaacagcagcatctgtgcagacaccgactcgtggaccactttcataggtagcaaggcctcactgtgctgggagcactccagaaaaagagcaataaagccctggatggagaggcaggagccctgggtccactgtgtgactctgggcagttcctttcccttttttgtctcctcttgcatctgcctgccagcatagagygagatctctgcatagggtgagatctctgctctcctgcacccacatctgagcagtccataactctccagacaggctcaacagtgccttgtctgaaagagccctttacctccccagagacccagctctaattgtgggagagtagtgggggttggggaaaatagctgtattagaagggactttggaggctggcaccgtggctcacacctgtaatcccaacattttgggaggccaaagtgggaggatcactggaggccaggagttggagaccagcctgggcaatatagcaagaccccatttcaaagaaattagccaggcatggtgctacatgcctgtagtcccagctactcaggagaccgaggtgggaggatcactttagcccaagagtttgaagcttctgtgagctgtgatcacaccactgcactccagcctggtcaacagagcaagaccctatctcaggggggagaacaaaaaaagacttgggggacatgactgagggaggtcaacacggttgtaactaggtgggacagtcagttataggaggaaataaagcttaaaggtacaagtgcagtttgctcatggaatggtggaattctaggcaccaaattggctagtgagactaatgccctccgaactagatttaacacagaaaatgttccctgggacctggtttcctcataggaggtgcctatcagaaccagagaattcagactcaaaaatgggcctgatgctctgggctgtcttcacacttcatttgggtttcctgcttgctctgagctctacaggggaatggggtagagatgggagccaccttgggtggagggtggggaaggtatgttctgcccaccacaggtgtcatgctcactcagcctgatgcccaggctgccaagtataaggcattggcaggggcccagccaccctgggttccttggtcccctattccccatctgctccctgcagtggccccatgggttctctgccatcttcccaggcctgctggatgtgtatggatttgaatcatttcctgacaacagtctggaacagttgtgcatcaactacgccaatgagaagctgcagcagcattttgtggctcactacctaagggcccagcaggtgagggatggggtgagcaggaggcaggtccttcttttggatcctcaatcccttcctgaccttccagccccagtccaggttctgattagaagccttttgttccttcttattttatttttaattgacaaataataattgcacatatggagtacaatgtaatgttttgatatacttttgtttctttgatgctgttctggaatacgctgtggtaccgaggccagccgtggatggcccgtcaggacatcagaccacagctgccttctcccacctcatcccaccttgttctttaggaggaatacgcagttgagggcctggagtggtcattcatcaactaccaggacaaccagccctgtttggatctcattgagggaagccccatcagcatctgctccctcataaatgaggtggggaggtcagctaatgagccgagcaccagagttggcctttgggttttctggggccttgatgattatcctgtttcctctctgtgcctstctcctcccagtctgccaaatagatctgctaattgctntattttttctgttggggacactatgatgcctgtgtgatgtctgctgtcatggggtccacagggtggggacagtgagggttgtggtgagacactctcatgttggtggctgaccccctgttcccatcccacaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggtacgggctgggccatgccctgtggggcctgcgagaaacgagatgctgggtctttgctatgcagacatagtagtttcccatcgtgagtcctttctctcctgaacctcctcccagaatccagaatcaccatcttgggcccacctgtctgaggtctccactaatcaagcatgacctgcctggagataacccatgttagactgggtctccaggtctctggttgtccaatggaccttctcttggactcaggccctgtcctacctggaagccccgtcatctgcggcttgggtgggcagtggatggccctgagcagaagctccacctgccctcactgctgctcttgccatttcccaataggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggtgggtctgatgtgctgatgggaggtgcttggttcaaactccacggtctcacaaatatttattgagcacctgccnggatcggtgctgtttgttggggagcagtggcaagtcaagtagatgtggtcccagtcccctggagtttatacttcagtgtggaagacagaaacagtagacaaataggctatcaggtataatatgatgggaagtctaggggcctatgggggcactatgcagcctctcaccccctgccactggggtgctcatgggaagaggatcagctacatgagcttctttgacctggctcatctccagctgtctagcttcctgttctaaccctaccctcactcacttctctcacatcgtctgctttctaccacctctcagtccttgcatgtaccgccccaccttcctgggatactcttgactactgccccatcagctccacctcactcccatcctccacgccccttttcctagtttagtccttctcatccttcagactttagctttatcaccaccacctcgaggaggcacctggaaaaccaggtttgattagcaccttcctacccagcctcaaacacacccccgagggtgttcatccaacatgtgtggcccattggagtgagctctgacatggcagcaggcagcctgtggcacagcctccaacacacaggatgagctgagtgataacagttgttgctggacgaatggcaagaagttttgagattgttcttttctaagaagattgctctggggagaagtggggaggggaaagaggaggagattggattcagggagaacagtcagggaggatcacaggtttagaagggtcccttaagacagaggtgaggagcatgggaagttgggagaggaatgtgctctgagcctgctcgttgagagcctgcagcagtcatccctgcacaggagattcttggtctcaggatcatggaagggcccgctggaggcatttgatgtagttactaaccagagcccagttgatggccctgggcagcccctctccctgcctaaccccatggtctctcatctgcaggcctcactggagcagcttctgcaggtcctacacagcaccacgccccactacattcgctgcatcaagcccaacagccagggccaggcgcagacctttctccaagaggaggtaattaacaccgggccaaagctgcttcgcaccaaaccccatctggccaaggccctggagagatgaagggcaggacatctgttccaaatggagtgcacagaagtggtctctccggccaggcctgacatgagagaggacccatctcccttgctgtggcagggcaggcatgtatggttgtgtggtctgtgcatagtagcctagccagggaggcaagttccagtgcatcttgtttttttgagccatgtaccctgatgagagactgaaactgcccagaggaatgggtgtctcgtgattagctgaaagtctacatcaccacacagtccccgcacagtgcagccatttctcactggaggtatcatttttttctttttttttttttttttgagactgagcctcactctgtcacccaggctggagtgcagtggtgcaatctcagctcactgcaacttccgcctcccgagttcaagtgattctcctgcctcagtctcccaaatagctggaattacaggtatgcaccaccacacctggctaatttttgtatttttagtagagatggagtttcaccatgttagccaggctggtctcaaactcctgacctcaggtgatctgcccacctcagcctcccaaagtgctgggattacaggcatgagcagccactgcactcagccggtatcatttttttctaatctaacaaaagcactctagccagcagctgcccttttcttgggattccaggttctgagggatgtggatgaggggtgaatgctgggcactgctgaaggtgtggcctggtagatgtggccttccggtttgtagccaggacaactcagctctgtggtaaagacctgggttcaggtcacagaagaatcttcatagtataatcttccctgcctctcagctgtgaaccaccctctaatgcctgcagacagtgaaaacaatccaaactggaaatttgcctgggctgggttgtgtggtagtgagactacactgagggcagggtgagacggagccaggacatcacttgcttcagctgtatcagaagccatgcgtcggatgagggggacttgggaccaccaggaccctttctagtgggagatttgttttcaaggtccctcgatttctcacagccccaaggagatacccccattagccaagccttgggagagcctgcagcttggcactggccagggtctaagaagaagggctgagagaatggcatttctggcctgctggccccatgctgcaggtgcctgccctgtctccccacccttgcaggtcctgagccagctggaggcctgtggcctcgtggagaccatccatatcagtgctgctggcttccccatccggtgagtgggctcgatcacggcacagtgcagggccagtacagagtggggctcaggactctcattgggcaagagcctgcccaacccagagtgagatgtggaaatgaagagaaagaggctggtctgtagaagtcaactgggaactagggagcagcacccattcgttcatccattcacttattgtgcactattttgtacccagctgatggctgtgacaaaagccacactggtacaatgttggggacagaagccagactcaggagggctgacaagcaattgggaggaagtgcagatatcaggtgccagcagctgtctgagaagtgttgccttgatgaggagcagggagatctgggggaggcagaggagactgtggggtcagagaggtcagaggggagatgtggccaagcatgtctgcgtcataggactggtccaattgtttggggagaggcctgtcagcccctttggagggaggcagcccgcaaatcccctgctaacacaagagatgctttgtgttggtagaccaaggcagcagggagagcagacccattttaaatagtctttatgggtttccaactaagtgatcctagaaatygcttcaaaaccacattcacattcagtggggatactcrgggagggcagcaccgtsctgtgttgttgagcagattaaatagaataacttctratgagccctgaaccgttaacctggctcacagatgaagtaattctctacttctgcctgctttggcytccagggtctctcacmgaaactttgtagaacgatacaagttactaagaaggcttcatcctygcacatcctctggccccgacagcccatatcctgccaaagggctccctggtgagtgggacccatgagttagtcatttgtgcaaccacagtttactgagcatctaccctgtgccctgtcttagggctaggggctggggcttactggtgaataaaacacagccctggttttggttcagtgggggaaacagattcaaaaaagacaaatagcatggaaagtggaaaagcagagctatgagcaggatgctgtgggtggtgctagggaggtgtgaattggggaaggcttcctggaagaggtagtatctgagaataaattggattagccaggtgatgggtggtccacatgrtaaatgtaatctgaacaaaggcctagaggcttgaggcagcagtgtgggtatgaggaactccagccagttctgtgttgctggttcattgaggcagagaactggggcaggtgaggctggagtggcaggtagggctccatcaaggaatctggactttattctctgggcagatgagcaggcactgcaggggaaggagcaaatgactcttatcagcctcacactttctggagaccactctgggggcaccatggagggctgtgggattgaggctgcaaagttgccccaatagagagaaacaagaattgtgggcacagtcgggaaatatttgttggaagaaactggtcagtcttggtaggggcttgactagatgtagagggagaggaaaggagtaaattaacttakcctgggaagtgaggaaaagcaagaggaaaagaggttcagggaggctgaagagcccgggcatgggtgacttgtcctgcaggtccagtgaagaagtctgcaaggcacttaggcaggctttagtctcaaaggaaggatctggaggccctcatatgggggttgtcggcatgcagataaaagagaggctgtgggagccacagggcccagacacaggcagagggagaacaggccaaggacaggctgccggggggccccgcctcggcaggaccccagcccagcacctctgcccctcccacccagccttaccctgggcccctcacagccattggggcaatcctgctttgtttcctcccctcctgggcagttttcactttcctttcaccctttctcctttcttctccctctccatggtttgctgtcctgttccgtgtctcttgcccatagcccttctggcccctggttgattttgctgctgtttctcatctgtggtgtctcctttggcagcctctgtcttcagagaggcactgggcatctaaggtggtcagagccctcaggtaaatcctacctctccaggagtcagctctgcgagctgcgggagggcaggcagtgggacacgggacctttgcagggctgggattttttaaatttattttttaatttattctttttatttgcagtagaagattcccaaactaagggctgggattggatctcccttttcccatacatggtggggagttgaggggtcggggctgagggagtggcctatagctgccctatttggccctcaggatgtgtgtttgggccttggaaacaaatgctggctgagcagcctgggattccaagcttggaaggagtcacccttccaggtgtcaagcaccctctgccagcctgcccaaagggactcatggcagtagaggctgtgggacaccccaggacacacaggcgcaagtgggtattccaaggctccacggaacagctagcaccctgagggacaacagagaggctgtttgtggcttcctccaaaagaagaacaaggagaaaatggctagagccaagaacagcaggaaagagacctgtrgagtgctagggaggccaaagccagtttcttcaggccacagaggcatgtagagatgaccatgcactgatggggccatctccctcccccagaatggtgtccacacagcgaggaagccacgcttgaacctctcatccaggacattctccacactctgccggtcctaactcaggcagcagccataactggtgactcggctgaggccatgccagcccccatgcactrtggcaggaccaaggtgttcatgactgactctatggtgagctggtttggggatgaggaggttacagaggcaagctgtgtgctctcctcagcaggagggggcagggggagaagaggctgccctcaatggatgccttttctcccagctggagcttctggaatgtgggcgtgcccgggtgctggagcagtgtgcccgctgcatccagggtggctggaggcgacaccggcaccgagagcaggagcggcagyggcgggccgtcatgctcatccaggcaggtaggtgggcaggtcacctgtcagcactgctcacagaccccacaggatgttggtttcctttgaaacatagctcgtcgagtccccatctcctgaagctgtgtcccagcctgaagagatgtccctgtggtgtgctgggattcaaattccctgtccccctcactcataacgtctctccagttcaatggaaaccaagtcactccacaaacaaaggtgctctgtaagaagtggaggctaagcgttgtctaagcgttgtctttaattcctttctcagaccctgacagctgtttaggccaactttttttccctttatgacaactcaaaccattacctgctgggctctagggctggaatgaatttaaggagaaggtaaaaaccaaaaggagttcatcagatgaaaagatgtattaaccaacatgttcatagtggtcttattttgaaaaggaaaagtgttggaaagaacccaaatatctaacagtggtgacatcatggccaaatgatggactggaccatccctatgatgcagctaagtgtttttgaagaatattataaatttaatggagaaccacttccaaaatgatattcatacctagatgtcaaactacatattaagggcgatgccctccttttaaggtgtgtttgtgtgtgtgtaggcattaaaaaattgtataaggaagctgggcacagtagttcgctcctgtaatcccagcattttgggaggctgaggtgggaggatcacttgagcccaggaatttcataccagccgggcaacatggcaaaaccctttctctactaaaaatacaaaaattagccaagtgtggtagtatgcacctataatcctagctactcaggaggctgaggcaggagaatcacctcaacccaggaggcagaggttgcagtgagctgagattgcaccattacactccagcctgggtgacagagcaagactctgtctcaaaaaaaaaaaaaacaacaaaacataattaaccgtgcctggtggcacatgcctgtagtcccagttactccagaggctgaggcaagaggattgcttgagcctgggagattgaagctacagccttacggaggctacaataagctgttcgtgccactgcactccagcctgggcaagaccctgtctcaaaaaaaaaaaaaaaaaaaaaaaaaaaaggaaccaaaaagaaaaagaatatgctgaaattgcagagaagggaataaaaattaccaccatctattaattgtatcagtgtttgggtatatggtgatgtgagatcagggatgcataaagcgaacaaattcaactgaggattaaaaacaaaacaaaaaaaaaagtttttaaaggcacagacaatccagacccctcccattccctgggtgctgacctggacccagcctgagacgggaagtgattgctgggccctcagccagtccttctccccagtgccccttcactgtgttgtgtaggtgtattcaagtgtgtgggcagtgtaaggaatgtttaaaagccaattttgccttatgtattgattttagaaccttatttgtagcaatttattgaaaaaaaaaaaacgtatttgaaactttgacagcaactgtggtgctgctgcagcsaggtcactgacagctctaatggcccctttattatctctttcctgtttctgggcaaacctcttagccattcgttcctggttaactcggaaacacatccagaggctgcatgcagctgccacagtcatcaagcgtgcatggcagaagtggagagtaagtaagacccaagaagtcggggtgggcagtggatcaattttggggaccagatggacccgagtgggaatgctggctctgccactgcaatgcaggtggccttgggcaggttgtttagcctctctgagcctcatattcctcatgtatgcagtgggcacagtaacacctaccctgcagggtggttatgtaggtgaagagtggtataagcaactctgggaatataccaaactctgggatgtacactttagaagactgggttttatggcatatcagttatatcttgatggactcttatcttgttttcaagtagcatatgtaaggcctaagcacagttgcctggggtgtatagacttgtggcatatggaaccagtttggttcagggcagccagctgtttgcaaccaggtgccttcagttcaccttgttaagatgatttgttaaagatagttttgatttccattttctgctaagagggctagataaatctaaagctataaagggatatttgctttttaagatcagaatggcctgccttgctgctaaagagctggatggtgtggaagaaaaacacttctctcaagctccctgttccctgagcacctcgccgctgcagaccaggctcctggaggcaataatccgcntctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcaggtacgttgtgtgtgatggccatgacagctttgttcctgagaacagcaggagcaaagcctacaagttcacagcgggaatgagactgaggctgggacaagatccatccctaaccctactgggtaaaccagagggctgcatgtcccaatcagctgcaggtttggattatttattttgttataactgggaatcttccagagccctttatctttttaaaaactgcttctaattatttcagcatctctaaatcttctagtcccatttccaaatgcaatgctgcgtttctagcaagctcccagctgattctgatgctccatgaaccacactgtgagaaccaaggctttagatgagtcaggagcaggaggtgatgaaagtttagcttagggcctggagcggtggctcacgcctataatcccagtactttgggaagtcgaggcgggtgtatcacctgaggtcaggagttcaagaccagcctggccaacatggcgaaaccccatctctactaaaaatacaaaaattggttgggcgtagtggcaggcgcctrtagtcccagctgctcgggaggctgaggcatgagaattgcttgaatctgggagggagaggttgcagtgagccgagattgcrccgctgcactccagcctgggtgacaggacgagagtccatctaaaaaaaaaaaaaagtttggtttagggtaataataggtcaattacagaaaagaggaaaaattcacgagacatagcaaaaaagaaactacccaagacttgagagcaaataatctaattagtcccacatcacaacttgggttgtgaggagtttgttacctcaaatggcactggatttggcaccatgttttccccaaattgtattgcttggttttttccttttctggctgacgaaatgacaagcagggtcagtggtccaagttctctgtgggttttttttttttttcatgttatttaattttttgagacggagtctcactctgtcgcccaggatggaatgcagtgggkttaagcgattctcctgcctcagcctcccgaatagctgggactacagggcatgtgccaccatgcctggctatatttttttttttgtatttttaatagagacggggtttcgccatattggccaggctggtctcaaactcctgacctcaagtggtctgcctgccttgccctcccaaagtgctgggattacaggtgtgagccaccgtgcccagctgtttttatataagcatccagggaaaagtcagccagcacactcaggaagtcattgtcactcagggctttgtgagtcaccccagtaagccaggcctcatagaattaaagtggccgaggaaaggtgaaagtatgttgcactgggaggtagaaccccagggtctggatcctggttctgccccattcactggatgatcttggctaagacacattttctcggagcctgtctataaaatgggctaatactcaacctactgcatggagtcacagcaaggagtaagtgaaatgacaaggcagaaggaaacaccaaatttccattcagaggaataactataggccttaatctggatgaagtctcccatgaaaacacacaggcctgctaaacagaagggtaaatgttttgcccttctggctttaagcagtcataggaatgtgacagacattcctcttagggagcgcctcctcctagggtttcctcatctgtctcacactgagtggatgtaatgctattttaatcctgctgtggcccccaatactagtacttgtccataycttcttgcayttttagcgtctgctctgtggggttgttaggccctggcactcccaggaactagtgctaaagctgcatctctctctcccctctagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgmccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattcccctaaaaattaacaagaaaaaaagccagtctgagttcaagtggaaacacatggagatggctgaaaagtgaagagctatttcaagtgtaataaaactatcagcaaggtgtggtggctcatgcctgtaataccagcaactggggaggtcaaggtgggcagattgcttgagctcaggagttcaagaccagcctgtgcaacatggcgagaccccacctctataaaatgaaaggtaagaccagcatatcaaactatttccgcattaaatgcagtaacagataccagttcttggtatctttgtaaatattgtaacttcgtgccacttcagctaagaaaaaaatgctttatcagcacaatcacaaagcaaatagtagcattaagctgctggcatgttttctttctttctagccataaaagttgccagtggtgaagacggctatacgaaataatctgaatgatgtctaagcatgccatttggcatgcagcagcaccagtagcagggaaccaacaataatacctgcatggtacttcacagtctgtaaaatttttcacacctattactagctcatctccaaactcagtctaactaatcattaccatgagactaagtgcaaaacataaccttttaacatgattctgtgaaatgggaagaatgaaattaacagaccccatgcacatgtaacagaatgttgtaaggactgaataagcagtgctacaaaaatggcaacacctgtttccccctaaatcaaatcatgtgataaccagtttgtgttaagggctggactgtgagctgagcactggggatctgggaatacaggtccctgctgtacaaatcggtatgtgagagacaaattaccatgaaatgtaacagtgatttattactattaagtccaagttgctatgggaaaccaaaaaagtgcctaattctgaaagagacacaaaaggtcaagaaaagcttagctgagtgaagaaaacttgaaccaaggcttgaaggaggagcagaattttgccaacccacaagaccagcaggattccaggcagaaggaatggtgtgggcaggctgggaggtgtgaaaccctgtatgtttacagattatgtggctagatagtaagagccctacatgccatacttattcaagaaattaaaaactttttaaaaaatcacaatccttacaacacagtaaatgtatctcaacgattgacaagcatagcacagacttacctaaattctttaaattctgcaaagaaactctgtcttcttcctcatcactattgagaaaatcagctatagagtcatcatcatctaaggaatacaaaacagtcaatggctcatggctaaaaaggaggcctgggcaccagattttaaccactacttgaacaggataaaaatgtgtgcacgcacatgtgatagtgataggggtattcaagcaggtacagacaaaaatcctcttctccggagtctgtgactatactaacactccttttttagaagagggaggctaagtgaaagaattggtgattttaacaaatgcactctagtgttcacagccttactgtatatgtggtcctgtggtctttaggcttagaccccggttgtctaataacttaatacccatccccacctcaacatggctccaaccctgtgatgggccaattaactggatgctctgtaaaaaccagccaagtagaatctcctgtgctttcagcatgggcagaaactgctggcattgcctgaacccaacctggaaatttctcaaagggcaaaaatgggccatgcctttggagtgaatgttcaatacctctttggtggcaccagaggggctgctttcagagcctggcatggtgcttgacacccaggaggtattaaagaacgtttagatggctggacggatgggttgacagcccactactgctgtgagctctgaacccccagcagcagcgagatgatctaggacaaagaaagcctcctgcctgggctgagttcaggtgaactgacagtcccagccagattcatggagggagaccagcagctatgggctagagaaggctcctgccagcagggcccaccgcaaacccccaaaccacagccatggcctttctcatctctgtcttctgcccatttttcttctcctgaatactgctttcaggctgttgcctcaatatcacccatgatgacatggccccactcctgatgctcaaggctaaggaagctgttccttcccaatgaagctattgttctggattccctgaccagccccactctccccttttccttcgacttattctatgtgaagtcccttgtagatttgtttgaagtcaaccaacccacctttgttttccacaggctttacggttttggtaggaagagctgatcttatttttttctcaacaggacgagtttcagggttgcactgttctgaaaaagacacaaatcccaggcccacattacctccatttcagcgacaaggctgcacctccctaccaaggtagcatctaggtaggaagcaagtgtctggggtaagggatgtgggtgggtgcccaggaatgtggaagaagtgagagatcaaagcaagagagagattaaggaaaaccgccagcaggctgagaaagcaggactcattcatgcaccccaagaacctgtccccatcctccctaccctgccgaatcttacaaaattctcaccacaattaactgaggtgtttgaaatagctgctgtaaaccagataccagatgggataaaactaggggcaaaaccaccaaagaacttacagagtcaacagaaggccagctgtgctggctcacgcctgtaatcctaacattcggaggccaaggtgggaggatcacttgagcccaggagtttgagaccagcctgggcaacctagcaagactatgtctctacagaaaataaaaaaaatcatccaggcatggtggtacacacatgtggtctcagctacttgggaggctgaggcaggaggatcccttaagcccagtgtgtcaaggctgcagtgagctgtgattgtgccactgcactccagcctgggtgacagtatcaacagagcatgaagtcacaggaaagggttctgaggacataaaggcaggaccagattgtagagacttaaaatgtagatttgacaatatgctacggaaaggttctagtcatgtaggtggcagttacaacagctgccagtgactaagtgccgagcactgtgccaggtacacagtgagatacatagtggctcaatgaacctttacgaagcccccatgacatggagactgttaattccacttacagatgaaaggattaaattttcttgtaataaacttgtccattggggtccacagctagtaagtagcagaggcagatttggaatccgggtctaactttacggctatgctatatgtgtaaggaacacagcaggagggactgaaggagaggtgaattttctgggttgtacctgaccccaaaatacatttgtgtctaaggtgctcaaaaagaggctggagctaaacagttggatgtcagcaagaaaaaaaaaagtttaaagtgaaagagagatcacctacctaggaataaaagtcaaggaccacatttcaagagagagatctagcaaaaggaaggagaagctgggcacagtggctcctgcctgtaatcccagcaatttgggaggttgaggcaggaggactgcttaagcccaggagtccaagaccagcctagacaatacagtgagaccctgtctctacgaaaaatagataaagtttgtctccgttactcaggaggctaaggtgggaggatcacttgggcccaggaggccaagggtgcaatgagctgtgatcacaccactgcactccatcctgggcaaaagagcaagaccctgtctcgaaaaaaggaaaaaaaagaaaacgagagtctacagctaagccaccctgaatgcaccctatctcatctgacctcagaagctgtaacagggtcaggcctggttaggacttcgaagggagaaagggaggagagaataccacagagcggtatcttcccagcctccaaagaatatcaagaaagaaaaagccaaacacagcagatattcatgggaatcaagaaagatgacaggctgagcatgggtagctcacgtctgtaatcccaacgctttgggaggccaaggtggaaggatcacttgagcccaggaattcaagaccagcccaggcaatacagtgagacttcatctccacaaaaattaaaattaaaaataaataagccaggcatggtggcacacgcctgcagtcccaactacttgggaggctgaggtaggaggactgcctgagcccaggaagtcaaggctatagtgagcaccactgcactccagcctgggtgacagagcaagactttgttgcaaaaaaataaaaaagacaaatgaaaagtgtacaacagatgtggctattagaaatttctgataaaaattatttattaaataccactttaacactgcctatagcagcaacaaaggcaaaattaatgtaaatatccaccaataagaaaaataaatattaaaatgaccatactacccaaagtaatctagagtcaatgcaatccctatcaaaataccaatgatcctgttcacagaaatgtcaaaaaaaaattctaaaattaatatggaaccacaaaagacccccaatagccaaagcaatcctgagcaaacagaacaaagctggaggcatcaccactacttggcctcgaaatatactacaaagctataatatctaaacagcatggtactagcataaaaatagacacatagatcaatggaacagaatagagaacccagatataaattcacacatttacagccaactgacttttcacaaaggcaccaagagcatatactggggaaaaaagcactcttcaataaatggtactggaaaaataggataactgtaagaataaccatatgcagaagaatgaaactagatccttatctgtcaccatatataaatatcaaaatggattaaagacctaaatgtaagacctgaaactactacaagaaaacacaggggaaatgcttcaggacattggtctaggcaaagattttatgaataaaatctcaaaaacacaggcaagaaaagcaaaaataggcaaatggaattctattacacaaaaaagcttctgtacaacaaaggaaacaatagaatgaagagacaacccacaggatgggagaaaatatttgcaaaatattcacttgacaaaggattaatatctagaatacacaaggagctcaacagccaaaaaaaaaaaaaaaaaaaaattaagtggacaaatgggccgggcatggtggctcacccctgtaatcccagccctttgggaggccgaggcaggtggatcacctgaggtcaagagctcaagaccagcctggccaacatggtgaaaccttgtctctactaaaaatacaaaaatcagccagcaggcacctgtaatcccagctactttggaggctgaggcaggagaatcacctgaaccctggaagcggaggttgcagtaagcagagactgcgccactgtactccagcccgggcgacaagagcaagactctgtctcaaaaaga

SEQ ID NO: 10587 - DNA, 12336 bp, Homo sapiens
ccttagtctctactactctgtcactactgaattgtggccctagctctgtccctggccctagctctgtcccttgcctgctgcccatgactgttctccccacaaaggtcagcaatcctgctaatgtgagtcagattgtttcatttcttcacttaaaagcctctaatggctccatcttactctcaagaagcctctagaatggaaggcacaagcacaggggctttgggttgttttgatcaaagttgtatctacagaatataaaagtatatctgccacatagtaggcactaagttaatttttgttgaatgaatgaatgaaatataattgtgttcaaaattgtatcacacaaaaatcatgaaatggaaaatgcaaagcaagttaggaaatatttggttttatgcaactactatgcatatcagttcatgaattcattccggtggagaaaatgtcatatacttatcctttgaatctgtttatttatttcctggcagtacataaccaattaccacaaacttagtggctgaaaacagcacccatttatttgtctacatttccttcatcagaaatccaggcctaacgtgatagactctttgttcagagtttcgcaaagttgtatcctcatcttaagattggggttctcccccaagcttgtgtagagtttgttggcagaattcggtttctggcaattgtaggattaaggtccctgtttccttcgggctatcagagtagacagtggggagggcttctaattcctattggccaccagtgttctttccccatgatccctccattttcaaagcccaaagtggaggaagcccctcacgctgaatccctctcacactgtgagtctctattctcaggaagaacccaatccttttcagagcttacctgattaggaccgtctaagcaggataatcctcatcttaaagtcaactgactggggactttaaatatatctgcaaaacctcttcacagcagcacctgctttagtgtcaactgagtaactggggtaacctgagtaaccaagggtggttattggggtgtcatcatagaatcagcctagcatagcctggatcttcctttcatgtttaaatagaacatacaagttgaagatcaaaaaatagatcattgttaatgataataaaatatatcttatatagccatggaaatttttattaaatattaaaagcaaatgacatgtttaatatcttataatgaatttagagcaaatgaaaaagttcagtgattcatcctctcttgtgaagctgtattagttatctactgctgcataacaagtcacctacaacttagcagctcaaatcaacaaatatttatcatctcccacagttatccatggtcaggaatccaggagaagtttctctgaatgcttctggctcagggcctctcacaacgttgcagtctagttgtcttccagggctgaatcacctgagggctcaaatggggccagggattcacaagacacaagaatctctcacatggcttttggaagaggctttagcttcttattgtctggtcccaggaggactcacttcctagtcacatggaccacaggcctccttatgacacaacagccagcttcccccagggctcatgattccagagaaagaaagaaccaaagtagaaacttcagtgagtcttatgttctacacccagaatcacaaactattatgtcagcattactctatcagttagaagtgagtcattaagtccaggccacacgaacagggagggaatgaagctgcacttctggaaaggaggagtatcaaagaatttataaacatgttaaaagcaaaattaacattattgtttcagggttttgtaaatcaaatacttcttgtatctgactttttttaatactttaaaattctcttctgtaaagttgattaaatatttgagacagagaaagaagatacaacaatatctcagattttttttgtaaatgcctttaatattaatgttctctttgataagttgcaacagagttgagaaaatacagtagctaaattaaagtgtcccaagactttggtgccatacaataatgcctttacaatcataactatgtttgtttctcttcagaagtttctaattcggtttaagaatgcccaaaatgccaattttcttactcaagcatctacaaaaatatttgcctaatcagggtgctttgcagttagaaaaatgtgaatctcacacctctgtctatacactagcttagcatcatgacaataatttgtttggctagggtaggcagaaattgtttactccaatctaggaacaagatttttcaataactggctattcagtgggcatcctatgaaagtttaacatctttcactgtgttttttaattagatgtggtagaagtgatttggactccagtatgattctgaaaaacactgttcttttgtgctgctatcattgctgtacaagcatctctttcatgttttccattcttattgctatttcatcactagttattcctttatgtcttttcatttaatttattttgctcaacaatgctttttttttttactgtgtaaaagtttaatccacttgtatgtgtggtaaaatgtgagcaacatatcaaattctcaaattctttgcaagatacaattgccttgcacatcagattgaacactgtatgccagacaatgtagagagttgccaattagcccagggtcaaatgacctctttctagccaaggctatttttcatgagatcctggtcctctctgtcacatgactctttacaattggctgtggctttgttttaacgtgtgtagttattgctaaggatccttgagatgaactttggtattttcttttctctttcatttccaaataatcagtcaggaatggcacacaaggtgcattttgaaaaatgacactttaaagatttgtgggccgggaatggtggctcatgtctgtaatcccagcactttggaaggccgaagttggtggatcacctgaggtcaggagtttgagaccaacctggacaatatggtgaaaccccgtctctactaaaaatacaaaaattacctgggtgtcgtggtggatgcctataattccagctactcaggaggctgaggtaggagaattgcttgaacctgggaggcggaggttgcagtgaactgagatcacgccactgcactccagcctgggcaacaagagggagactccatctcgaaaataaataaataaataaataaataaagatttatgatcaagtaacttaactacctggacatcccctcctggcataaaaaacaaaacctatgaagccaccctcggctgttgtccaattctattccccaaaaggaacttctatcttgagtcttgtatttactattccttttcattgtctctaaagatttttacaataagtatatatatatatatccaaatcacagtttgacctgcttttttaaacttccccgtacagagaactcacacaatgtgcattcttctgtgatgctgatgcatgttatgtgtaggagagttatctctgatgtgggagggtgctgttcattcactgttgctgctgaagttttactttttattattatacgactattttgttaattcccattgatgtatatgtgattgtttccagtttttgccataaacattggtgtacatgtctcctggacacatagccaagaatgtccccagggggtatgatcaggaggcagatggtgggattatatgatgtatggacattaatcatactagataaggctaatttgatttctcaagtgcttgtaccaagaatgggaaagagcttgtgttgctcatgtgttctgaaaacattcagttggaggcagaaattaaatgttaaaaggtactgtcttggctatagaatcaccctaggcattttttcatattccattaacaacttccttttctttacttttatattataaattacggcattatacttttagcataaagttcaaataatgcttccttttggcctaaacacttggagtttatgaaaaaaatggagggagggagaaagctctgagggaggaaaggaggaaagaaggaaggaaggacagagaaagacaaaatttaaaatgttcaaaaataggaggaaagagttggaaacagcaagtatagctaatgttattaaaatgcaagggattaaaagatatgtagataatatccatggaataatggaaacttaagaaagccttaatagttatcaagtgctgtgtcacaaactacctcaaaatttagtagcttaatagaacaaatatctgttaactcaaagagatactacacacacaagtaaaatagattctgtgggggtggcagaagttggataaagagaaggattttacaggttggaataagagttattgatatgcagatggaaataatttttagtccaagtccttcaaggagcagatgccaagatgagcttaaagtctgcgacatcttatgaggggacacacccgtaagggaatatgggaagtgagccagaaatccctggaaaaggcggcagaccacgatgcaagtgtgaccccaagtgctggacagaaggagagaaagtttgttcgacgcatcctagagcacaggcaatctaaggagagttgagcaaggccgtggaggagccttccagctacagttggccatcagaggagtcccgtgtctcccaggaatggcttgccttaacgcctgctgtgaccagtcactggctgggaacagcccatgggaagcagggctttgcaccaatcctgctgaggatgtcagagcacaggagcacagccttgggacattacctatgagtatcgctcaatccttccttcctgagggttctgggctcttgaatatgaaaccctctcaggctgggttgctggatgattctgctcacacttacaacaggacaaggggaaccataaggtctccaagtggatctcttatttccacacacacatctcctgccctccttgtgtgatagcagccctgcctcctcctcttctcacctgcttgtatctggacacatactattcaaacatccctgggggcagccataatgtgtatttccatggactctcatttaaatgtctccttgccagggtgccccctttgggaaaccaggacctcctcccctacagagcccagatattggagatgagaagtgcaaaatcaccctgaaggtgaatataagggtttagatatggagccacacctgcttctacttcttggtttttggacccacgtattcttccttctgtaaacacagcactatagagacatctttgattcaatacatgcaccacatcctgaaagatggcagccattcctcagagggtttcatccaagctggcactaagttgtgtctgtagagacctgtccatgactctgtgtggctggcagcccctgggaggtgcaggtggtgataagaccaggggattccatggtcatcatggcccacgcttcatccccttccctctgaggtgtgtcccgcgggcagataatgtactgaaattctgagccagtggctcaggaatgccaatagtgatactggctgagggtctaagagtagagaggaaaaccacaccacatctaataggtgcctatccctgtgaggatgaacctccgccccccgggccgcctcccacttgagctgggtgatctgagccgccgtgtctgcggctgtcaaggagcacaggtcctcgttcaggacgatgtaatccttgccatcgtaagcaagctggtgatacccgcggagtaggcgcccgtccgaccccacgtcgcagacagacatcctctagatgggtgtgagaccctggccccgcccccgcggccagccccgcccaccgagccccgccctcgccaggaccaacctgcggggattttggctgaaaatgaaaccgggtaacggctcctgggcctctcccgggtcaagggtctccaggtcccgctgcctcggcgtggatctcggacccagagactcggggagacccgggcggtccgtgggggatgtrgasgggtagtgabctgcgcccccggccggtgtcactcacaggcctcactctggttgtagtrgccgctcagggtccgcaggttcactcggtaaaactgtgctttggccttggcggtccctgtctcctcttcccaatattccggcccctcckgctccatccacggcgcccgcggctccatcctgggactcgtggcgtcgctgtcgagscgcacgcactgcgtgtcgtccacgtcgcccacggagaggaagcggggatccgcgcggccgggccgggacatggtggtgtggaaatacctcaaggagtggaagcctgggagcaaggagggggctgagaccctcccgaccctcctcccggcaccgcaaccgggttcctgcgcccccgccgggcaggcccctagctactccccacagacgccgtttccctcccgaccccgcactcacctgcccaggtctgggtcaggaccagggcccccgagagcagcagaagcagggttcggggcgccatgacaccatcctcggcgactgggaagaatcggagtcccggtgggtgcgtgggaactttagaaccgggaccgcggctacattgattggcttctctagaaacccgacactcaatgggagtgagaactggggcagcctggtgagtatccaggaagaaggacccgacacaggttgggagagggagaagagaaaccctgcggagatggggaatccccagcgctgggcctccccaatccatacaccgcctttggggcctgagatcctgagagccatgcctgaggccctgggacttcgccctgaccccgctacttctgtgccaagcgctctgtctcaacgtttccgagtcttggcccaggagctgtctgagaaaccagggagaaaccctcgaaatgggccccgttcctctctcttcactttgcatcacggaatccccgtcccagaactggactccctgcctcctactccttacctgtccccgtggactcttctagaagaaaaatcactccagggagcttgttgccagagagtgagcttgccctgggaatggaggtgtagagacagggttttttgttgttattgtttgtttgttttttaaatctggaaaagttgtgcctgagtgcatgagatagaatagagaccagtttgctttttgtttattaactacagtgggtagcagaatcttggtaactcctaatgatcaggaatctaattggccaaaaatgtgactttggtcccttgacatataaatgtgtctaaaagcattacaacaggaatcacaaagctcctaagtttcactttcccagacaatgtatctgtgactcccgcttgtagtattttaaatttaccttcattccatagccctgagtttctgtgtgagtccaggacatctcctaatacaaggtagccactgtgttactatatgttgtaaccaggagccagtacagactttattcacctcacagtggcaagcactcaatgcagtcacaatgcccctcaccagtgctcatgcactgcctgtttttaggaagtatccacttctaagtgttgtgtatattttatatgaacacttagtattttttaaacctgattaacataaaaaaattagtttttaggcagacccacataaggtattaaaggccaactgcaaagatcaccctgcaaggctctgtagattgatgtattaaaatatataaaacaatgtgtttaaacctgagttctgctgctttcgaattctttccctctgctccatttcctcacctcctgcatctccagcccttccctccattcctctcatccctcaggccctcctctccccttagtccccaccaccttgtcactccttatttgtgacactagcactgtcccattacctgctacgtgactgttctctgcacagtggtcctgctcctgtgagtcagagtgtgtcatttctccacctaaaacattccactggctccaccttggtcttgtgaagcttctggaatgtcaggcacgtaagcatatgagggcacacctggttcattgtagggattaaattaatttttcttgactgaatgaatgaaatatgagtctattaaattgcatcacagaaaattataaaatgtaaaatactgaaaaagttaagaaatattttattttatgtaattagtgtgcatatcaattcatcaattcattcgtgcactaccacgactggcaaaacaacacccatttatctgcttatacttccttggtcagaaatctgggcaagatgtggatagaatccctgttctgggcttccaaaagctgtgttttcattttgaatcctccttcaggcttatacagaggtggcagaatgcagtttctggcagttgtaagactgaggtttctgttccttgctggctgtcaatacagagaataggcagggctgtgctcaattcctggtgcctaacagtgttctttcctacacagcctcttcattttcaaagcccacggtagaggaaacccctcatgctgaatccctctcacactgcaaatctctatgctcagaaagaacacagacctttcaaggactcaccttattaggacagtcaaagcaggataaacccagcctaaagtcaactaattgaggcccttagttatatctgctaaatcccttcacagcagcatctacactagagttgcttgaataactgggggaaagtgaatgaccgggaggtggctgttgggggccatcaaagaatcagcccagcaagggttggatcttccttttgtgtttaatttggacacagttggaaattgaagttcaagtaaagtgatcattgtgaatggtaataaaatgcatcctcttcagccatggacattctccttaccttttaaaactaagttacatgtgtaatgtcttataattaatttaggccaggtgtggtggctcacacctgtgattctagcaccgtggaaggcagaggaaggcagatttgttgactccagatgttgaagatcagcctgggcaacatggagaaacccccatctctacaaaaaaatttagaaaattagccaggcgtggtgcttcatgcctgtagtcccagttactcaggacgctgagataagagggtcccttgagcccaggaagtcgacactgcagtgcatggtgatcatgccactgcactccagcctgggcgacagagcgagaccctgtctcaataacaataatattaataataatgataaatttagagcaaatgcaaattaatgtgtaatactacatcctcttttgtgaaaatgtgttagttatttactattgcataacaaattatgtaaaacttagcagctcaaaatggcaaatattcatcatctcccgcaggttccaatggtcaggaatccaggagaggtttccctgagtgcttcttgctcagggcctctcacaaggttgcagtccagttgtcagcctaggcctgcatcatctgagtgcttcactgggactgaggattcacatgaaacatggatgggtcacatggctgttggaaaagccctagttccttgttttctgttcccagaaggccccagttctcagccacatggaccttccttcagggctgcttatggcacagcaggtggcttcccccagagctcatgattccagagacattgagagagaagggggaggctgcagtgagttttatgttctacacccagagtcacaaactcttatgtcagcattaccagttagaagttgtattagtccgttctcacattgctataaagaaatacctgagactgggtaatttataaaggaaagaggtttaattgactcatagttctgcattgctgagaaggctgccccatgaaacttacaatcatggcagaagtggaggcaaacacgtccttcttcacatggtggcaggagagagaattgcagatcgaagtggggaaaaatacctcataaaaccatcagatctcatgagaattccctcagcatcataagagcagcatgggggtaccatacccgtgatccaatcacctcccaggaggtccctcccccgatacatagggattacaatttgcatgacaattcaagatgagaatttggtgggaactcagagccagaccatatcagaaatgcatcattaagtccaagccacactcaagagaggaaattaagcagcatctctggaagggaacagtattaaaggatttgaatatatattaaaagcaaatttaaaactcttgtttcaggattttgaaaatcaaaatttttttatctaattatttttcgttaacccttttagcttgtcttttaatttaatttaattttaagttccaggttatgtgtgcaggatgcgcaggtttgttacataggtaaatgtgtgccatggtggtttgctgcacctatcaaaccatcacctatgtattaaccctggcatgcattagctattttttcctaatactcctcccaccactgccctcccccagcaggcaccagtgtgtgatgttcctctccttgtgtccatgtgttctcattgctcatctcccaattataagtgagaacatgtggtgtttggctttctgttcctgtgttagtttgctgaggatggcttccagcttcatccatatccctgcaaaagactgaatctcattcctttttgtggctgcataatattccatggtgtatatgtaccatattttcttaatgcagtacatcattgatgggcatttgggctgattccatgtctttgctattgtggatagtgctgcaataagcatacacatgcatgtatctttataatagagtgatttattttcctttggatgtataccctgtaatgggattgctgggtcaaatggtatttctggttctaaatctttgaggaatcaccaaactgtcttccacaatggttcaaccaatttacatttccagcaacagtgtaaaagccttcctatttctccacaacctcgccagcatctggtgtttatgtagttttaaataattgccattctgactggcattagatggtatctcatttgtggttttgatttgcatttctgtaatcagtgatgttgagctttttttcatgtttttttggccacatgtacgtcttattttgtgaaatgtctcttcatgtcctttgttcactttttaatgaagtttttttcatgtaaatttgcttaagttctttatagattctgaatattagacctttgtaagatagatagattgcaaaaattttctcccattctgtagggtgtctgttcactctgatagtttctttttctgtgcagatgctcttttgtttaattagatcccatatgccaatttttgcttttgtggcagatgcttttggcgatttcatcataaaatctttgcccatgcctgtgtcctgaatggtattgcctagattttctttcagggtttttataattttgtgttttacatttaagtctttaatctatcttgagttaatttttgtgtaaggtgtaaggaaggggtctagtttcaattttctgcatatggctagccagttctcccatcaccatttattaaatagggaatcctttccccgttgcttgtttttgtcaggtttgttgaagatcaaatggttgtagatgtgcggactttttttgtgaattctctattctgttccattggtctatgtgcctgtttttgtaccagtatcatgctgttttgtttactgtagcctcacagtatacttttaagtggggtagtgtgctgcctccagctttgttctttttgcttagtattctctttgctatatgagctcttattggatccatatgaattttaaaatagtttttttttctaattccacgataagcttatcttttaaaattaatgattaactgtttcagacatcacagagccttgggtgcttaggagaaaacagtttgaaacagagaaaggatatgcaacagtaactctgaatttttcttgtgaatacctttaataacaatgttgttttcaattagttaacacagttgagaacatagagtaactagatcaaatagttccaagacttcagtctgataaaaataatgtcttgaaaataagactttgttttgtctaagatatctcaaatttagtggaagcacgtcccaagcaccaattttcttattgaaatatcatcttcactaaacatttgcctacacttaaaaaaaaaaaacaaaaactccactatatggagtagccattcttttgtttctttacttctctaataacttgctttcacttaggaaaacattgcctaatcaaattgcttttcatttacaaaagtgtgaatctcatacttcagtcaacacatctagcttagcatgatgccaataactttggtttgatgca

SEQ ID NO: 10588 - DNA, 15644 bp, Homo sapiens
aggtgtgaagtgggaaatcaggggtctcacagccttcagagctgagccccaaacagagatttacccacatatttattacagtcattagcattgtttctataaatattaaattagttaaaatatcccttatgggaaacgaagggatgggccgaattaaaggaataggttgggctagttaactgcagcaggaacatgcccttaagacacagatcactcatgctattgtttgtggcttaagaatgcctttaagtggttttccaccctgggcgggccaggtgtcccttgccctcattcccgtaaacccacaaccttccagcttgggtgctagggccattatgaacatgttatggtgctgcagaaattttgtttatggccagtctcggggccagtttatgaccagattttgggggacttgctcccaacagtctccttctggaggatgactgggtagcagcccagggtagttttacagttttgtgttttacaccagtgctgggccccctggtagttacttgattataattccttaaacagagttttccaaattaaaatatacctgttttttatagaaatgaaaaagaaaagaatttcaaagttcattgcaaagattcttaacaagaactacttacattggaagaaaaccacagagaattgtaaggagctatgtgacagagaggaccaggatgccatgaaaacggccttggctacatataggtcattcgatccttggctcactggcatctctctagattttcaataatacaatgttcaatatgctgtgcaaggtaatttcatcttgcaaagattctatgttacattttaccacacatacaactgaattaaacttttacagaattggaaatgcacatcactgatcaaaataaatgaaacatgaaaagagtaggaaggaatacccagtgatggaatagcaaatatgaatggaaacagaataggactgctaaaaagaaaaaaaattcagaagcacataatagcagtgctatttagaatcatagtggtgtccaaatcacttctatcacatctcattcaataccacaacaaaagatgttaagtgtgttatagaatgcccatcggatagccagtttttgaaaataacttgtctctcaattcgagctaaccatttcgggctacagcatcaagccaaaattattggcatcatgctaagctagatgtgttaactgaagtatgagattctcatttttgtaaatgaaaagcaatcagattaggcaatttttttctgcacagcaaaagaaactatcatcaatcagagtgaacagacatgctacagaatgggagaaaaattttgccatctgttcatctgacaaaagtctagtattcagaatccacaaagaacttaagcaaatttacatgaaaaaaaacttcattaaatagtggacaaagaacatgaacagacacttctaaagaagacatacatgtggccaacaaaaatatgaaaaagaaagctcccatcactgatcattagagaaatgcaaatcaaaacgacaaatgagataccattttatgccagtcagaatggcaattattaaatagtcaagaaacaacagatgctggcaaggttgcagagaaataggaatgcttttacactgttggtggaaaagtaaatggttaatccattgtggaagacagtgacagtgtggcgattcctcaaagatttagaaccagaaataccatttgacccagcaatcccattgcagggtatatacccaaaggaatataaatcattctattataaagacatatgcatgtttacattcatggcagcactattcacaatagcaaagacatggaatcaacccaaatgcccatcaatgatggtctggataaagaaaatatggtacatatacaccatggaatattatgcagccataaaaaggaaggagatcaagtcctttgcagggatatggatgaagctggaagccattatcctcagcaaactcacacaggaacagaaaaccaaacaccacatgttctcatatataactgggaactgagcaatgagaacacatggacacagggagaggaacaacacacactggggcctgttgggggagggtggtgatgggaggatcattagcaaaaatagctaatgcatgccagggttaatacctaggtgatgagttgacaggtgcagcaaaccaacatggcacacatttatgtaacaaacctgcacatcctacacacatgtaccctggaacttaaaaaaaaattaaattaaaagacaagcttaaagagttaatgaaaactaattagatacaagaagactttgattttcagaaacctgaaacaatagttataattttgcttttaacatatattcaaatcctttgatactgttcctttctagaggtgcagcttaattccctctcttgagtgtggcttggacttaatgaggcacttctgaaatggcctggttctgtgctcccacccaaatctcatcttgaattgttatgcaaattgtaatccctacctattgggggagggacctcatgggaggtgattggataatgggggcggtgcccccatgctgttctcctgatgctgagggaattctcatgagatctgatggttttataaggggcttttccctgcttcattgtgcatttctctctcctgtcaccacgtgaagaaggacgggtttgcttccacttctgccatgactgtaagtttcctggggcagccgcctcagtcatgcagaactgtgagtcaattaaacctctttcctttataaattacccagtctcaggtatttctttatggcagtgtgagaatggactaatacttctaacttatagaatagtgccaacataacagtttgtgactctgggtgtagaacataaaactaactgcggcttccaccttctctctctctctgaatctgggatcatgagctctgggggaagccagccactgtgccataagcagccctgcaggaaggtccacatgactgagaactgaggccttctgggaacagacaacaaggaaccaggccttttccaacagccatgtgactgatccatgtttcttgtgaattcccagccccagagaagccctcagatgctgcagcccctggctgacaactggagtgcaaccttgtgagcggccctgagcaggaagcactcagggaaacctctcctggattcctgacgattggaaactgtgggagatgagaaacatttgttgtttcgagctaagttttacgtaatttgttatgcaacagtaaataatatattttcacaagagaggatgtattattacacatcaaattgcatttgctctaaatgtgtcatcatcatcattattatttttgagacagggtcttgctctgtcacccaggctggaatgcagtggcatgatcaccatgcactgcagtgtcgaactcctggggtcaagggactctctgacctcagcctcctgagtagctgcgactaccatcatgaactaccatgcctggctaattttctaattttttgtatagatggaggttttgcccaggctgatcttgaacttctggagtcaacaaatctccattcctctgccttccacagtgctaggatgacagacgtgagccaccacacctggcctaaattaattataagatattaaacatgtaacttagttttaaaaagtaaggacaatttccatggctgaagaggatgtattttatgaccattcacaatgatcacgttacttgaacttcactttccaactgtgtcccaattaaacacaaaaggaagatccaacccttgctaggctgattctatgatggcctcaacaagcagctcctggtcagtcaccttcctccagttattcaaccaactctaatgtaggtgctgctgtgaagggatttagcagatataattaagggtctcaattagttgactttatgctgggtttatcctgcttggactgtcctaatcaggtgagcccttgaaaggactgggttcttcatgagcacagagacttacagtgtgagagggactcagcatgaggggtttcctccaccaggggctttgaaaaggaaggggctatgggccgggcgtggtggctcacgcctgtaatcccgacactttgggaggccgaggcgggcggatcatgaggtcaggaggtcgagacaatcctggctaacaaggtgaaaccctgtgtctactaagaaaaaaaaaaaaaaattggcagagcgtagtggtgggcgcctgtagtcccagctacttgggactgagacaggagaatggtgtgaacccaggaggcagagcttctagtgagcagagatcattgggccactgtaccccagcctgggctacagagccagactcggtctcaaaaaaaaaaaaaaaaaaaaaaaaaattaaggggctgtgtaggaaagaacgctggtgagcaccaggaattgagcccctcccagttctctacattgacagctagccagaaacaggaacctcagtcttacaactgcaagaaactgcgttctgccacctctgtataaacctgaaggaggattcaaaatgaaaacacagcttttggaagcccagaacagagattctatccacatcttgcccagatttctgaccaaggaattataagcagataaatgggtgttgttttgccaggcgtggtagtgtgcaaatgaactgatgaattgatatacacactagttgcataaaataaaatctttctgaactttttccgtgttttacagtttataattatctgtgatgcaatttaatacactcatatttcattcattaagtcaacaaaaattaacttagtccctacaatgaaccaggtatcccctcatatgctcaagtgcctgaaactccagaagcttcacaagaccgaggtggagacactggagtgttttaagtggagaaatgacactctgactcacaggagcaggaccactgtgaaaagaacagttacgtagcaggtcatgggacagtgctagtgtcacaattcacgagtgacagtgtggtggggactaaggggagaggagggcctgaaggatgagaaggatggagggaagggctggagaagcaggaggtgaggaaaaggagcagaggaaagaatttgaaagcagcagaattcttaggtttaaatacattgttttatggattttaatacatccatctacagagcctagcagggtgtccttggcagttgtcttttaatacctcatgtgggtctgcctaaaacctaattttttatgttaatcaggtttaaaaattactaagtgttcctataaaatatacacaacacttagaagtggatacttcctaaaaacaggcagtgcatgagcagtagtgaagggcattgtgactgcattgaacagttgcaaatttgaggtgaataaagcttgtaatggcttctggttgcaacatataggaacacagtcgctactttgtattgaggagatgtcctggactcacacagaaactcagagctatggaatgatggtaaatttaaaatactacaagcaggagtcacagatacattgtctgggaaaatgcaacttagtagctttgtgagtcctgttgtaaggcttttggacacatttatacatcaaggggccaaagtcacattttttacctattagattcctgatcattcaggggttaccaagattctgctacccactgtagttaataaacaaagagcaaattggtctctattctgtctcatgcactcaggcgcaactcttcccgattaaaaacaaaaacaacaacaacaaaaatctacacctccattcccagagcaagcttactctctggcaccaaactccatgggatgatttttcttctagaagagtccaggtggacaggtaaggagtgggagtcagggagtccagttcagggacagagattacgggatgaaaagtgaaaggagagggacggggcccatgccgagggtttctcccttgtttctcagacagctcttgggccaagactcagggagacattgagacagagcgcttggcacagaagcagaggggtcagggcgaagtcccagggccccaggcgtggctctcagggtctcaggccccgaaggcggtgtatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcstcctgctactctygggggcyctggccctgacccagacctgggcgggtgagtgcggggtcgkggggaaacsgcctctgyggggagaagcaasgggccckccyggcggggacgcaggaccsgggdagccgcgcckggasgagggtcgggtrggtctcagccactsctcgyccccaggctcycactccatgaggtatttcwhcacmtccrtgtcccggcccggcmgyggrgagccccgcttcatcgcmgtgggctacgtggacgacwcgcagttcgtgcggttygacagcgacgccgcgagccagargatggagccgcgggcaccgtggatagagcaggagrrkcckgagtattgggacsrgcasacasggaawgtsaaggcccaskcacagaytgaccgaghgracctgsggaccctgcgcggctactacaaccagagcgaggmcggtgagtgaccccggcccggggcgcaggtcacgacctctcatcccccacggacgggccrggtcgcccacagtctccgggtccgagatccaccccgaagccgcgggaccccgagacccttgccccgggagaggcccaggcgcctttacccggtttcattttcagtttaggccaaaaatccccccgggttggtcggggccggacggggctcgggggactgggctgaccgtggggtcggggccaggttctcacaccatccagakratgtwtggctgcgacgtggggtcggackggcgcytcctccgcgggtaccrgcagkacgcytacgacggcaaggattacatcgccytgaamgaggacctgcgctcttggaccgcggcggacatggcrgctcagaycaccmagcrcaagtgggagrcggcccrtstggcggagcagttgagagcctacctggakggcacgtgcgtggagtggctccgcagatacctggagaacgggaaggagacgctgcagcgcacgggtaccaggggccacggggcgcctccctgatcgcctgtagatctcccgggctggcctcccacaaggaggggagacaattgggaccaacactagaatatcgccctccctctggtcctgagggagaggaatcctcctgggtttccagatcctgtaccagagagtgactctgaggttccgccctgctctctgacacaattaagggataaaatctctgaaggaatgacgggaagacgatccctcgaatactgatgagtggttccctttgacacacacaggcagcagccttgggcccgtgacttttcctctcaggccttgttctctgcttcacactcaatgtgtgtgggggtctgagtccagcacttctgagtccctcagcctccactcaggtcaggaccagaagtcgctgttccctcttcagggactagaattttccacggaataggagattatcccaggtgcctgtgtccaggctggtgtctgggttctgtgctcccttccccatcccaggtgtcctgtccattctcaagatagccacatgtgtgctggaggagtgtcccatgacagatgcaaaatgcctgaatgatctgactcttcctgacagacgcccccaaaacgcatatgactcaccacgctgtctctgaccatgargccacyctgaggtgctgggccctgagcttctaccctgcggagatcacactgacctggcagcgggatggggaggaccagacccaggacacggagctcgtggagaccaggcctgcaggggatggaaccttccagaagtgggcgkctgtggtggtrccttctggacaggagmagagatacacctgccatgtgcagcatgagggtttgcccaagcccctcaccctgagatggggtaaggagggagacgggggtgtcatgtcttttagggaaagcaggagcctctctgacctttagcagggtcagggcccctcaccttcccctcttttcccagagccgtcttcccagcccaccatccccatcgtgggcatcattgctggcctggttctctttggagctgtgatcactggagctgtggtcgctgctgtgaggtggaggaggaagagctcaggtggggaagggatgaagggtgggtctgagatttcttgtctcactgagggttccaagacccaggtagaagtgtgccctgcctcgttactgggaagcaccacccacaattatgggcctacccagcctgggccctgtgtgccagcacttactcttttgtaaagcacctgttaaaatgaaggacagatttatcaccttgattacagcggtgatgggacctgatcccagcagtcacaagtcacaggggaaggtccctgaggaccttcaggagggcggttggtccaggacccacacctgctttcttcatgtttcctgatcccgccctgggtctgcagtcacacatttctggaaacttctctgaggtccaagacttggaggttcctctaggaccttaaggccctgactcctttctggtatctcacaggacattttcttcccacagatagaaaaggagggagctactctcaggctgcaagtaagtatgaaggaggctgatgcctgaggtccttgggatattgtgtttgggagcccatgggggagctcacccaccccacaattcctcctctagccacatcttctgtgggatctgaccaggttctgtttttgttctaccccaggcagtgacagtgcccagggctctgatgtgtctctcacagcttgtaaaggtgagagcttggagggcctgatgtgtgttgggtgttgggcggaacagtggacacagctgtgctatggggtttctttgcattggatgtattgagcatgcgatgggctgtttaaagtgtgacccctcactgtgacagatatgaatttgttcatgaatatttttttctatagtgtgagacagctgccttgtgtgggactgagaggcaagagttgttcctgcccttccctttgtgrcttgaagaaccctgactttgtttctgcaaaggcacctgcatgtgtctgtgttcrtgtaggcataatgtgaggaggtggggagaccaccccaccccsatgtccaccatgaccctcttcccacgctgacctgtgctccctcyccaatcatctttcctgttscagagaggtggggctgaggtgtctccatctctgtctcaacttcatggtgcactgagctgtaacttcttccttccctattaaaattagaacctkagtataaatttmctttctcaaattcttgccatgagaggttgatgagttaattaaaggagaagattcctaaaatttgagagacaaaataaatggaacacatgagaaccttccagagtccacgtgttgcttatgctgatttgttgcaggggaggagagtagatggggctgtgcccagtttctgttccggccaccatgggctttatgtggtcactgcttggctgggtcatctttgctgctccattgtccttggcccttcagtagaaccttgtcccaccaagacctgtgatcacagggagttggatgtcacctagggtggtccctgcatacaaatctccttgtggtatcaagagacaaattttcagacctgtccaggtcttgccttcctcccagggctttttcctcaattgtattttcgatttttctccaatctttttaaaggaaccagattgtgacatttgcagagaggaggggtcccatagtttctcatcatgattaactttctgttggaactcctcttctgccctcctactcttcttcctgctctgagttgtagtaatcctagtgctggctccaatccaaactcatagatttataaagcagagtctaatttagattcatatgtggttggaaaattgtacccataaggctagggttattgttcctgaagagaaatatatggttttgtgctgaagtgtgcaggagggttggtgtgggaggagggaggacacacaagcagccctggtgagaaaagcactggcggcatggatgtccatgtgaacttatgttctttagctgccacaaaacagcatttgccctgtggctacattaataaaggtatgggctttagaatagggaggtgctctacagtgatcattcattcaactgacatttgttgtctgctagggatatgactgcttttgcatttagaaagcatccttaaagtaaaaacagaaaaatttctggggttatggtgcatacgttctagatgcaggcttgtccaacccgcggctcgtgggctgcatgtggcccaggacaattttgaatgtgaggacttttttgcttatctgtggtgaacctgagtcctggagtgagtgcacccacctccctcagggtcaggagtgaatgctttaggaaccctccttttcagtgacctgcaaaagataragggcacatttactgtgataacccagagtatcagccaagggggcttgaccttcaaggagttgtggggaaggttaataaagggtggtgtcccagggtcagaaaagatgggcagacagcaagggcactgcttgatatctatgataagcatgtggaattgaggagcaagcttcagattcagaatccagtgactaaggacatatctatatccctaagagaaagaaccttgggacacgatgatggttacatgctgggacaattccatcagcccttctgcaaaggagcctatagccatttaatcaggagatgggataagtattaacattgggtgtgagctgacattgctgcccagattcccacagcaccattatgtcccccatcacactggggcttacagaggccagggaataaacctagacacattatgccccatggtggaatcaccagttccataaatcctgtcctggttatctccccattctctgagtgcataattggccttgatgcactggcaactggagtcaccccacactgtgtccctagtctggagagtaagggatctcattgtgctgaagcccaaagggaaacatccctcatccaagccaaaccagaagcaatattgtgccccagggtgggtcttgtggagggtactgcaggtattataggggtggcactgccattacagacctgaacgatgyggggtgktgttgggattgcctgttatctccatataactcagcaatctgtacctgcagaagcctgatatggctaaagaatgaatggaattactccagacttgaccaagtaggagtcctgattgcagctgccatgctggctggatatcactgcctggggagattaataaggcctcaggcacatggcaagcagctgtggatttggtgagtgcattccctcccatttcatttagaagatggatatggaatgattcacattcacatgggatttataatacatttattgatagcttgcatcagggctaccttaactcctcaaccttctataaatatcaccttaagagacctggacaaatcagacatcccacagaatactaaatctcttcatttcattggcaatatcacataaattgggaaggatgaacaacagcaggaaagtacgctgaattccctggcaaaacatgtgcactacagaaggtgaagataaaacttacagagcttcaagagtggccactgcagtgaagtgttatgggtccagtggttaggggcatgcagagctcccccccgccacacacacacacaaagtaaaagacaaacttgcatcttgcatcctcaccagaaggaaggaagcacactacttgatgagcctctctgggttctggcaacaccacattccacatctaagtttattgctttggctgacactctgggtgatataggaggaggccagctttgagtggggcctggactggaaaggacactgcagcagacccaggctgtggtgcagtcagtcaccatccctcagacccctggtgctggaggtggcggtctggggaaagaagcaggatggagctgaaccaagcatcagtgggaaagtcagaatgcagggcctgggatcaggagtaaggccatggagtccacagcagagaaacatgctccatgttagaagcaacttttagcatgttactggccctgataagatagaatgcttgagcataggacaccaagcaaccatgtgattccaagtgcccgtgtgtattggcttctatgtgacccatagagtcattcactggacaggcccagcggcatctatcatgagacgaaaacggtccatgtcggttgagcctcaattccatgttaacacccacagaaaacacccagtcctgatgtggccctgaataaccaaacaaattgaagacaaattgaagttagccagtctgcatcatggatcagcccaggcctgataggaaggacccgtgagtggagcaaccacagtggcagggatgaagctacaaatgagtccagcagcactgtctctccactaccaaggcccacccagctactgcttcctctgaatactctgctcgtgagcattgcagaccaatgataggcaccaatagggcaccatttcttaaagtaactgactagcccctaagtgacaagttgaatagcttgaacaccatccatcctggaaggggcagaagtttatcctcacagggataggctcacagggatgcgatgtggtgtggttttcctctctgctctcagaccctcagtcaacaacactattggcattcctgatccactggctcagaatttcagtacattatctgcctgggggacacacctgttggggaaggggatgaagtgtgggccctgaccatgggatcccctggtcgtatcaccacctgcgcctctcaagtgctgccaggcacacagagtcatggacaggactctacaggcacaactcagtaccagcttggatgaaaccctctgaggaatgggtgccatctttcaggatgtgatgcatgtattgaatcaaagacgtctctaaggcactgttttcagaaggaagaatacgcgggtccaaaaaccaagaagtcaaagcaggtgtgtctcattccttatattcacccccagggtgatttacttataagtaaataaataaatacataacatgaatacttaaataaatttatttatgcatgtatgtatgtatgtatgtattttattcattatattcacccccagggtgattttgctcttcttacttccaaaatctggactctgcagggtaggaggtcctggtttcccaaagagggcaccctggcaaggagacaaatgagagtccatggaactacacattgtggttgcacccagggatatttgaatagtatgtgcccagagacaagcaggtgagaagaggaggaggcagggctgctatcacacaatgagggcaggagaagtgtgtgtggaaaccaggaatccacttggggacgtcctggtttcccttgtccgttgtgtgagcagaatcatccagcaacccagcctgagagggtttgatattcaagagcccagaaccctcaggaaggaaggattgagtgatactcctaggtaatgtcccacgtctctgcttctgtgctctgacatcctcagcaggattagtgcagaagccctgcttccatgagttgttcccagccagtgaccggtcacagcaagcacactaaggcaggccattactgggagacatgggactcctctgatggccaaatgtggctccaggactcctccatgcccttcctcaactctccttagactgcctctgctctaggatgcgtcgaacagaccttgtctccttctgtccagcacttggggtcacacttgcatcattgtctgccgccttttccagggatttctggctcgcgtctcatattcccttacaggtgtgtcccctcataagatgccgtagactttaagctcatcttggcatctgctccttggaggacttggactaaaaagcattgccatgtgcacaccaataactcttacttattccaacctgtaaaatccatctctttatccaacttctgccacccccataaaatctattttgcgcgcgttcgtagtatctctttgaattaacagatatttgttgtattaagccactaaattttgaggtagtttgtgacacagcagttaataactattaaggctttcttaagtttctgttattccatggatgttatctacatcttttaatttcctgcattttaataatattagccacacttgctgtttctaatcctttcctcctattcttttttgaaaatgttcattttgtctttctctgtccttccatctttctttcctcctttcctccctcagagctttctccctccctccactttttcacaaactctatgtggttaggctaaaaagaagcattatttgaatcttatgcttaaagtataatgccataatttacaggataaaagtaaagaaaaggaaggtattaatggaatatgaaaaaatgcctagggtgattctgtagccaagacaatggttttttaacatgtaatctccaccttcaactgaatgttttcagaacacatgagcaacataagttctttcccattcttggtacaagcacttgggaaatcaaattagccttatcttgtatgattaatgtccatacactgtataatcccaccatctgctcctgatcatacactctggggatatctttggctatgtgtcccagagacgtgtacaccaatgtttatggcaaaaaaactggaaacaatcacatatgcatcaatgggaattaacaaaattctgatataattacgaaaagtaaaattttagcagtaaaaatgattgaacagcaccctcccacatcagagataactctcctacacataacatgcatcacagaagaatacatatagtgtgagttctctgtacagcgaagttaaaaaaacaggtcagactgtgatttgggtatatatatttattgtaaaaatctttagagacagtgcaaaggactagtaaatacaagactcaagatagaggttccttttggtggataggattgggcaacagtctagggtggcttcataggttctgtttcttatgccaggagaggatgtccaggtaattagttacttgatcataaatctttatttatttatttattcatttatttttgagatggagtctcactcttgttgcccaagcgggagtgcaatggtgtgatctcgtctcactgcaacctccgcctcccatgttcaagcgattctcctacctcagcctctgagtagctaggattacaggcacctgccatgatgcccggctaatttttgtatttttcgtacagactgtgcttcaccatgttggccaggctggtctccaactcctgatctcaggtgatccacccacttcggcctcccaaaatgctgggattagaagcatgag

SEQ ID NO: 10589 - DNA, 12972 bp, Homo sapiens
tccttctgctggggatcctgataagatggcaccttaaaactagccaaattagaatcctaacaatcttctgaactccagtacctataactgggcttgcaacctctcatcacacagccacataaattccctaggaagtaaattcatttacaatggaagaccaaaaatttttcctagacctggttgtcagccaaagtcctacaatgtgaaaagagttagatactattttactataaatatcacctgaaatatttcaacagttattgggacttaaatttaataaaagttttcatctcttcaatgatgaagttgttgtttgaactttctttgctttggaatttattaacaatattggggtactgggatttttcaaaatatcaacatgacatgacactatggtttttctgtacttttgctcttttaatgatgatatttaacagcaattttcctttgttttaccattaaatggtccaatattttgcagccaagacatatgattaaaggaacttgacaacatttaggaactgtttcctaaggtcctctcatgtgcaaagtggtgggctaggtattccaacagattgattcagcttcttgaggttttgccaaatctattcattcatccattcatatatgaggttgtatacaattatttctgtcctccaagatatacaaaagcataataaaaattgtgaaagaatacaaacacaagattacagagtaatagcacgtaacgaatatacacatttcattcaaggtctaggctcataactcccatagcccttttattgatgttagggcactttacacttcagaagcaggcctcagaaaacagaatctctctctctctcgctctcgctcactcacttgctcttgctctctctctctctctggccttctccccacctcttttcacctgctccttttactcctcaaggcaagaatcttcccccactgttcttggcactggccatcaagatattctcctacctaccttgcctgattgtaggtcataagatccccatttcagaagaggttctgccccatgccctggaggaaggaaggctgcatagagagaccaagaaggatctgacagacaggtttcatcactcactctactaacattagatcatactctttttgtccaatcacgtttctaatggttgtccatcatgcccatccactgaagtccccgtaaaatgttcaaaaaaaaaaaaaaaaaaaaacccacagagtttgaggagcttccagatagctgaatgtgtggaggttcctggaatgtgctgttcccagagaggttatgaaagctcctcataccccttcccccacacctcaccctatgcatctcttcttctgtgccatttgtaattgtctttataataaaccaataagctaaatgtttccctgagtcctgggacctgccctagcacattcatcaaacttgagggtgtcatggaattcccaatttatggctggttggtcagaagcacaggcaaaacaacctggagcttgtgcttggcactggaagtagggggcagtcttacagaactgagccctccccctgtaaaacctgacactatcaccaagtaaatagcgttagaatggaattggagtggaaaacatgcagctggtatctgctgcagaatttatttccttgcttcttgatggggagaaatccccacacattagccacagaaatcttctgtgttgattgttgttgagtgagagagtagaaagaacatttgagtgtgtttttttttccttctacccaatagcataagatgtaaaaatagcttatgctattgggtagaagaacaaaaagctaaatcaagactcctgagttctagtcccaactttgtaactagctatccatgaatccttgagcaagtcccttcacttgcctgggtacctatttctaatttgggaaatgagagaattgagtcattactgacaacatcccttccaggcataagagggtagataatttcctaaacaggctacacactgaccagtaatagcttcagatgcccaaagaggaaaaaatatacagtggtcaaattatgttgtatgctttatcacctttttgcaagtttataaagccacactggaatattaaagggactgagatggcctgcaataaataaagctctacaaccagtggccgggctcagtggctcacacctgtcatcctagcacttccggaggctgaggcaggtggatcacctgaggtcacaagttcgagaccagcatgacaaacatggcaaaaccccgtgtctactaaaaatacaaaaattagccaggcgtcatggcgggcacctgtggtcttacaggctgaagcaggagaatcacttgaatccaggaggtggaggttgcggtgaaacaagatcgcgccactacactacagcctgggtgacagagtgagagtccatctcaaaaaaaaaaaaaaagaaaaagaaaagaaaaaaaaaacaactctataaccatcactcccaaactaacttagccagaaaactctctatttttatgttacctgttaacaccctgtaacacaaatactcctcaaaatatactttgaaaaatgatgaaagggagtatcaactgatgtttttataatacctgtataatcttcttatgtattgtgaagcagaaaataaatgttcactgcaaggatggatttaaatactgtcactgttcttattctaattttcagagagagttctagatgaagcaagcattaaataaaagacgcatagtgaggctttcattccaagggataaaatcttttgtcattaaatcaaagtggtgagccagtgcctgggggtagaggggtatgggaagtgattgcttaaaggtcatgggggtgttcttctgcgatgatggaaaagtttttgaagctagagagagatgatgttgcccaatattataaatatactatatgtcactcaattatacactttaaaatggttaattgtaggttatgtgaatttaacctccattttaaaaaatcaaaagaacaggacctctgctagcacaactttaaaagaattaggaaaaggcaccactttggagaagatacagacagaggagtgcacagtttgttgagcctccagcttgatgtaagaaataatatgctccttcctctgagtggacagagccacacatcagggcgcgacctgtacatctatacacaatggccctacaatgtagtcaacattttattcccctcatttagagctctgttgtctctgagagggtttaggttggatgtaccttttaattaaaaggactttggctcagaagcaccccaaaaaatcctggttggcattcaggagggaagagatagatcttgtgacttggcttaggataaaagttggtagtaagaggaggtccttgaagtttatgtgttatctggtctagattactaggatggaagcccagagcagaagcacagaagccctacataggaatgttgtattcatttgactggtacatcaatcatgttttatttctcgagaatctaagtaaggcagtcacaaccgaattagagaactagtaaaacggagatgaagaaattgggagaatccccagaacttgtaactagaaaaccagaaccatgatatcttaaagaaaaataatttcaaacattagtgtctgtgttaaaccaaagccacgttcaggaataacagacaaacacattctttcttcttatggtactggaatggtctacagcccatcacttaaatgaagtaatgaatgccagagggaatcagcacagtaataagaaatgtggtatatacacacaacggaatactattgagtctataaaaagcaggaaattcggtcacatattacaacatacctaaacttgaaggatataatgtaaagtgaaataaaataaatttcattttcttaatttacttagaggaggtaagggaatgttcagattagtcttcgttctgtggcacaggagtcaaattctcaagtaagtgtcataccttaaattttgcattgaggaagatgttgaaaatagtgccacagtagaaaagcccagaaagggagaactgatatgcaacgccactgtctccagtgctcttatcaataatgtatttcaggtcctcagatatctgagccttttgcaaaaggagatacatctgtttagtatcaaagattctgctaaatttagatctgaattaaatagctcccgagattgttgtcatgacacacccacgtatttcaagcatccaacataaaaaatattagctaatcaaagaatctgtgatgtagctttgcttaagaagaagcaaggaattcacaaagaatcatatcttttaaaccaaatttgatgtgggatttgaaaatatgtcttaattctgactcagaaagagttatgatgtaaactcaaagctgtcatttctagagaagcagaactaccacttggtgttctggttcaaaatccaagagtagcatcgtaacttgcatttctcagtaatgaacccatactccatggaggcctggtcaccttttattgcatctaaacaaaacctttatattcaccgtcatcagctgtctcattcaaattatataaactttccagttcactggattagtctctaatatctataataaactgcatacagccgatctaacactctgtagtaaatcacatactccagtattaatatgttaaaaactataattttatgcagttaaaaaatctaaatctatagaatatcctaagataaaagatgagacaaagtcacaagaaggttaacttttttagcacttaagattttcttgaactgtgcttattatgctgttaataaataaataaaatctctaggaatggctgtagtaaactgtgttattacttaccctaagctctcccttccttccttttactctcaaaaaagtccgtaagaaaggaagcaaatttttacggcttgctttcaccattggaatttccttagaatgactttttacataaaaaaagaagaaaggaaagaaagaaaggagaaagaagaaaaagaaagaaagaaagaaagaaagaaagaaagaaagaaagaaaggaaggaaggaaggaaggaaggaaggaaggaaggaaggaaggaaagaaagaaagaaagaaagaaagaaagaaaagaaggaaagaaagaaagaaagaaagaaagaaagaaagaaagaaagaaagaagaaaggagggaaggaaggaaggaagggagaaagacagagagaaagagagaaagaattgactatagtgtttaaagagtttagtctggaatcagaggttgtggattcaaatttcagattcactagatactagtgtgaactagggtaagttacttcaacctgttgtggctcagttttctcacatggttgatgggagtggcagtgatacctagcccatagattgccgtgaaaattcagcaaattgatacatgcgaagtactcagaactatttaggcacataatcagtgatgggaaaatgttatcaatagcaattaatgcaaatctcccaggcccaagaaagcatccctttctggccagctgaatatagtcttgcttcacagtcaaagggaagataagaaagttagagaaggagccacagttaaaattggagggaattaaactgtcatgtgagacccaatcacccagttgtaagggtcaacactgagtaatattgacaatccttaaaggtgaggcatcagtcaattattccttgaccatgaggaaattttaagaaacatgaggagttagggatcatattcctaattaatgccaatgacttcttgaccatggtaaagaagcctaattgcagaccaaatacaatcaactttcaaaggctctcagtaggttcaacaaataattcagggagaggccaattatcattcagagacaaattatccaacacaaataagcaagagacttctggaattatgtaaacagtagctggcccaggcttataaaaggcccaatgtggcagccatcaccaaaactcagaaactcctccaagcaacccagacttcatascagctcccaacaccatgacctgctgccagaccagcttctgtggatatcccagctgctccaccagtgggacatgcggctccagctgctgccagcmaagctgctgtgagaccagctsctgccagccaagctgctgccagaccagcttctgcggatttcctagcttctcaactagtgggacctgcagctccagttgctgccagccaagctgctgtgagaccagctgctgccagccaagctgctgccagaccagctcctgcrgaactggctgtggcattggtggtggcattggctatggccaggagggcagcagtggagctgtgagcacccgtrtcaggtggtgccgcccagactgccgtgtggagggtacctgcctgcccccctgctgtgtggtgagctgcacacccccaacctgctgccarctgcaccacgccgaggcctcctgctgccgcccatcctactgtggacagtcctgctgccgcccagtctgctgctgctactcctgtgagcccacctgctaaaagccagtttgctgattttcaacttgaaatwtccactttcagttccattcatgaacgaattatttcttcaagcacttatggacaacgarcaaattcttcaacctttctttgtctttcttatgggggttaccaaatattttggcctcagaattatctgattcctttcaattccagaaagaccttactcttctctctgaggacgccaaaatacaaatttgacccaagaaatgaaaaagccgatttaccttgaaactgagcctttgcaagcattgaagcccacgctctgagtctcagcgccgacgagaccatggaagagccatctgtccttctcaggacactcacttcctgtatcccaccgtcctgcaaattgcaccccctatgaaagaggaataatataccaaggtctaataaattttaactattggtgcaacaaacatatcttttttttttcattgagtgtactcaggatgtatatttcatagaatgtcatatgaaaaactttaatctgcttttgatatcccttctcttctaataccacattaggaaatttgttatccagaggtccagtggaggttaatgaccataaaaacatagagtaagtgtagttatttagggcctcagaaatggcaaaggctctgttaccataacttaaccttacacagtgctttcacaaccaggaagttacagaaatcaaaatctctggctgggtacggtggctcacacctgtaatcccagcattttgggaggccaaggtagacagatcacgaggtcgggagtttgagatcagcttggccaacatggtgaaaccccatctctactaaaaaaaataaattgcatttctatatactaaccatgaaaaatctgtaaggaaaattttaaaaacaattccatcaaaagaataaaatacttatggccgggcatggtggctcatgcctgtaatcccagcactttggtaagctgaggtgggcagatcacctgaggttaggagctcaagtccagcctggccaatatagtgaaaccctgtctctactaaaaatacaaaaattagccaggcatgttcgtggatgcctgtggtcccagctactggggaggctgaggcatgagaattgcttgaacccaggaggtggaggttacagtgagccaagattgtgccacttcactccagcctgggtgacagagtgagactccatttcaaataataataataataataaaataaagaataaaatacttaggaacaaacttagccttggaggggaaagactcgtacaccagaaactacaaaatgttactgaaagaaattaaagaagacacaaataaatgaaaagacatcctgagatcatggattataggatttaatattgttaagatgtcaatactacccagagaatctacagatttaacgcaatccctataaaaatcccaatgatgtttttgcagaaattttaaaaaaatccatcctaaaatacatatgaaattagaaggggtcctatatagccaaaacaatcttaaaaaagaacaaagttggtctcacattttcctgtttcaaaatttactgtaaagctacagtaatcataacagtgtgatactgatataaagacagatatataaagcaatggaaaagaacagagagcctagaaataaaccctcaaatacacatatggttaaatgagttcatttatttatttatttgaattgacaaaaattatatgtatttattgtgtacaacacatttttttggaatatgtatacttcgtacaatggctaaatcaaactaattaacatatgcattacctcacataagtttttttgtagtgaaaacacaaaatctactctcttagcaattttcaggactgtaacatattgttatgaactatagtctctatgttgtacaatagatctcttgaatttattcctcttatctaactgaaattttgtaatcctttgaccaacatcttcccaacacactccaccaccaccctacccccggtaaccaccattctactttctacttccatgaattcaactttttcttttttttgaggtttttttgtttttattatactttaagttctagggtacatgtgcacaacttgcaggtttgttgcatatgtatacatgtgccatgttggtgtgctgcacccaataacttgtcatttacattaagttccacttgtaagtgagaaagtgcaatattagtctttttctttgtctgacttatttcacttagtataatgttctcaagtttaatctgttgccccaaatagcaggatttccttcttttatgaccaataatattccagtgtgtgagtgtgtgtgtgtgtatgtgtgtgtgtatcacattttctttatccactcatttaatgatggacatggacacttaggttgcttccatatcttggctattgtgagtaatgctgcaatgaacatgggaatgcagatgtctcttcaaaatactgatttactttccttcgggtatatacacagaagtgggattgcttgattatatgacagttctatttttaattttctgatgaaccttcatattgttttccataatggctgtactaatttacatttccaccaacagtgtgccagagttctcttttctccacttcctctccaacacttgctatcttttgtctttttgataataactatctaatatgtgtgagacgatatctcattgtggtttcaatttgcattatccgatgattggtgattttgaaaatttttcatatacctgttggcaatttgtagattttttttgagaaatgtctatttagattttttgcccatttttcaattacgttatttgttttcttactacaggtattgagttgtttgagtttcctctatactttggatattaaccctttatcagatatgtggtttataaatattttctcccattcagcggtttgcgtcttcactcagtttagtgttttattggctgtgcagaagctttttagtttgatgtaatcccacttgtctatttttgctgatgcttttggattcatgttcacaatatcacaatattggccaggcaaaagtcatggagtttcctctgttttcttcttatagttttatcattttgagtctttcttacatttcagtcttttaatccattctaagttggtttttgtatataatgtgagacaatggtctaatttcatttcttctgaatgtgaatgtggtcaaatgattttcaacaagggtgacaagactatttacaaatggttaagatggttaatgtaaatggttcataaattttatggtatgtatattttaccacaattaaaaatttgtaactataaacatgtgtaggagacccaaacttttctgaaatagaagatatatatgtatatatgctggtttatatttgcagaagcaaggataaaggtgtcaaagaatgtgcaccaaattcttaatattgattacctctagagcattagttttggaagagatgtgtgcatcttccaggaagggaaaagacactaatttttctttatatacctctgtactctttgacttgttacaatgtgtactcattactagcacatatgtttaatttaatagagtcagaaaacaatctacaagcaaaagtcattaaagattttagttagcaatttgtacattcactattactgaaggcaagaatattagatagagctctgaggatcctataacttgcacaaattgatcatagaaaggcatacttggtttgaaagttgatacatcaggttgtagttcatgttttgatgacactaatgttagtctttccaagtctggacaaattgtttataaaatcatgatcatagttaagtgaccatttaaggaaaaatgatcagttaagataaattctgcctaaaggttatcaaaggacaactatgacaaaacgtgccagggcgacacttggctcaaggctagtctgtcatgtgacttgcataaagaggcacttcggtgcttggcttccatgatgagccttcacttcgcccagagggcaaagaagaaacataatgagacttaattgtacaatggaaaaaggctattgaaatgctatttataactttataaacacctcaggtattagccagagactcacactgaaattgacatcaagaaaaggtgttgggtaaatatgcagctctagggaacatatcaaaggacagatatagaaggtacagcccaaactcagaaacctctcttaacacagctctcaacccaactcctgacaccatggccagctgttccaccagtgggacctgtggctccagctgctgccagccaagctgctgtgaaactagctgctgccagccaagctgctgccagaccagctcctgcggaaccggctgtggcattggtggtggcattggctatggccaggagggcagcggtggatctgtgagcacccgtatcaggtggtgccacccagattgccacgtggagggcacctgcctgcccccctgctacctggtaagctgcacacccccatcctgctgccagctgcaccacgccgaggcctcctgctgccgcccgtcctactgtggacagtcctgctgccgcccagcctgctgctgccactgctgtgagcccacctgctaaaagccaggttgctgatcgcttaagaatgaaaggggaagcacagcaaaattgtgctgatttctgaagaactgttcgattttacttggatgctaagtaccatgatgttgttaagctgctcagagataatgaaactcctagttaggacactgtggatgtgccgaattcacttactgaaagatgtatcaatcagtgttctggatagcttgcgttgcttgagcagaggaccaggatggaatagttcatcatttcagtgacatctctgctcccccaactctctcttgatgctcatgcatcttcagacctggtttttccttgaatatctctgattaatccaaataaaatgttttaatgtgcaaagcaaactgagttatgtcctccttctacctttaaacatgtcttcttgtagctggtattcaagagtggatttgcaatttgataataataccaaggcataaccataaagtctaaaccagaaagattaaatacaaagtaaattatgcttgaatccatcagcttaaaaatgctccatgaattaaagaatttttatagttcaaatatttacatgctctaatctattatgattaggtctagaccaataaaggttgacctttagctaaaatgttaaggttgatcaaagctattgatttctatctaaatgtaattctaccatcttttgtctccttccatttaatatactaaatgttctccttcatttatgccccaaaatctaaagaaattgcattaccttctaaatagatttaaaaatagctactagatactacctattttccaagagaatttaggtttaatttctacaccttagcctttcacattcttcccactgatccttgaattgctctctaagcttcaactcccactattcaccttcatttgatgtacgtatgcataaggtgtatctttggtctaaatgatagtagaagaaacagctatagagagcacccgctgagttctaccattgccatttgtcagacagaagtgttagaaatctgaaacagctcgattatattttgcactttgcaacccaacttaaaagatattctcttaagaagttaacacgctggacacggtggcttacgcctgtaatcccagcactttgggaggctgagatgggtggatcacgaggtcaggagattgagaccatcctgactaatatggtgaaacccagtctttactaaaaatacaaaaaaaaaattagtcaggtgtggtcgtgggtgcctgcagtcccagctacttgggaggctgaggcaggagtatggcgtgaacctgggaggcagagcttgcagtgagccaagatcacgccactgcactccagcctgggcaacaagcaagactctgtctcaaaaaaaaaaattaacacaacctagaacaaaacaaaacatattttaccatttaatttttaaattcttcattaggcattagagtgtaatacacaaaatacaataggatgcaaatatagaaagaaacacgttttccacattatttacaagctcccagaacttacctctatatttaattggtagcaatgatggattacacacaaaattatgcaatttccaagaggaataaagtagatggcagtacatttttcaaagtgtcataactcctagatattttttcccgagcccggttccactactaaatccaaaaaataaaataaaataaaccaaaaaacacatttcctagtctctttacagcaaataacaagactctttcatgagaagtactacagcttgaaagttctctttaatcatgtttgagtggtattgatatccatgaatcaagccttttactccacctattcaataaa

SEQ ID NO: 10590 - DNA, 19876 bp, Homo sapiens
ctctttcagagtgctcagtaagaatgctcttcgtatttgatgctccctgccctccttcaagccacctgcttccatacctgcctgtgcaggtagcggtgctcatattggggaaggggcttcccatccaacagcagctgtcccccggtgggctggtacagattctgcagcagggcagccactgtgctcttcccagacccattgggtcccaccagcgccgtcacctcgccagggcgtagggtgaatgtcagcccctagaggccagagaagcacacgataagaggctaccaaggcctctaaccttgagagtgtcattgccttgttacatagcatgatgtcttaccccagaagaaaaacagggaaatatagaaactcctaccctcccacatgcacagatttctgggtgatgcctccccaaggagtagagatagaagaagcrgcaaagacaagggcagagacccagcaccactatgccacacacttgatgtcagataccaccaggaaagggaaaaatcacattccaaattacaaaggaaaaggaaagatggaagaccgaagacacagattttgctgcagcaattccttggaacgtgagagcactctcttcgaaacctcttctctcattctctttggaagcccaaactgggttcttgagtttggggaagatttatggaacagatgatgcctaccattgcctttaaagggttagggaggatatatgcttggcagtaagcaggctgaaggcaggaagaaaatttaggatggcagaattgcagttggggccagtggaatacagggagtggtaggttgtacctgtagcactaagacatctgggcggtttgggtaggcaaaggagacatcttggaactggacaaggccctccaagtgtaagggagtcaacagaccactgggtgggcagcgaggggtgcggtccaggtactcaaatattttctctgaggagcccacagccttctgtactctggggtagatggagagcagtacctagagggaggtaagaatagtgaaagtgaggtagtctgcttgccagcattatgtgaagcaagaagggtaaagaatggaaggacatcacacagatggtgctgggccagaggaaggaatcacactggggagtgaaggtggagggacctcacctccamagcctgggtgaactgcatctggtagagaacaaatgtgacaaggttcccactgcttacagccccactggtcaccagctgcccaccaatgtagaggattcccactttcagcagcatacctgaaatctataaagagaccacaaaaaaagggactgaggtagagaaatctggaggggacacaaagaaccacagtcattaacctgaaggaaatatcaagtccctgtctcctaagtgacatcggcaggctcaataggcagacaggagaatgaaccagagaccccatggagtctgactcaatgcacatcatgcaagtcacagttatcttcaccaccatcaccactatcaccttgtctggggagcattttactcttcacaaaaggctttcattcatgtgatgtcagctaatacatgaagagccttataaagaaggttatatcactccatttttgaaaaatgaggaaacaaccagtcgggcgcagtggctcatgcctgcaattccagcactttgggaggccgaagtgggcggatcacaaggtcaggagattgagaccatcctggctaacacggagaaacctcgtctctactaaaaatacaaaaaaaaaaaaaaaattagccgggcgtggtggcgggtgcctgtagtcccagctactcaggaggctgaggcgggagaacggcgtgaacccgggaggcggagcttgcagtgagcccagatcgcgccactgcactccagcctgggcgacaaagcgagactccagctcaaaaataataataataagtaaaaataaacaaacaaacaaacaaataaataaataaagaggaaacagtctcagagaaggtaaatttgttgtcatgatcacaagacaagtaaattgcatcatcaagccaggatcttcggatcactggcgtagctctctttccagtgcatcacagatgtccctcatccctggcttccactattcccatcactctcactaacaaatctacaaggtaccagcatgaagcagtcccaggtgcaagaatttatggckccckgcacttcccctgagaggcaaaggaaggccctaggactggaagacacgcatctctccaatccacatggttgggtggattttatgtaccatactgaaaggaagccacctagcatctttaaagagagggagggggctagggacactgagtagagtcattgagcctcaggttgctaggacgaaaatactgaaccaaccatttcccagtaaaggaggagtgggagcagggtcataggaatgggaatggagtcacggcatcttaaggacaagggaatgggtattcatcttcaggtgctcacactagtggtccaggagttgactgcataggccacagcctccttctggttgagtgtctttatttcttgcagcttttccctaaacttctgggcttcgccctcctcgttggcaaagcttcgaactgtaggcatggccgacagarcctcaatggccacctggctggactttgccagagattcccgcacctgcacttccagcaactgtggatacatggacaagagatgtcacacgggttggcaaaccatcagggacactaatacctgagttacctatttggaaattaaaggtgagaagagacagaggaaaaggagaaaagagaaagagacacagctatgccccttggatgctaaagaaatacraggaagaggaaaatgactcagaacgggttggggatcaaattcttaaagacagattgtggggagaagctagaaaagaagacccagagagtatggaggttaatgttgagcaacctgggaacatggaccacagggacagggtgttccatgaagatggagaatcagtaagggtgccaggaaagctggactgaaagcaatgtgagaggaactgagtctgccaagtctgggagatgagggtctgtgtagagcgggccaactccatgaacatacctggtaccattttcccaccttcttgggcagaaggaaaagcagaggcagggtgaycagggtgaccatggtgagggacactgatccccagagcatgatccccaagagacataggcctcgcaccaggtaccacagaaataagctcagattctcactcagagaatcactcagggtggacgtgtcctctgttacccgaracatgatgttacctgcagggttggggagaagagagtgaggtgaatcagacaggttccaagtgatgagacgaactaacaatgagccaggatgccagggtcaggggtgtcaacatggggttctaaggaggctgcaggaaacaaggttagggttctccagaggtctgcaaatctcagtgcagggaagatgagtgttaaagaggaaaggcctgaccttcattttaattataaagtcattaatgcacatgtgaatttccattttcctgaaagctttctgttccctagagaacctgtatgtcccatgctatacacacaggcaggaagagcttaaactggtcacataacagagatggaggaggagggtgctgctaggaagcatgccaaagtctgtggagcactcactgggactagggttctaaccccaggtctatctctagccatatgtaactgtacagcttctagtgctgctagaaagcatgccgaagtctgtggagcactcaagagaccagggttctaaccccaagtgtgtctctagccatatgtaactgtgcagtttcagcatttagggtcttggcctcagtttccttctctgtcagatgaggcagttggtctctatgagctcaaaatttccaggtttgaaattctatggtttctatctaaggatacataggaatagatttataagaaaatgctagatgaaaactctaggtttttcttaaggtaaggaggacaatattttgctcctgaggtatatcaagaatgagaaaaacaattgtgtgtgtgtgtgtgtgagagagagagagagagagacagagacagagagagagagacagggagagggtatatcaagaatgagaaggaacaatgtgtgtatgtgtgtgtgagagagagagagcggggaggggggagatcaaagcagatgtatgaggatatgaacagtacatggcgtataaygaaagagtttcaggagaaacctgtctggttctgttggaaaaactccgtctcctggcgcaggacagccccaaacacctctccctgcaagtggctgtgcacgtgrcccatggtgttgttatagatccygtcacccamgaactccagcactgcactataaagaacccggaaaaaaaggggatcagggtgtgttcagggaacagactgaaggtcccaggtatccccatataagtgcatttcggacagcagccccaacttccaactccctcatttgcagggtgccccattttcagcccccagacctggctatggtgagaatggacatgagagttaagtttcgagtgaaggtatcggctgagccatcttgtagaatccagtcagtgaggcggcccgtaaagaatggaatggccatctcccctggagaaagagaagagaggtcacgcacaaatattaagtctaagtaggtcagttccagtcagactggccccaccacgcctcctccccctcaccattatcctggagggcatcagcagaaaggaaacactgacgtctcaatcccgaacctaaataggctgccctggaactcactaccctgtggttgctctaccagaactttcaggattttattaggaaggctggagatcatgaagtagaaaagcctcctgttagagatgaggatgccccgcccttcggccccagagcaaaggatttccccgcttccggcgtggcccaaagaatcaagacccggtcagcaatggagcccagaacctctggcccccgccagtccagtgccgtttcttctacaccgaagtggtgttccaagacccacgctaggagtccttctcctgctccacatttcccagaacccacgctactctaccttactgacaattacctttgattcctgtcccagtccccttgtgtcctcccctcttgccctgcgttccccttaccaagagaggasaggaccaccaggaccaggaacagcgagaggcggcgcgtctccgagcccaggcagcctagaagccgacgcacagggtttccagagccgccctgaccgccgggcacccagaggctcccgagtttgtgccacagggctgctgcgggcagtgccgctgcataactgacracgaaggcggtagggtgacttccccagtgcagtagcctggtgctatccgcggacccgggggctccccatgagatcagctctcggaacaaggcaastcccggcagggccaagcccagtgccgcagctaatggcttcaaagcagccagccagccctgggcacctgcgttttcgctcttggagccaaccgttgccctgaggaccccgcaggcccccagccagagcacggcccagcggctcaggcccaccgcccagacccggagcagtggcagcgcggtgggcaccagcagggagaatatgcggggcagcgcggtccggagcagcacccagtcggcgagaagtagcagtactgtccccagccatgcgagagaagctccggggaggcagcggcacccgcggggagcgggacacctagagctagccattggcactcggacgccgtccyggtcccggccgggyctgggactctccgcgccccggtggggcctgaagctccgggtaccgccgagtcctcccctactggcggctgggggagggaacgagggcggggctctcggaaagtcccaggaacaggctgatcctgcgctggcgagaagctcagccatttaggggaaagcgaaatcgaaagcggccgcctgctcactagataacgcctacttccaaaagtggcctgcccagactattttggtagcaagcgtggaaatcagatctgagaatctcgggagcagccctggtgcccaattttctccatcacgcacacccttctcgcctctccctgcctcctgcctttccacttgcaccagttttcccaccccagcctcagggcggggctgcctcgtcacttgtctcggggcagatctgccctacacamgttagcgcmgcgcgcaaagcagccccgcagcacccaggcgcctcctggcggcgccgcgaaggggcggggctgtcggctgcgcgttgtgcgctgtcccaggttggaaaccagtgccccaggcggcgaggagagcggtgccttgcagggatgctgcgggcgggagcaccaaccgrggacttaccccgggcgggagaagtccacaccggggtaatgggtctgggcttgagggttggcagaggggtggaggagatgcagcggccaggggaccctggaagcgcgcgcggagaagtgaatgcagagaccaacgggagcgcagggaggtcgcckgtagcagccagcgcttgcaacccgcaatgagcatagagtatttcttttctgagggggktcgtctagagtgtccgtgaagggamcaggcacgcgaggctggtggaaaaagsgggtgctttgactcttagctggaagcgtcaacgggaagctactctaaagcgctttcgctttcactctggtcccggacagtgggggctggttaaatcaagaaagggggttggggatggtgcaaagagatgaggaaatggtgccctgggtgaagtagaacagcacttgggagaaggaaatataggcacttattgagaaggaccaactcatcacacagacttttgataaacttgccactgggcaactcttagcccaagcactgataatgggcgttctgtgttaactagtgatgcccttccctagcttgacccaggaaggcctctccttggcccagatgctgccttactcccttccctgtgtcttccctgcccactcccatgtgcccactggggggactttgcttaggatgggcgcctggggcagatggcagccccaagactggctggctggcttctgctctggactactgccaccactcgtggcttgggggcggctttgttagagaggaatagcctctaacttgaagttaaccctgttctttgaccctctattcatgataagtcggtccgtcggaaagcatactcagaggagcgtcctttggggccagagtaacttacggcctggtaagaaagacacagtgaaaccacttataatttgggaaatctcccctcactgccaaatgagcagtggcaagtaggaagtagaagtggaaacaagggataagagttagacctgaattttagtcccaggtctactattaactctgtgtgactttgcataagtcgtttgcattttctgtgacttggtttcctcatttgaaccgaggatctttaaggctccttccaactcaatagtagaataaatgtagctttatcttccctcacttcttcttgattcttttcttgacctggaaaagtcagcttaaacttctcagtcaaattatctcttggtacaaatttaccyccctggctgctgagatatgtatttacctcttgatcggaaattccataactgaaacttttattttcaaccatctgtatgtgttccttgctgcttctctcctgccttgcccctggccatgctaaccactgccctcctcgattttttccaatgttcagtaaattggaagagctcacttctgatgaaatggggggtgagagtggaggattgtggaccaaaaaaaaaaaaatagactgaccttgtttcccaagatcatagtcaattactctgtgttgggtctacaccacatctgcacatactatgagcccttccrttggagataattttcacttgcggagctgcttcacttctacctgtaggagcctcatctccacctctctacagtggagaggattccactaggcaagttggaacttagggacacagttctttctgtgttgtatcacagctgggctgtggcattcccctgcagccggatgaagcaatagagaaagtggaaagatgaagggaaaaaaagcctgtactgacagtcagctctggcctgttactgtgtaatctttgagccagtcacttcgcctctctgggaatgtttcttcttctctaacatgagggcatcaaggctgttcttgccctgacattccatattctgtgtctctgcagaccaccatcatggcagtggagtttgacgggggcrttgtgatgggttctgattcccgagtgtctgcagggtgagtaaaagtgaagatgtatgcatttggaaagaagctaatggcctcaaatacacactttccttacccattcatgaaaagactggcaaactggagccttggaggaatggagttgaccttccccaaaagccactatgataagctatttggtgggtgcttgggtctctgaatttgtggaggaggatctggggtctgaatgtgtatrtgacctgtcccagtagtgtacagggatgagtaaaggaatagggtctgagagggggacaggagatagatttttgagggtcttctttccatctgtgcttagggatcaaaaagatgattctgtcaagcagatayctggtttctcatttaccatatattgaactattttgtctcttctcccactcctaaccaatttcctcacatgcaaaatgagtatatggggttaggtcaatattactgacattatgttccatagaacataactctctcaagattgttaatagcaaagaaaattgatgaggcatatttttcttaccttagcattttttgctttgttataaaatctaagcctgaaaaataagcctaattttgattaacatctgcagtgattaataatatctgagatgattatttgcctcctgctttaatccaagcattaaacttcatgctattctcttgtcaaagaaatttgagagacattgaatgatcaccctcaaaaattcctgagttctggttgggtgcagtggctcacatctataatctcagcactttgggatgccgaggtgggcagatatttgaggtcaggagtttgagaccagcctggccaacatgttgggaccttgtctctactgaaaatacaaacattagctgggcttggtggtgggtgcctgtaatcccagctattcgggaggctgaggcaggagaatcacttgaaccagggaggcgaagtttgcagtgagcccaagattgatccactgcactccagcctgggtgacagagtgagactgtctcaaaaaaaaaaaaaaaaaaaaaaacctgagttttaacttggtgactgttgactccctcctgacagcgaggcggtggtgaaccgagtgtttgacaagctgtccccgctgcacgagcrcatctactgtgcactctctggttcagctgctgatgcccaagccgtggccgacatggccgcctaccagctggagctccatgggtatgaagctctggagttctgactccccacccactagagctcccccaacctgcatgaatccctgtacagtgtgctgttccaggagctggacactgggaaatggaaaagtcttgtttcggctcttgctggcacttgaatctgtcagtttctgcatctgtaaagtggagataatatagyacctcatgagacggttattttgagaaccacrttctatatgtgaacacagtttaaaagctgtaaatcactatcctgatataaataatcaggaagaaggtgatattgtgacccaccataatatcaggcagttaccatacgagaaatcaaggtcgttgggayggaagtaaccttatctgcttttccccataagagcagggtccttgcagccaaaagaaagttatgtgggtggggctgagcaaaagagtgagcaattgaaagcttcttaccagttggtggtgtgggactctggttcccctgtacatgtgggagggaggctgcagtttgagctattgcagttacagttttcaggggtcgtttagcagggatgatggtaacagtataggagaatgagacttaaaattctatcaacctttattcctaatatttccctcaggatagaactggaggaacctccacttgttttggctgctgcaaatgtggtgagaaatatcagctataaatatcgagaggacttgtctgcacatctcatggtagctggctgggaccaacgtgaaggaggtcaggtgagtttctcccaaagcactctctcctctgggcttccccactctcctgcagaggaagatggaagtcctatgtcattctagcaatgagttccaaggacactacctctgaaagcatagtactttggggatatgagataccagggcttcattgcagggtgcagagaccacttaatgtctcagtgggaaggaagggcttgatgawtctttaacctgaggatccctttcccaggtatatggaaccctgggaggaatgctgactcgacagccttttgccattggtggctccggcagcacctttatctatggttatgtggatgcagcrtataagccaggcatgtctcccgaggagtgcaggcgcttcaccacagacggtaaccagccaagtggaagggtacctggggagggctttgaaacatgggaaggaagtagattatgaggaacaggaagagaaatacaggggtggccatttaagttaatgccgggcctggtacacttttaagagtgaaaaggggcaggacaaatgcaaagctcaatggggytcttgggcaatacggataaaccagggctgttctgagtaaatcaaatgaggatacacagtcactgtgagaaccagtggtgtgctaagcacagtggctcacacckgtaatgccaacaatttgggaggctgaggcaggaggattacttgagcccaggagtttgaggccagcctaggcaagatggtgaaaccctgtctccacaaaaaacaataaaaaaaagtaaaaaaaaaaatgaactgggcatagtggtgcacacctgtagtcccagctactcaggaggctgaggtggaaagatcatctgagccggggagatcaaggctgtagtgagcggtgattgcaccactgcgctgcagcctaggtgacagagagagaccctgtctggagaaaaaaaaaaaaaaaaagaaccagtggtgtgctgaggtgtgctgaggctggcttgggaccactcatgagagcggactgttaaatagtcaaggatttgtgaactgcttagctatttgtaacttgcaattcatcatagcgggagcatttacaccacggacatcagcagatgccacatatggaagcctttttgtaaaaaaactgatttaccagcacaccactaaatatgccttcctggaagatgagttttgaggtgaaagtggtagtaggcatatggatggagggggagtaaaaagatttttgaagctaagccatcctctctctccctctctccaacttgaaaccctctgcagctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctaggrccaaaacctggtatggtcattgggaaatgagtgctcagggagatggagcttaggggaggtgggtgcttccctcctagatgtcagcatacactctttcttcttttgtcccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaagtgaggtgatgggactctttcctttaaggctaagactgacagataggcaagacacctacacacatgagaattagctaagactatcagcaaactcgcatgtaaaagaattcctttcataatgcattcattcatattaaagggcaatacatgaaaaatgcttaaatattttggggcacttgtgaatttcaaagaataatgacaataaccaaaagaagctacatttgtggcattggctaaatgttttataaattttatctcttaaaattcaaaccaaaaaaccccctgtaytcacacctgtaatcccagcactttgggaggtcaaggcgggaggattgcttgagcccaggagttagtgaccagcctgggcaacatagtgagaaccccatctctacaaaaaaatttaaaaattagtcgggtgcggtggtgcatgcctgtagtcccagctgcctgggaggctgagtgggaggatcgcttaggcctgggagtttgaggctacagtgagctgtgattgcgccactgcactctagygtgggtgacagagaaagamcctatcttaagaaaaaaaaaagaaaagaaaaagaaaaaacaaacaaaaaaaacacccaaccctatataggtaktattattacttctataggacacatagaggtttggaaagattaaatcacttgaccaaggtcacaaaataagttctgaggctgggatctgggattcagtcttattatatgcccttcctctaccactccctaaaacttctcattccctcaatccccatatatcatcttaaaatctgcaataaatagccccatacattcgttggcacttaggaaactgttaccagatggctgagtaactgtattaaaacaaatttaattctgcttctatctttgccttgcacttcctgagtgacaggagtgaactctcatatccttttctgtcaaaagatggtgctgaatgatttctaaggtagtttacagttccaacattcaatgccattttgctaacaagtgggcagtcaacaggcatattcaacagaaatactagtaggatctcaggctaaacataygaattcaaaactctaaaacaatcacatccccctggagtgtaaagaaaaaaatctaaaattacaaatgcctggagttgtttctagccatgatatttaacttatttgagattttaaatagcccatttttcccactgatcacaagtagaaattctgggcagtatacaaaaagcaagtactcaaggactccaaaaagtaaacaaaagcaggtggattgtgaagagggtcaaaactgggagaggggcccctcctggggagtgggttttcaatgttttccccttttttcctcccagctctgccctgacgtcaggcctcaggtgcagagctgcactgcgtggtagcacaagccctgagttaacaagagaaataccggctttctggccagaggaatgaagaaaaagggcccctgcrggcaggaatgtgtaggggaatctccaaactgagagtacaggcggaaattccctaattctgagtctgaaccctcaggagtaccaggttacccctgagctgcacatgcgtgtgacatgccttaagggcacagcaaagactttgagaactgaatgaagattagatcttttaaaattrgaagacttcggccaggcgcggtggctcrtgcctgtaattccagcactttgggaggccaaggcgggtggttcacctgaggtcaggagttcgtgaccagtctggccaacatggtgaaacctcatctctacttaaaatacaaaaattagctgggcrtggtgcctgtaatcccagctactcgggaggctgaggcagggagaatcgcttgaacccgggaggcaaaggtggcagtgagccaagattgcgccattgcactccacctggacgacaagagagaaattccatctcaaaaaaaaaaaaaaaaaaaaaattagaagacttcatttttctgtattggccaaataactgttctaatgcccttcattccaataaaaggtttgtagcagcttacagagataatttaaaacaatttttaaaagaagaaaacaacactgggtcagagagaaaatatggttaagaaaagtaagtgaagccaaggagtgaaactaatggaaactaatggacaacgtgaatatcttaaaaaaaaaaaaaagtggtgcgctgtcttatactggctagcaagagcagattgcaaagtattcaggatttttgaagacagttgttaactattggtaacttgatattgaccactatggaagtatttatactatagaaatcagcaatgctacaagtcagaagcattgtttttcttcagagagccggtttaacaggacacatatttatcagccaactataaatggataaaaaataattggctccaggccataggatagtgaaagcaaagaaggaaataaaatgaggtacaagattcataaaattcattttttaaaagttgccagaaaaccaaaaattatatataatagttcaagccacacagaacatttactcaaataggacatgcatcattccataaaggtaacgccaataaattccagagtatcggtatcttagaaactatctatattctaggccaggagcagtggctcatgcctgtaatcccaacattttgggaggtcaaggtgggcagatccctagagcccaggagtttgagaccagcctgggcaacatggcaaaaccccgtctctacaaaaaatttagctggatggggtgcacctgtaatcccaactagtcagaaggctagacgggaggatcgcttgaacccaggaggcagaggttgcagtgagctgagattgtgccactgccctccagcctgggcaacagagtaagacactgtcttaaaaaaaaaaaaaaaaaaagaaaaagaaagaaagaaactatattctgcaaccatactgtaataaaattagaacttgataactaaaatatacttaaaattgtaagtgaacaaatatatttatcagtaacatggatttaaaaggcagtcgtggatgggagcatcgctggagtccagaagatggaggctgcagtgaggcatgattgcgtcactgcactccagcctcagcaatagagtgggaccctgtgtcaaataaataaacagcagttataaagaaaattaactcttttagaaccaggtgttaaaaatgttacacataaaatatacatataaaataatattataatttcaaatacatttattagaacaagaaaagttaaaataaaggacctagaaattctactcaaaaatttggaaaaagagaagttgagcaaacctaaagaaatacgaagaaaaggagttataaagataagaatagaaagcaatgaaacagaaatagagaacaaaaaactaggtagtgaaaattaacatacttttgattccaaaagctgcttacttaaaaatatttgtaagatattcagagttacaacaaggccgattatggataaagggagaaaaaatgaataaacaaatacataatgaaaaagggggaacagctacagatatgacacagatataaagcatagagtgttatgaacaagtatatgctaataaatttgaaaacctaggtgagataagcaaattcctagaaacatttaatctatcaaaattagcacaaaaagaaatacaaaacttgactataccaatgagtattaaagcaatttttaaagttatcaatggcatctaataaaaaaatatatttttgaaaatgcccagatggtttcacagatgagttctatcaaacattcaaggaacatgaaacttctatattatatactttttccagaaaacagaaaaaaactaaacctgattagctaattttatcagccgagtgtaatcttgactccaaattgagttgtggaaaactcaaggaaaaaaaaataatagacccatttcaccttgaacacagatgggagaaaaaaataattatttatgaaccgaattcaacaatattacaaataataatactgggaggccgaggtgggaggatcgcctgaggccaggagttcaagaccagcattgtcaacatactgagatcctgtgagatcctgtctctacaaaaaattaaaaaattagccaggtgtgatggtgagcacctgtagtctcagctactagggaggctgaggcaggaagatcatttgagcccaggagtttgaggctgcagtaagctatgattgcaccactgcatttcggcctgtgcaacagagcaaggccctgtctctaaaaatatgtataataataacaataataataatgattatgctaataatgatacatcaagatcaaatagggaatccttggaatactagggtggttcaatataataaaacatattgttgctataatttaccatattcatagaaaagtcatttcctttgctcagtctattaataaaagacatttggtaaagtatatccatttgtgatttttgaaaaacagttaaggaagcaggaatcaaaactttcctattttggcaaaggttataatccaaaaaatctgtaaccactagtatacataacggaaaaaccttgggtatccaagacaagaatgttcactataattactagcttatcatagcactaaagcctatgggcaacataacaagaccccatttaccaaaaataaatttaaaacattttaattagctggcatggtggcatgcacctgtagtcctacctacttgggaggccaaggcaggaagattgcttgagcccaggagtttgagcttactgtgagctgtgatcacaccactgcactccagcctgggtgacaaaggaagaccgtatttctaaaaaataaaaaatacaaatacaactacaaactagcactagaccaacagtgactatgtaccatgaactgaggaatattattaattccaccatttgcatctgaggttaacaatatgtcaatgacttaaataacatcatatctctgagagtaatttctcctatatttccatgacaaatgttagataattttccattttttccattcaataaaataaacaggaaatataattaaagagttcaattgaggattgggatttagaaaggaaggcaggaattaagaataatccttagttctcttcctaatttgcacctctctcactgatacatatgtattattttctttttatgtcttttagaatctaataaacatgttttatattatataacaaactagaatatatggattatctttggtcttccttaccaagttcttaactctgctggctctggggcactggacataccatgtaagaagaaaaatgttttaactccattgaacttattcagaagcatcggaaattggttcagcaatattcaactttgcccagcaatgtttatgaaagtttcatatatagtatagtataagtatgtgtaatacagaatttatgttctcaaaaatgaagagataaagtatggagattctaaactctgttgacatagaagagggtggatttctcgaagaaacagccttctatagaaagtggcttgtatgagtcgggattctccagagaagcagaaccaataggatgttggcagagagagatttattttaagtaattggctcatactactgtggragctggcacggtcgaaatctgcaggtaggctggagacccaggaagagctgatgttgcggcttgagtctgaaggtggtccagaggcagaattccctcttccttggaggacctcagtctttgcccctaagaccttcaactgattggaagggccacttacattatggagggtaatctgctttacccaaaatctattgatttaaatgtaaatctcatctaaaaaataccttcactgcaatatctagactggtattcaaatgtctagaaaccatagcctagccaagttaacacataaaattaactatcacttggctcaaggtgaaacttccagatcaatgtggcaggagtgttgaggaaggaagtgaactcggttctaaccaagtaggacagccgaatcatcactgaagtgtggcactggcctttcgccaaggtaacatgtggcaaggttttaggttaggataggtaccaggcaaaagctgggtgactcgatggaggcttttgtgccaaccttcagagactggctgcgtcagactgccctcaagagcatacaaaggaaaaaaagacaaattaaaagcctttaatccaaactcaagacatgaatgaaaaactgtaaatgcctctatagcagttttaaaggctatcttttctcctgcaacccagcacagatatggctgagggtcaagcccgggggcttatgataaaggttatgaagttgtagaaatgtttgttgcatcatccaacagcagctgttgtgataaggcaagacccctggttgggatagaccggaccctgagatatgaaatagggacatatgagcagacacagagaagtctgagtgagaactatgaatcaccgcaccccctgagggtccttgctggaagaagcagactcaccgtattagttacctattgccatgtaatgaatgacacccgcttaaaataacagacatttactataaggtgttactgggacaataggggattttttaatatggattgtgtgtttgataatatggtatcaattttaagtatcttgggggtgatgacagtattagggttttgcaggagaaatgtccttattcttaaattatacatgacaaaatatttaggggtcaagtggcataatttccacagattactctcaaattgtttaacaaaatggttcttcaacagtaaatggataaacaaaacgtagtctattcgtgcaacacagtactatgtaaacaatgaaacttcatcaactactgaaaatgtaacaacatggacgaatctcatagaaacaatattaagtgaagaagccagacttgcagaaatacatactgtatgtttccattatctattgctgggcagcacaccaactccaaacttaatggcttaaaacaaaaataatcattttattatctctcatgaatctgtgaattactggactttaagagccactgatgtagtccatgaaccaaaacacatattcacggcagcyactccacccagcacctcacacctgtgatgtttactggctgcccatgggatttgaacacctttagagtactgtgaaatttcccctaccttttgagtcctgcctccctaaagtggaaaccagaaagctcacttcccctagccttctttgaagctagagcacctaagttccaccaattaaattcatccacctaagacttcagttacaaaggggccacaggaggaaccagggtgtgggggttgcagagcaccttttactgtatttatttctctggcaaaggtgacagaagaagcaactgtcttttggggaagcggtgggttttttccttttttttttttttttttaagtgaagttcctgaaacagaagtggtttaggaggtgtcttcagtggtggctgcagcaacctccaggtcctaacaacagaaccaacagcagcgtctagaagccatggggcagcagcagtggtgtggctcatcagacctgctctctgcgtggtctgaccctgtacatacatgtgcctctcatccgtagttccagcatttcctctctaaagtctagttctgagagaaatttctttggtagacttttcaaagttttatcaaactcaaagagggaaccagcaagaatacaagagccttgatccaaagagtatttgaaaaacagagctgtatctctctgtgaggaaataatttctaggctagagattcaaaatggctaacgtgctagagggcaataaaatcataaccttggtgttatcttctttaccgg

SEQ ID NO: 10591 - DNA, 26701 bp, Homo sapiens
ctggtgaggtgtggatggggtacagccttcagagagacattgtccttcccctgcactggccaccagggagtccaggttgactgatgggggagcatgagaaggaaagcaagaaccaaaccctctggggcaagggattccttagagaaacttctttgtctcccagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtatgtcaagggaacattctcctcacctgtcatttctgttttgttaggcatgagccacctgtttgaaacctttcccttcctcctcctagtgtcctctcagcagtattttttccccctcattctcaggctaccctctccccttttcttcttttccaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaracaggatcagggccattaggaaacaggtaataacaagaggaggaggaagagggaagccaaggagggattgcaggggactttcggagagcaatactggggaactgagtctgctgggagagactggactgyccccctccagcctcagtcttcccgtacccctccacatatttatgtttctgtttctagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcycggctgtcccaaaccccccattcacagcctcctcggcctggtacttgcaaggtaagaaggggagggcgtgtttcctctgacaatttgttctctttcattggctgtttcagctgctctgtctgaatattccacgtgccacatcctgtctcttcctttttcccacccattttatcctctaaatcctcctgtttcttttctcctgtactccagatctctttgactctttgtctctcacttccctgcagacaagtgtggccacacaatgcgatccagaagagatcatcgtgctctcagactctgattagctgcctccccttctccctgcctccagaatkttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtatcactgtctttttcttgtccttctactgttacagattggcattagctgtccccttgctcagggttagcccagtatccccggggtagtcccgctctgtcctttctagcctggcctttttttttttttttttttttttgtctcgctgtgtcgcccaggccagggtgcagtggtgagatcacagctcactgcagcctggacctcccagtctcaagcgataatgcctcagcctcccgagtagccgggactacaggcgcgtgccaccatgcctggctaatttttgtttttgttgtttgtattttttgtagagacggggtttcgccacgttgttcaggcagtacttttttttttttttaagtgcttcagccgccttaacgcactttactttttcacttcgtgcagtaggagtgagaaagccaatgaggggccgactcaaggttatttagccaatccaggcccggagaaagggggcggggcttcagtgggactgtaaggagctaggaagagggcgattagatcccaccaaccagctaatggtcacagctcagaggcggagcctggggaacgatacctggacccatcgccaatgggaaaaggcaggcttatagctttaaaggggaataaatgcttcggccgaaccaagtcctgagctcccagcggaggaggggacctgatcttttaaggtggaatgtggcgatgtttctttaaaggcaaagtggccgagtcggccgagtattgcccagcggcacgggcggggtgcccggctgtgcctttaaaggcggaggggcgggaggcggagcggaggcggagggcggagggagtcggcgcaagatggcggcgggaggggcccaggttgctgctctggccgccgagtgaggggcggggggggcccgggggcgcgcggcccggtaagcggggacgcgcgaggttggggggcgccttccgggtgggagaagaggccgaggtagcgcttggggcggagcgggggggggcggggtccgttgtgggcggaggtagacaaggggcggggtcgaaaggcccgatagtgggcggggcacggggggggtgggcctggaaaggggcggggctagagaagctggggcgaaagggggcgtggtcggcgagagagcttggggggcatagcctgaggggagatggagcaagcgttggttttcagtagcagagctgccctgccccctcccaaaaagtgggtgcaaaacaccaaaaaggtagattttggaatgtcaggctctcaggtaagtcggaaatagggtataattccgaaggaagccactccagcccctaagagcaccttatttctctaacctccaaggaaagggcacaagatttgtcagatacctgtgtttgctggcgctgccacttgctgtgtgaccttggataatctcttaatctttctgagctttagtttcctcatctgtcaaatggggttgagaggaatacctacctcactgttgtggggagttacacagataatgagcgtgaacatatttttgagttgtaacgggctgtgtcgttatgagatgttatcattattcttttctctttttcttcccagagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggscgggcctcagctaccaccaccatcactactgctgcagccacctctgtcactgtccctggtgctgggstgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtgsaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccarcacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgyggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagrgtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcgcccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtctctccccgccacccccgacttcccgtggaaattcccaactcggttctcatggaggagtgggtggagacaaggagggagtaagtcgtaggagtacaaggtttttattttttttaacagtgattaaaatatttattggtcatttacttggcttcccgayaacccgtgtgtttgctggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtrtcctggtgagaactggagaggatctacccgggtccctgcctggccagtggggaaacaccggtccccsaggcaccttcacctaaccagagcggggatttccaccgcccctcatgccgccctttggaggaaagtgaaagtgaaaggaggaagaggaggctwmatggctgaggaggtcgcagcgccatgaagtccctgtctctgctcctcgctgtggctttgggtgagcgaaccccgcgactcatcgcccaagaactagagggaagcggagggaggtggccccactggagccgatgccagggtgggagtggggcaggtcaccagacatacaaaccgctcctcactcgcgtccctatacgccaggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacggtgagtctctagggactcgccgcccccctacctctgtcgcctccaccgaaaccccctcctctttagatccggcagtgacctcaggcctcagcttcccctttgtaaagtgagtctcactacggggtagtctgtgcatttgaagttccccgaacgctgcccttccagcccctttcccggcrgtgactctacagctgcaacttccttctctacactcagaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggascctgttctcatcaccatggcaacaggtagctggggaggggaggtggagaagggtgggtagattctaagggtccagatcagccggtggtctcgctttatggacttgagcaagacatttcgccaatcggggttcagtttcctttttttgttaagagaggtggtttggctagaatgaatcaatctctaccgctccttctagccctcacccagttaaaaaaaaaaaacaaaaaaaaaactgcagcttggcagggggtagggggaaagcagggccgggcaggggggttactttctggtgtttcgaagggcggggctttgaagaggtggggtttcccgacaccagaccttgagagacttgtcaggtgatgcgaggtgggaggggttcagaagcagsagcgttttttctctgctcttcccagatctgtgtcttgctctgcaccctcagctttgcgggtcactctttcaaaacccagcactctatccccacctgcgcccacacccggcgctgcggcaatccgcaaagcaaaggctcttgcactctagcgcgttgaccttgcctgacagccccgtgtagggatgtgctgccgctctgtggtccgcaaacaggtgggctcgagtgggcggatggacgcggctggagattggatagctcctattgcactgaaaggtgcattgcagtttgaggcccaggagtcagaagcttttctaggctgrgacgtgggagggactgtgcagataattcaagaatgaggagagtctgacctggatatctgggagctctccctcctggcagcggaggcggggtattccggggtagaataccggtagagttcttagcttttctatctggattttatgtcagcgacacagcccgatggacagggcaaccccaaccaatccctgcaccctcccttccctccaccctcctgagaattacccacagaaccagggagacagacttgaaacccacgctgaaaccctcacctctgcctatacctccattcttagtctcaagcccccaccctggcagaagctgaggaacactgctcttgtgtagacagtagctctctctggtggggtggaatatttcctagggctactggctccaccgaggtgatgatgagaatggtctttgctttctgagtttgtttttccaactgtaaaatgtggatactatttcccagctgcttttcttgttgtgactatcaagagatggcactgtgttaatttatccattgattcaataaatactttttagcaccaagaatgagttaggactcagcagttctcagtccacactgttggaggtttctaaaatatactgaaacctgattcaatcccatgcttagcttggccgattaaatcagaatctctggggtggccctgggtgcccttaagggtcacaaagatgatctgatgtagactctgctctccaggaggttctgggcgtatttgccacggataatcctaatgtaaagtagaaagtgaaggacatgcagacagggagccctggaagtgcccgggtggtaagattgtctgtatttcacaaacaactggggtcaaagcaaggtgctgtgctatttatttatttttattttatttatttatttatttttgagacagagttttgctcttgttgcccaggctggagtgcaatggcgtgatctcacgctcaccggaacctccgcctccctggttcaagcaattctcctgcctcagcctcccgagtagctgggattacaggtgcctgccaccacacccagctaattttgtatttttagtagagatgaggtttctccatgttggtaaggctggtctcgaactcccaacttcaggtgatcctcccacctcgcctcccgaagtgctgggattacaagcgtgagccactgcgcctgcctgctatttatttatttatttatttttgagacggagtctccctcttattgcccaggctagagtgcagttgcagtggcatgatcttggctcactgcaacctccgtctcccatgttcaagcaattcttgtgccttagcctccccagtagctgggattacaggcttgtgccaccacgcccacctaatttttgtatttttattggagacaggtttcaccatgttggccaggatggtcttgaactcctgacctaaggtgatccacccaccttggccttccaaagtgctgggattacaggcatgagccaccacgccyggcctgctgtgctctttcttttcaagcatttctgcttgatcagggatttaagaaaatgaaagctgttgtactgatgtaaaattagaaatgaaatctctccagggtccaagatcattcatgattttgctaatatacatttatacttgtcttatcaaatatttttaaatgtttattgacaaatatgcttatttatttatttatttgagacagggtctccctctgtcgcccaggctggagtgcagtgcaggctggagagcagtggcatgatctcagctcactgcaacctccacctccgtggctcaagtgatcctcgtgcctcagtctcctgagtagctgagaccacaggcatgtgccaccatgcccagctaatttttgtattttttttgtggagatgggtttttgtcaggttgcccaggctggtcttggactcctgggctcaattgatctgcccaccttggcctccgaaactgctgggattacacgtgtgagctgcctggccccaaatatacttkttttttttttttttttttttgagacagagtctcaccctgttgcccaggctggagtgcaatggtgtgatctctgctcatttcaacttctgcctcctgagttcaagtaattctcctgtctcagcctcccaagtagctgagactacaggcgcccaccaccaggcccagctaatttttgtatttttagtggagacagggtttggtcatgttagccaggctggtcttgaactcctgacctcaggtgatccacccacctcagcctcccaaattgctgggattacaggcgtgagccaccacgccaggcctatactttcttaatatactttgtgtgtatagtgtttaattctcaccattcttttaaaatattatggagtcaggtgaggtgactcacgcctgtacttccagcactttgggaggtctaggtgggaggatcatttgcactcaggagttcaagaccagcctgggcaacataaccagaccttgtctctactaaaaattaaaaaaatgctgggcgcagtggctcatgcctgtaatcccagcactttgggaggccgaggtgggcagatcacctgaggtcgaaagttcaagaccagcctgaccaacatggagaaaccccgtctgtactaaaaatacaaaattagccaggcatggtggtgcatgcctgtaatcccagctactcggaaggctgaggcaagagaattgcttgaacctgggaggcggaggttgcagtgagccaagatcatgccactgcactccagcctgggcaacaagcgtgaaactgtctcaaaaaaaaaaaaaaaaaaaaaaggttgggtgtcgtggcatgtacctatggtcccagctactcgggaggctgtgttgggaggattgcacctttgatgggtgacagagtgagaccctgtctccaaaaaaaaaaaaaaaaaaaaaagagttaaactgtaaaacctttaggtcttgtttattatttttttaaattttttcttttaaatagagatggggtcttgctatgttgcccaggctggtctcaaactgctgggttcaagtgatcctcccacctcagcctcccaaggtactgggattacaagtctgagccaccctgcccagccaggttttgtttattaattctatggattttttttttttgagatcaagttttgctcttgttgcccagtctggagggcaatggcatgatctcggctcaccacaacctccgcctcccaggttcaagtgattctcctgcctcagcttcccaagcagctgtgattacaggcgtgtgccaccatgcccggataattctgtatttttagtagagacggggtttctccagtctggtctcaaactcccaacctcaggtgatccaccggcctcggcctcccaaagtgctgggattacaggcgtgagccactgtgcccagcctgtggatcttttttttttttttaacaattcaaaagtatgtttctggattttgacaaactaagtgaaattgcatactgtttttactctactgaacaattccatgaagatgagaacagtttaaccttataggcctcagaagctaggattaaaaagaacataaaaataattacaagaagaaaaagattacttctacctgaaggacctagacatttctgggaagaaacagcagtgaaagtgaccttcatgtacatggagtatttagatcaggggtctccaatcttttggcttccctgagccacactgggagaagaattgtcttgggccatgcataaaatatacgaacactaacgatggctgataagctaaaaaaaaaaaatgtgaaaaaatctcataatgttttaagaaagtttatgaatttgtgtygggctgtattccaagccgtccttggctgcatgtggtccctgggctggaggttggacaagcttgatagatgtttgggagaaaatgggaaagacaatgtaaactgaagggacctcatgaccaaagcaaagagatgaccaatgatgaccacttctactaggcacaagaaaggggttctatgtggctggtttgtagggtgcaggagaagcctggaagggtgggttaggggctgaatgttcaaataccttgaaagctgggctttgttctgtaggtgagagcgaaccatcagaagttcttttggagggcgtgttattctaaaaagcctgtttttattatgtacatatttattttttgagacggagtttcactcttgtcacccatgctggagtgcaatggggtgatcttggctcactgcaacctctgcctcctgggttcaarcaattctcctgcctcagcctcccaagttgatgggatcacaggcacccacaaccacgccccgctaattttttttttttttttttttgtatttttagtagagatggggtttcaccatgttggccaggctgctctcgaactcctgacctcaggtaatccacycgcctcagcctcccaaagtgctgggattacatgtgttagccaccatgcccggaaaaagcctgttattttacttgattcttttaaaagataggcaaaggtcagatctttggactagtgaggaaaatacaggttaaatgatttttccaagttaaccagcaagtccatgatagtgatgaaggtaatgaaaatagtaacagctaacatttatcaagtattttctatatgccaggccctgttctaagcactttatatgcataatctcacttattcctctcaacaaccataggttgtaggttttaatattatccctgtattgcatatggataaatataggacacaaaccagttaaataatttgcccaaggacacacagtgtgtaagaagcagagctagaggccaggcgtggtggctcatgcctgtaatcccagcactttgggagaccaaagcaggcggatcacctgaggtcgggagttcaagaccagcctgggcaacatggtgaaaccccatctctaccaaaaatacaaaaattagctgggcacggttgtggacgcctgtaatcccagctactcaggaggctgaggcaggagactcacttgaacctgggaggcagaggttgcagtgagccaagatcacaccactatactctagcctaggtgacgagcaaaactctatctcaaaaaaaaaaaaaaaaaaaaaaaaaagaagcagggctagaaattgaacccaggccatatagcttcagcctatgcctttatcagctgacttcctaggtatttgggatttttattttatttatttatttagttttgagacggagtctcactctgttgcccaggctggagtgtagtggcatgatttcggcttacggcaacctctacctcccaggttcaagtgattcttctgcctcagcctcccaagtagctaggactacaggtgcctgcccccacacctggctaatttttgtatttttagtagagacagggttttgccatgttggccaggctggtcttgaactcctgacctcaggtaatccacccgcctcaggctaccaaagtgttgggattacaggtgtgagccaccacgcctggccgtatttgggatttttttttttttttttgaaacggggtttccctcttattgcccaggctggagtgcaatggcacaatctcggctcaccrcaacctctgcttccygggttcaagcaattctactgcctcggtctcccgagtagctgggattacaggcatgtgccaccacaccaggctaattttgtatttttagtagagacggggtttcaccatgttggtcaggctggtttcaaactcccgaactcaggtgatccacccgcctcgkcctcccaaagtgctgggattataggcatgaaccactgcgtctggcccatatttgggatttttaaacaggtaggtgatgggatcagacttgtagtcactttgtttggctacagtgtgaagaaggagttgaaggagagactgagaatagggagaccagacaggagggctgttgtaattgtctaaacgtacattgatgagaacctaaattggaaacagatgtgagatctgttaggtcctggtggggatagcacatagcacattatttttgacaatttgcttgtctgtcattggactataggcaatttgagagcagggactgcttgtcttgttcaccattctgtcttctaccaggataccttgaacatcttcagtgctcaatagttgctgaatgaataaatgagtctgagtaactccaagggtttgcttttagtgtctggcgggcttggtgatcattcatcaaagacagggaagatgggcattggagcagggtggggaatgttgcagagatgctgttgacttggggtatgctaagttaggtgtaactatagcaaacacgtgtagacttactgtgttccagacagtgttgtaagcacccttcatgggtaggtgtctctgttatctaaaattgggaactgaatagacttgagtagcaagaggtattaatgatttaaccatcacaacaacctcatgaagtaggtactattattatcatcaacttttaattttagagattaggaagctgagccatggaaaaaggaagtggcccaaggccatataaataagctgcagaggggatttgaacccggtcagccaggctccaggcacttagccactgcactgtactgcttcagtagagcatagaggtctgtgctcaggtctaggctagagctggaaccttctagagtcagtaaatattctgtacagcaccacaagactgacagtcatggctcaatcattgtcttcgcctgtaatcaagaaaggcctggttcctcaagggtggtgcttggagatagagtggttcaggttgtgtcagaagtggcctcggattctgcagtcccccgagctagagtgtgctatgtgttcagagtaggcttcaaaggccataccccctcattgcccctactcaccacccctagacctctctgctcaccctcagccacactaggtgccacccagtcgcagagcaaaaggagtttgcagggagggctaggaaatggtgagtatcagaaaaggtgtcctctgaggggtgggtaaactgcagtttagccctccccaataactgcatttctctatttttttctccttctttctctccctcatgcccctcccaacccctcatctccctgtcttcctcagtggtactgactgtcctcacccacacccctgcccctcgagtgagactgggacaagatgctctgctggacttgagctttgcctacatgccccccacctccgaggcygcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctasagttcaaccctttcaggagggcacctatctggccaccatacacctgccatacctgcaaggacaggtcaccctggagcttgctgtgtacagtgagttgggggacagaggtctccaggggtagagggtgggcactggattgtggkkaccgtaatagggggagggatgatggataagaggrtgcctgggcaagtaagtagagatagaaagaggttcctgggagttagagggrtaatgggaggctagaagtttcctggaaatttgaggggctttgacatgggtatttctgtgacgcaccaatggagagacagtgggtwccctatttcaggagaagaaacctaaccttctttagttctgaggaagccagcaggcaaactgaggrtctcttagggaggacagtatggactgatttccctatgctcatttcgtcctctttccccagaaccccccaaagtgtccctgatgccagcaacccttgcacgggccgccccaggggaggcacccccggaattgctctgccttgtgtcccacttctacccttctggrggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtaagagctgggagctctgcggaatctgagccagcacccaggaagacaggagctcactctcaccccttctgcctgccaggtctttcagggccctcccttgaggacagygtaggccttttcctgtctgcctttcttctgcttgggctcttcaaggcactgggctgggctggtaagtgtcagccctaccctgaccatgacctgaggttggtggactttccccacctactcccaagagcctgacacccatccctctgccctccacctctaccactccagcatcccatcccttctcaatctttccccacagctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaattaacttaataatataccttatttaatctaataattctggtcccttatctgaaatgcttgggtcagaagtgtttttggatgttggattttttcagactttggaatatttgcatatatttaatatctttgggatcagacccaaatctaaacacagaaatcatttatgtttcctatacaccttatacacatggcctgaagatttttttccttctctttttttttgagacagagtctctgtcgcccaggctggggtgcaatggtgcgatctcggctcactgcaacctccacctcccaggttcaagcgattctcctgccttagcctcccgagtagttgggattacaggcacccaccaccacgcctggctaatttttgtatttttagtagagacggggtttcaccatgttggtcaggctggtctcgaactcccgacctcaggtgatccgcccgctgccttggcctcccaaagcgttgggattacaggtgtgaaccgctgcacccgaccacaatatttttaataatatatgtgacccatcacatgagggcagctgtgggattttccacttgtggcatcatgttggcactaaaaaaatttcaggttttggaacatttcagattttagagttttggatcggcgatgctcaacctgtacatccaaaatattattgcaacatgtaaacaatataagaaattacaggccgggtgcgatggctcatgcctgtaatccctgcactttgggaggccgaggcgggaggatcacctgaggtcaggagttcaagaccagcttagccaacatgatgaaaccccatctctactaaaaatacaaaaaattagccagatgtgacggcacctgtaatcccagctactcgggagactggggcaggagaatcgcttgaacctgggaggcagaggttgcagtgagctgagatcacaccattgcactccagcctgggtgacaaaaggaaaacttcgtctcaacaacaaaaaaaaaagaaaaagaaattacagtcttggccaggtgcgttggttcacgcctgtaatcctagcactttgggaggctgaggagggcggatcacctgaggtcaggagttcaagaccagcctggccaacatggtgaaaccccgtctctactaaaaatacagaaaaattagccgggcatggtggtgcacacctgtaatctcagctactcaggaggctgaggcaggagaattgcttgaacctgggaggtggaggttgcagtgagccgagatcgcaccactgcactccagcctgggcaacagagtgaggctctgtctcaaaaaacaaaacaaaacaaaacaaaacaaattagctgggcatggtggcacacagctatagtcccagctacttggggagctgtggcagaaggatcgcttgaatctgggagggtgaggctgcaatgagctaaggttgtcccactgtactccagcctgggtgacaaagtgagaccctgtctcaaaaaaaaaaaaaaaaaaagaaagaaaagaaaataaattgcagcccttttctcaccttaagtattcaaacacaggtgtttattttaaatagtcagcacatctcaattcggactagccacatatcaaatgctcaatagcctaatgtgggtggtggctgtcatattggacagcggagcctgagaggacttttaggaggattaaggaagacagtgtatctccttaagaagatgcaggagatacagcactcagcacagtgtctggagggcagaaaatattagcctcatccttctcccatcatctgtgcccatgatagtttatatgtctctaaactgaccatgtacacctcaactgccttttaatatcctgaattcctcaccaccttcctctcttccagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcamtcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttgagactgagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccrcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaaygcctgtctccccgcggatcatgggctcctcgaggacagggacyggcctgtctgtccactgctgtaaccccgcgccggcatagggacctaaggcccactggagggcgctcatcaagtagctgctggatgttgacgaaggaarcggcggcgcagctcagggatctccgagtcaggacggtcggccagasccacggggtaacgggtctaatcgtgtaggaataaagctgtattccagtgcttccaaacggttctctcattccaacccctttccaagctcaatgaatattccaatcacctctggtcccttccagtgaccctgaaccgctcagagaacgccccgtcgacaccgttcggggcgggcgccactactggcgcatgagatgcgctcaagcagagggtactccaccagcgaggatacaccgagccgacggggatctcggtctcggcgccggaagcctctgagagccgaatctggaaccggatgtggctgcttcctgccccgccccctgccgagggggcgggaatcgagggcccttcggaaaacccggccgggatttcggtcagctacattcgtgggttgtggtagggagggtaatcccgtggggatggagtgaccggctctctctccgcctgaaacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggtcagagcctgagcaccctgcgcgtccccgtactcgtgacctcctccttccccaacagcaccaagggcccccctattccacccttctgttgccccctcccccaaccttcctgcagaactcccttccggtcttcttgacacccacccacgtcccttccctgcccggttcccccgcgcctgcctgactctccacccccaccccaccccgtctctccccaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggtgagacgcgggtggtgggaggtagggggcgtatgtatttctgaagtctccacttttctcttgtctctgggtccctacatctcctcctccttgcctcagttattctcgcgcctccctgggtgtcggcccgtttctctgctgcggggagtcctggcgtctccgtggttctctgtcagtgtgactcaggacctgcccgcaggaacctgccctgttcctgcctggaacttctggctggctgtcctgtccctgcgggtctttggccctccacctctgcctgcctgagtgtgcctacctctctgagcagtcgtgtcttggtccctgtctccctccttgtttttgtttggcggggaggggtttgtttccacagtaaccagctcctctgactctgggattggggagggaaccctcagatttcgtgacccctccttccctctctcccccttccccccgcccccccgccccgccccggtcctgggtagaggccgggaagccacggttctgggacctggaggaaagatcctagggtgggtagagagtggtcatctgttttcattagggattaatggtggtggccaggagcaggatttcgggcctcaggaggggccagaatttggatttggggccccgaggccctaaactcctaggtccagatcctaggtgagggcaggttgactggcagggctggtttttcgggatcggtcgggggaggggctggggccacgtgactctctgagtctaccgcccccaaccccctatcatcccacttccccttttccttcctgtactgggattggagctgctaccttcgggggtcccttagggctgagatagtggaggcgctacccgagggaccagggtgaaaggggtcctgaaaaagactaattctctgggctggtatagtccttggccgggaggggcggggcatgcggcagtgcctggactgaggtttcagctacccctagtcgctgcctctggcttgctgcctctcgcttccctctcctgccctttgtaccctgcttctctgtcgtgtgtgggttcagctctggggagaaggggctttgggggtctccaggatcagaattcctgtactccatccacgcctccactgcagccccttcgactccaccggggccctgaggcggctggggtggggctgtctgggccccagtgggggagacctggggtcaccagctcccccaacccttcctcgcactcgctggtactatgccctgccaccacaggtgaggggtacagagggaggagcagggcctggggtgaaggctgagggcaatggggggtggtgtggaactgtctgacttccccttccttgctcctccaggcccctgtgtccgtctgggatgaggaggaggatggtgccgtgtttacygtcacaagccgccaatatcgacctcttgatcccttggtgagatcatgactttagcttctcacctctgactcttcattcccagttttccttcctctggctgactttctggccagagtgctaggttggagttctggagtcctggactctgctgtgtgacataggccaagactcttgccctctctgaatatcagaaaaatgagtctggaacatctcctgggtctgggattgtcctcagaaatctaggtgcagagtgggagaaagggttagcgatcatctctctgtgttctccaggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggtcagagtcataagggacgcagggtagtggagtatctgcccggatttcctaaagccgcaacatcccaccaaaatagtcaaagccactgagggtttgggaaaaatggacagatagatcctcttctccccctcaggctggaagcccttgaatctcatcctaccgacgaactagagaggacaacagagtgagtgacccctggttcttaatctcacagtcccctctgcccaggctgcagctttacctctcacccttggctgattcccttctcccagggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggtgagaccctgacctctggcccctatgccccctgaccccttactaacctctccttgactccagatcctttccttgcttccaccccttcctgatccagctcctagcctcctccacctaccattttgattctccccttttccctttggtcgttacccttcaaaccctgtgcccctctggttccttggccacctgagatcctcagatccctgatattggaaggctgacctcacttgactatgaactttaacctctgacctctaccctgcaggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggtgagagagaagattgccctacggtttgtggccatggaatggagaggcctcccatagccttagctctcttctttgacccccacaggagtgccggctgctccgaaacttctcttcagtttatgccgtggtgtcagccctgcagtccagccccatccacaggcttcgggcagcctggggggaagcaaccaggtgcggaggctgaggcattggactggggtgggggttcctcagaaggcggggaagagggggtgacagagccaggcctgtcctcagggccacttttctcccttccccagggacagcctcagagtcttttccagcctctgccagattttctccgaggaggataattattcccagagtcgggagctgctcgtgcaggtgagagcctggtttgtggcattcccacctctccttgttccctactgctcccccatgtctcttttattttgtcaccaccaggaggtgaagctgcagtctcctctggagccacactccaagaaggccccgaggtctggctcccggggtggggtgagtgactagcggggtggtgggcgtgggggtggtgattatgaaggggtgaggagtatgttttgggggagcagcctgaaggatgggtaagggaggcacagaggggtgaggagaatgaaatctgttctctgaggcaatgaggagggcaagtgcggagggatggagggccctcacgtcaatggcaggcacttctgaccctgacccctgacttcagggtgtggtcccataccttggcaccttcctgaaggaccttgtgatgctggatgcagcctccaaggatgagttggaggtcagtggtgtgtgtgtgtgtcattgcaatgatgtaacaagtgggctgcagggtcggacagacccccccgccccttgcaaggggctgtaaggcacaaatagctgagtgtgggacagagccagatctgtttctgtgccaagtcgcctcagtgatctgtaaatgggaaactagaaatagcatctacattgatctgttataagggttaaatgaatttgtatttgtcaagtgcttagaacgtgcctgaaacgtaagcacatctaggttttgtgatgggctcctgctctattgctagagtttgttaaataaacaaatactgagaccttggacaagttccttatcctctctggataaggaatcctgtcgaattggatactatccagtcctctcatctgcaaagcagactcgttgtctacctgagaaattcaatttaaagggtcaagtggagtgcttaggccatgatagattgaggaggaaggcagggagggatcgaagagtcagagaggctggagggaagtggttgtgagttggatgtggctgtgtgtgtttaagagaggggatattctctctctgtggccggaaggtagggttggaactttcaccccatccccattttcctcgcagaatggatacatcaattttgacaagcggaggaaggtgagcggagtgtctgggctggatgctggacttccctatccatgttccaggaaggggagggggaaaagtcaggggtccctgagttttggctcctgcagtttgagggctccttcccaggagtttgcagtcctttctgagttgcgacggctccagaatgaatgycgtggctataacctccaacctgaccatgatatccagaggtggctacaggggctccggccactkacagaggctcagaggtgactggcgggtgaggttgggactccagggttctggccaggtgtgggggattggtgtcatgtcctgagctctgcctattgcccccctaacccagccatc

SEQ ID NO: 10592 - DNA, 144021 bp, Homo sapiens
  misc_feature (1)...(144021): n = A,T,C or G, or insertion/deletion polymorphism (see Tables 1-2)
gcatttaacaaatgtgtattgcttgccaactatgcgtcaggcactcttctatgcacattattgctataattgccatgatctctatcatcttcatcatacgtctatattagactgtgaatttctcaaaggcagagatggccaggcatggtggctcacacctgtaattccagcattttaggaggccaagacgagaggattacttgagcccaggagttcaagaccagcctgacaacatagggggatgccatctctacaaaaaataaaaaattaggtgggcatggtggtgtgcgcctgtggtcccagctattagggaagcataagtaggaaggcttgcttgagaccaggaggttgaagttgcagtgacttacgattgcgccactgtactccagtctggacaacacagcaagaccctgtctcaaaaaaaaaaagcaagcagagacaatcttttcattgtaacaagtgcatagtaaatgtctactgcctgaatgaatgaaacagaggagagagttaatgaaagacattaaagaagattaggcccagttacatttatattcagacaaaaacatagaacgattgttctttaaattgtacaatgttattatattaaattttaaatgtcttccatgttttacatttgtctatttaacatactttttttttttttttttacatatttgtaatttttctttcttttttttttttttgagatgaagtcttgctccattgcccaggctggagtgcagtggcatgatgtcggctcattgcaatctcctcctcccaggttcaagcaattctcttgcctcagcctcctgagtagctgggattacacgcaggcaccaccacgcccagctaatttttgtatttttagtagagatggggttacaccatgttggtcaggctggtctcaaactcctgaccctgtgatccgcccacctcggtctcccaaagtgctgggattacagacgtgagccaccacacctggcccatatttgtaattttacaaataaaatgtatgactcaacatatttgtaatttgacaccttctgtctttctacttaacattaatgacaaacattttttagtgtttgttttgattttggtttttgtttgtttgtttgttttgagacagtgtctcgctctcttgcccaggctggagtgcaatggcacgatctcatctcactgcaacctccacctcccgggttcaagcaattctcctgcctcagcctcccaagtagctgggattacaggcgcctgccaccacgcctggctaatcttttgtatttgtagtagagatggggttttgccatgttagccaggctggtctcaaactcctgacctcaggtgatccacctgccctgacctcccaaagtgctggaatcacaggcgtgagccactgtgcccagccctgagtgtttctacattatcattatcttcatggctttctgtaatttagtaatttctcttatttttgaagcattgttgggttccctgtggtcactagcaatgcagaccctggaacaactggtcaggtgtttgtgcttcttccacaaatgacaaaatgaaggagcaccgggaaagtacatctcattctggaggaagagatggcaccacatgaggagcaggcagggagtcaatcccaggtgcacttaggagagaagaaaggcacatccacctggtaagccgctctgaaatgagtagcgtgcagggtgatgttgagctctattctgcagttcgatcaacatgcttctacctctcggccctcacatagcagcctgcctggctgccatctgccaagcttttgctttcctttctgttttgcataaggcttttgcttttaatatgctgctactgagtacagaaaaacaagagcgtaccagacttcagggatctgcctgtttcttttctgccttttaatagagcttagctcttttgccacttgttattgtcaagtacaacatgagttcagagaaagaacactgcacctgaccggggatggatgccacgccttgaagaaattggcaggaaacagaagaggtttataggatcttctcttctgccactcccatcttggaaacaagtggaagtacatttgcaaaattatattgaaaaaaatgagaaaatgcatttttctttatagtcaacccttctgacatggacctagtttcaaatgaagttatgaggaaatggcccttatgactaaatgttgattcatgtgctgtgagctgtgaacccaggatgagaaatgggaggaaatcaaactaaggaatggaaagggggaagtgctctgggtgccttgcctaagagactgaaccctcaaatcttggaaataaaccatattttgtaaaccagataatttagacttaggttattttgtgtgtctcttatttggtatcatttatcaagttatgttttaaaagtctatagctttgggctataacatatatgcttaggccagagtttaatggggatcaacagcatccctggaagcctatatctcttcagcaggtatcgagagagatcctaagagaaagatgattctggtagcggtgacacccaaaaatcaaagtccaaattgagtaggggctcctttccaacaggcaatctcttgctacagtaaatcttggatgttatttaaattttattttatttttatttcacaaagtacactaaggccaggtgtggtggctcatgcctgtaatcccagcactttgggagaccgaggtgggtggatcacctgaggtcaggagttcaagaccagcctagccaacatggtgaaatcccgtctctactgaaaatacaaaacttagccaggtgtggtggcgcatacctgtagttccagttactctggaggctgacgcaggagaatcacttgaacctgggaggcggaggttgcagtgagtcaagattgcaccactgcactccagcctgggtgacagagcaagactctgtctcaaaaaaaaaaaaaaaaaaaagtactctatcctttaagaagtacactcaagcccacaagaattcttttgaatatatttaaagtaacatgagaaaattaaataaaaaacttaaataatgatattttctacaaactctaggatcaagcaccaattaaagaggatgagtaggctgggcgcggtggcttatgcctgtaaccccagcactttgggaggcccacacaggcggatcacttgaggtcaggagttcgagaccagcctggccaacgtggtgaaaccccgtgtctactaaaaatacacaaattagtcaggcgtggtggtgggcatgtgtagtcccagctgcttgagaggctgaggcatgagaatcgcttgaacctgggaggtggaggttgcagtgagctgagatcgcaccactgcactccagtctgggcaaccaagcgagactctgtctcaaaaaaaaaaaaaaaaagagaatgtgtaaaagataatggaattattacatattcaaggtctcatctaccttgacatttctatgatagatgtcatcattcattcattcactgaacatttactgactcttaagtgacaggtattataggcagtgacttgtacactgttgttatctatgttggtttttaataatttcaaaatgaaatacattttgataagcaaagtctaagagagtgtggcacaaacactttaacgcatataagctcggtggctcatgcctgtaaccccacccagcactacccactcaggagcttatctatgctctgccagaatgtatgttcatccctggaaacctcacttgagagtgcagaaggaggctgataccatccacgctcttcctatactacacagtcttgtctgaaatttagtcaccttaatcactgtttactataaagttccacaacttaaacatcaggcaattacaggatatggtgtttcggccctaatgaaccttgcaaatacctgaaatactcagaatacttattttcattccagatctactcctaaatttaaggggagcagaagaatgcgaatgaaggccagtaactattgtgaatactatactaaattgtctgtaggtaatagccacacattggaacactaacaaaaggaaaatgtatgcttgatactactgagaaacaatactttgtcatgcaggaatctatagcattcaagctgagatgaaggatttgacaagttaatttgtcttctctcttacctaagcatttctgctgctcaaattctgactccaaagcagtctctgaaatgggcagccatgctatgtacaaattttcactgcttttggagttcaccgtttgttttgaggacagaagacaaaagataggaagaagagttttcctggggcctgaatagtgttcttcactgggagagggaatttatggttatgagccagtgttcagtatcagatcacaagcggcaggggcacctatttttttttaaattaatgtgtgtgtgtgatatgtaagttcctttaaagcatggagtccaggatagaagtctctcttgcccaggtctaagggtgcggggggaagggggggggcgcggcggtgggagggagtactttagtgatactaggaatttaatgccaaatgtatttgctgtgtgacctagatggctgaattttttaaaaagttcttcagcatcgagaaaaatccagttagaccgatagcttagagagctgtagcttatttctaaatttgactttccctaaaactaagtgtaaatgtcagtgatatgaggactttttaaagaaacaaaataaagaaacaagatacacaaaaatagagcaactatggccaatcttgtttcatcccttttcatctatgaccttactcatacccctatccataataaatgactttcagcaaatcctagatgttctgcatcctatatctttctaacagatattcttaaaaagtatgaccacaataccattatccaattattccttgttcaacaagcacttacaatttcatccatgtgaaaggcacctcatgatttttacttgaggatgaagataatttctcatgaattctcattgttttaagtcacctgaagaggtgtgatatgctacaataaatctatttgtagggcttggcttcaagaactgaagattctggacctagctgatctggtgacagtgaacttgagacctctaatagcgtttaactatttttttttaacttttggaaagcaaggtgtaggaaggggatttagtttttccattaggtcgtggcatgttaagacttgtttctttttccaaaatgttcaagttgctgaagagaactatggactatgggtcaggaagtccgtcggtttcgggtcacattccgctcccgcaggcctgcgggccgccccagctggtttgttcccggcgtgttagaggtcagaggccgaggccgcactcagtgcctgggtctcgcgcagctccagggctctcaggcgacactgggcgtttcctttccggcttcggaaagttttgttttggttcaaggaaaggcgccctgttgaccaaaggcttctcagtctcctccgggtggccagcggccaagtttcctccagcccagcgagtccagactatagtccgttcgagatcctcgaaggccggggaagcgagtcttgtgaggagagaaagcgagtgggcagccagcctgccgactccactgccgctggctggcccttctcttccctctgtccctgggccagtgcccgtcgcaccacaaacagtgcgagcagtctccccggtgactcctcaaggacccagttctccaccattcctaagagaacactcaacccagccgcgcccgggatgcagagagatctaccaacacccgagaatggggacagggcgcatgcgcacaccgtggccgtggcgtctaagtgctcgcccagctgcggcagccgctaggtggcgcatgcgccctggaaggtgcgggccggtctctgggaagaaggcggcggcggcgaaaggcgggggtgctgtgggggccgggccgtgtttacacagcggcgggcgggcgcggacgcggaacccggcgcggcggcggcacgatggtcatggcgtatttcgtcgagaatttttgggtaagcttaggatgttggaagtcgtgtgtttcgaagtccaaggcttttggcgcctgagcttggcctgcgtgcgcttcgggcggcggcggcggcccctccggcagggcgagcgtcctcctgccgcgtcccgcctgggtgaggtccggcgggcgaccggtcgccagcctatagggactcccgggctcgcagccctatggggacgggggctgtcaccgcggcccgggggcccgcagcggggccgccggccaccggggctgggacaaagcgccggatggggcgggagacgggacccagccccaccggaggctcccggtgccgcgctccgcgcggggcgtgcgcggcagctcggacgcgaaggacgggcccgcggcacagccgcctcccgctgcgcgctggctgggagcgccgggcggtggggttttgcctcctgccctcaccgcgggccccccatctgagcgatcccttttacctctgacggtttccacaccaaatccagtgcggggttgggctggactagcgcttcctctcagcctcgcagctcggctcgtgggtttgcgcccaggactttgcctctgggcctgttcacaaagcgtttaaaagttggatttaatgtaactggactccttgggcttaaatgcatggagacctccccctactctgtgctccttccccttcctcattctttccaccccttgtcttagctcagtattagattcttctttgagaatttctccggctcccggtggagtatttttctgcagttattgtttttttttttgtaatgggaagtacagttcagccatgtacaggaaaggaacgtgtttactcaggtatctttcgtgaatcccattttatgccctgacagttgcaagtactgcaggtccattttcgttgagatttagacatatttaaaggggtaatcttttagctagtaaggaatgtatgttaaattcttaattctaagtgcctcaagcatggtcttggttagtaatcagatcagttcatagttatttatttgtcttgaatgtaccttgttttccacaaagaacgtatatactagaccttaggtgttttgttttttaaacagctttattgagttcacatttccgtaccaatacactcatttaaagtgtagtacaattcagaggttttttcatatgttcatagagttgtgtaaacatcaccatatcagttttacaacaatttcgttatcccagaaagaatccctagacccattagcagtcactccccattttccccctgccccaggcctaggcaactaatgtattttctgcctctctgcatttgtctagtctggacatatcctataaatggggccatggtgaccagtttctttcacttagcataatgttctcaaagtttatccatgatgtagcatgtatcactactaattcctttttatggtcaaataatattccattccacattttattaatatttatccaatcagtgatggacatctggttgttcccacttttgggttatgaataatgctgcatgaacatttttgtacaagtttttgtgtgaacatatgttttcatttcttttgggaatgggattcctgggtcaaatcgtagctctatgtttaacattttgaggaactgccatactattctgaagtggttgtagcattttacaatcccaccagcaatatctgagggttcctctccacatgctcacgaacacttatttgtcctttttattataatatagtgagtgaacgtgaagtagtattaatattttattgtggttcgatttgcgtttctttgatgcttaacatcacagttaatgtgcttattgcctatttttatattttctttggagaaatgtctatttagattaattgcccatttaaaaattgggttgtctttttttataattgagttgtaagagtttttttttttttaatattctggatacacaccttatctgatacataatgtgcaaacattttctcccattctgtggcctgccttttcattttcttgatgctgctctttgaagtaactcataagtttttatttctcgtgaagtcttggtgaagtccatcttatctatttttttctattacttgtgcttttattgcrtctaacccaaaaattatttgcctaacccaaaaattacgccttttttcttgttttcttgtaagggttttatagttttacttcttctgtttagttctatgatccatttgaagttaatttttgtgtatggtgcaagggaaaggtataacttcattcttttkcaattgtgtatccagttgtcccagtaccatttgttgaaaaggttcatctttccccgttgaattgtggtaccattgtcaaatatcaatcgaccagaaatgtatggattcatttctgtattttcaattctattccattgtcttcccttacgacagccagtaacacacagtttggattgctgttgtttggattacaaatttgttttgtatagcaaatttggaatcaggaagtatgagtcctctagctttttccttctttttcaggattattttgactgccctgggttccttgcatttccagatgaattttaggattagcctgtcaattttaggcattaggttttacaatggcaatttataaaatgttttaaagagcatttaaaaattgatgctcttgtaaatgttatgcatatttttgatgcatgaatgttttttaagttgctaacttaattccaaattgcatcttcacattaaaagttatgtttcgttttctgttaattgagctttgagcatagctttgtttgatgtttttggctaatatgaataatacttctctgaatatctttctacacatttttatgtgcttcttgggtattcttgttacaagagggatgggaataaacttcaatatttgaattctggagagacctccaaatctaatttatgttttagtttttgccttcactttcactattgaaaacaaatagttaatagactgcattttattttatttcctggcttggaattggggctgtgaggaggctcagtgagctaggaaggtctaggaattaactaaataattaacttccgagaatttatagttgtcattttaggctgggcatggtggttcactcctgtaatcccagcactttgggaggctgaggcaggggaatggattgagcccaagaattggagaccagcctgggcaacacagtagaccttgtctctacaaaaaattttaaaaaattagccaagtgtggtggcatatgcctgtagtcccagctacttggaaggctaaggtaggaggattgcttgagcccaggagttcaaggttgcagtaggttatgattggtcactgtactccagcctgggcaacagagtgagaccctgtctcaaaaacagaaaactaaaaattcacatatttcaggatcatttataaaataatcccttaaaatagatattaatttaactcttccctctagcatttaaagtggaactattaaaaggaaataaaattgtcaaaattcaaaacatcgtgctctatatgataaatatatatgtttttcatcaattaaaagataaaaacttgtcaaagtgaggtagtgagaacctttgatgttttaggtctgtcttgtcttgtcttctcttctctctcttctcttctttctttyttttttttttttctgaattgcagtctcaccgtgttgcctgggctggcacgcagtggcacgagcatggctcgctgcagcttcaaccacccaagctcaaatgatcctcccacctcagccttccaagtaggtgcgaccacaggtacaggccaccatgaccagctggtttttaaattatttgtggagatgagatctcgctaygttgcccaggctggtctcgaactcctgggctcaagccatgtttccgcctcagcttcccaaagtgctgggattaaaaggctgagccactgtgcccagccaaagttttaggtttctaatcaaacaacctattaattgttttctcccctacatgtataaagacaaaccttttttgttgtgacatttcattagaagaaagtttgaatcgttgaaactctcttcaagctcttttgaaagcagcacattcttcctttttctttaaagtataggttttctcaattgaaactatatgctaaattgaaaattcctttacttaatactgtactttgaaggaaaaaattattcaaaaccttttacagaacaggtgttttgttattgataagtcagtttttgccacgaagtatagcaccattgataatcaagctgaaattggacagcaaaattaaaattggacgcaaaaataattttactagtagaaattcacaccattgcttttaatatgtaaaaacaattgttttttatctttatttttacatattaaacattatgtaactttaaaaagatattataaaagattatgtaactttaaaaagatattgatcagtattacagtgaggaagtgtctaagccgctgctttctcaaaggaataattgagtacaagtttataatagtcttgagattataacaacattgctatgtaataattaaaatggcattatatttttatgtaaacccagattattcagcaaaaaaaccttaatgcatttcataggtaattattaatgggggacaaataagtatgtaaaacatacctgagttgaatagcttataatcttcattttacagagtaatcccaatctatatacgatatgaagcattcacccaaagacactaagtagtattctttagtatatatcacattgtaatgagctgagatttttagttaggtgactttttccagaggttatctatagtcagcacataaaaaatgaacaaacaacaattaggtatttttatcctgaagtttttccttatttcttttactgattaactgtacagaagtctcatttcacttgattttattggttttgttacattttgatttaaaattaaattgaaacattggttatatacccaaaatttgatttatcattacttggataagctaagagaattaaaatgtattttaaaattctggaattgctattaataggtctttgggataaaaaacattattatatttttgcttgattaatctaaacttagtatcctagatgagagactaacacacattctttggggttatgtatccatatgaaattttaaaatatatatctttagcaaattagtttaggtgaccatatttgaaacccakaataaaggcttttcattacttgaaatttccaaatattgtagtttgggatacctgtttttaggatatgatcccatcagatgacataccaaaacaaaatctatatatctgtatatatttactttatacattaagagatttgcaaattttacatggtttaatatttaaaaggtataagagggagtaaatcttctttttctctggtaatcaagatgtccctaaaggcaatcaccattaccaatttctttcttttttttttttgagacggagtttcgctcttgttgcccaggctggagtgcaatggcgcgatctcagctcgctgcaacctctgcctcccaggttcaagcaattctcctgccttagcctccctggtagctgggattaccggcatgcaccaccatgcctggctaattttgtatttttagtagagatggggattctccatgttgaggctggtctcgaactcctgacctcaggtgatccgcctgcctcggcctcccaaagtgctgggattacaggcatgagccaccatgcccggcttcaccattaccaatttcttatatggttttccacagatgagaccaaataacatacactccactaggttaaaattattattgtataacttttagcaagttagccaggcccaacttgttcccattgcaacaagctgtgaaaatgaagactacagattcatttaacttgatgcagaagacttgacagtagacattataaaattatagtgttttagattgcactaaaatttgagaggcccttagaattttttaaggggtgtgatttgttttattttttaaccttaattataggagaaatttggaagtgaaaattggtactgatttagtgtgtatatatgttcagttcagggggaggattttagaactttgacatttgaaaggatataaatttgatgtctgcgttcttttttagctctacacactaaatcctaaatgctgtagtcctttcagaactacttaaattatttaagcaaaggatgagggaacagttatgctttaaatcatcctgcacatgtggctaatataagccctttgaaagtagttttttgagtcactgaggtatctcctgagattatccatcctgatgtcataattctagaatagttaacggaagcacccttagaaattcaaatggaaataggatcccatggaaacttaaaaaggaagggaataaggacttgggtttcagttttcttagtgtggaaaaattaaagaatattagagttggggcaggtgcagtggctcacgcctgtaatcccagcactttgggaagctgaggtgggcggaccatgaggtcaagagatcaagaccatcctagccaacatggtgaaaccccgtctctactaaaaatacaaaaattagctgggcgtgatggtgcgaacctgtagtcccagctactcaggaggctgaggcaggaggattgcttgaacccgggtggcagaggttgtagtgagccgagatcacgccactgtactccagttgggcgacagagcaagactctgtctcaaaaaaaaaaaagtattagaattggaagaattttagtagcaatctggtccaaaaagataagtataaattgttgtgatgtggggagaaacaaaaacaacagcatgacagcaactgagacctgtaatgatatctactatattgataaatgtgcaagaggatgttgctggaatggccagagtcagagataattaaactggaaagtgttacagtgtgtgataaagttgaggagatagtcatgctccctgatgtatttgaaggagtgaagattatggaagatatatcaagcacgtttgcttgactttagggaaaagattggaaagtataatataagtaaagcaaattagtggtggtggtggagccttaaaaccaaggggagtgagttttcagttggttgaagcaacagccacaagtctgcatggttttcctttttaattaaaaccattattatgggataggtaaaacacagaagaatacagaacacaaattgcctatagcctctccctctacccttataattttctttagaaatacaaaattcaagatagattctactatatggttgtgtgtcttggtattttcagttgatattaccatcaagcatttttctcatgtgaataagtattctttaataggtttccatggaatggataggctgtaaatttttttttttagacagggtcttcctctgtcgcccaggctggagtgcagtggccccatcaccatcatagctcactgcagccttgaactcctgggctccagggatcctcttgccttagcctttggagtggctagaactacaggcgcatgccaccacacccagctaatttttaaaaaaaatttgtagggacgaggtcttgctatgttatttaggctggtctcaaactcttagcctcaagggatcctcctgcctcagcctcccaaagtgctgggattccaagtgtgagccaccacacctggccagataggctgtaattttctttaatcattcccattttgtatgggaactttcagtttttttttttttttttttttttttgtttatgaattacaaggactggagatttaagtactgatgtgaacaagatgccagtttaagaaagtagccttctgtctctttgtaggcatagattgaagagctgagaaaactgaaattgttggtttagtttttttattttgaaagtaatgaaaaatactttcatttatagaacattacagaaaacgcaaaatatataaaaattaaaaaattaactactgtttgcttctgtagttttttctcaacccatataatatttatttagatagctttaaggattcaactaactggcagaggtgaactataatataaaagattagggaagaatatctgagaggtgagaaaaacaattttttgaaaggtagtaagatttctttccttcaatcaaccaacaaatatgtttgagtcacttttgtacctgcatcaaatcgttctgactgcctattctacatactttatttcatttttatttatttagagactgagtttcgctgtattgctcaggctggagtgcagtggcatgatctcagctctgcaacctctgcctcccgggttcaagtgattctcctggctcagcctcccaatatagctgggattacaggggcacgccaccacacctggcaaatttgtaaaatatttttagtagggacggggtttcaccatgttggccaggctggtctcaaactcctgacytcaggtgatccacccaccttggcctcccaaagtgctgggattacaggtgtgagctaccgcgcctgagcattctatatattttagtcactattttctccattagcagtatctcttgccagtagctctgcagagtacttttaatgatcatgactaaaaatgtcaatgtacggttgtctccccatccataatttcactttccacagtttcagatctgaggtcaactgcagtctgaaaatattaaatggaaaattccagaaataattcataagcattgaaatctcactgtgtcctgtttggtatgcgaatcatccctttgtccagtgcatccatagtatatacccttcctgcccattaatcacttagcagccatcttggttatcagattaaaaaaaaaaaacagtgtataaagggttcatgaccagtatataaagggttcgtgactatccatggtttcaggcatccactgggggttttgaaacatatcccctgtggagaagaggggactactgtacaaataagagtattgatgagaagaggttgtaacttgtggttgaacgtcccgtatacctgtagaaaaattgcttgcatacaaaggcataccttagagatattgtgtattgaattcaaacaaccacagtgaagcaagtcacaaactcctggtttttcagtgcatataaaagttatgtttacactatattatttacactatactggtgtattaaatgtgcaatagcattttatctaaaaatgtatataccttaattaaaaaatactttattgctaatgctaacagggaagaagtgagcacatgcagttggaaaaaagatactgatagacttgcttgacacgattgccacaaaccttcaatttgtaaaaatgcagtattttcaaagtgcagtaaagcaatgctcaataaaagaaagtacagtaaaatgaagtgtgcctgtattttacctccagctccctagcagttttcaaggccagagtggcactggagagctgtcattgcatgtctattgagttctcatcaaagcgtatctgtaggttcttcactaaaggggctgttcttcaaagaaaaaaatctttaggattagtaaaatgttttttggtgtgtttcagagaagtcaagataaagtgagactgtatcaaaaatatgaatgttatattgtgcattgacttgtccagggttgtctattaaatgtccataagagctaaattaaaaggaaaatgtagacagggtgggaagttatagtatttatttatttttgaggtggtttagagttgagagggaggttaggcatgttattggtgtttgcaggatagtacctcctgacccttctcttacccctccaaagaactttttgaaaaaaaggaaacttggtaaaaccaattttttaatcagtaatgtgattatacaatatacaatctatcttctgcctatttttcaaatcttggactcaccaaaagtgaatgctcgccacatgcagtggctcacacctgtaatcccagcactttgggaggccaaggtgggaggattgcttgaggctaggagttgggagactggcttgagcaacatagcgagaccctgtttctacataaactttttttaaaaaactgaatgctatccaggttttttatttttagtgtctaatttactgttactcttaaaaagttcaccgaaggagaagtttcaaacccttatctttttgtttttttagagacaggttctcactttggccaggctggtcttgaacacctggcatcaarcaagcctccttgctcagcctctggagtagctgggattacaggcacaagcctctgacaataaatttttaaaaaaatcttaaacatgtaaagttgcagaagccaaatggaaatgtttggattcacaagaggctgtggttttatgttatattcttcttaataaatggaaatggttattcaaaatgctaaggatattgttcatattatcttgttacagatgtgacattttaatttgtgatatgtaggcaaagtaattactagctacattagctgatgagtttatcaggaatcacttcaacatagctggaagtttttatgctttctgttttcagtggactgtggaaaaatcaagttttgtattatgtaacacttgcttatggtataacactttccaacaaatatattccatttttccattttcactaaagaagaataaaaactgctgcctgtaaagagagttgttaaacctagtgtatcagctgtcttttatttcatcgaataaattgacatttctaatgttatctttatgatttactaattaaggattcataggattaaacaacagtagaggttttccaggattgtgtagtgatctagttctattaatatctcattaattaggctgggcatagtagctcacacctgtaatcccagcacattgggaagccaaggcaggtgtatcgtttgaggccaggagttcgagacctgcctggccaacatggcaaaaccctgtctcttctaaaaatacaaaaattagccagatgtggtggtgcacacctgtaatcccagctactcagggggctgaagcacaagaatcgcttgaacccggatggggaggtagcagtgagccataattgcacgtctgcactccagcctggatgatagagtgagactgtctcaaaaacaaaaacaaacaaacgaaaatcccattaattaaagactagcacatagcctcttctcttttgttaaattttgtctattttctcccttctcaggttaagtttactgaaagatctaagtattttgtgatactcaatgctgatgtgacttaagtactttactgtcttaactcagaaatcaagatttagttattttaaagcacaaactccaaattaaataatcaggaatttcttactgtgtgttaaagagattgaaatgggatttggtaatatgttttgaaaggtccatgtttatcttttcttaattatgctgcatattccttaaaatttcatacttaattttttgttgttgtttttgccagagtctcaccctgtctcccaggctggagtgcagtggtgtgatttcagctcactgcaacctccacctcccgggttcaagcgattctcctgtttcaccctcccaagtagctgggattatgggtgcatgccaccatgcccggctaatttttgtatttttagctgagatggggtttcaccatgttggccaggctgatctagaactcctgacctcaagtgatccgcctgcctccgcctcccaaaatgctgggattacaggcgtgagccaccacgcctggcctcatacttaatttttttttttttgagatggagtcttgctctgtcacccaggctggggcgcagtggcacaatcccggctcactgcaagctctgcctcccgggttcacgccgttctcctgcctcggcctcccaagtagctgggactacaggtgcccaccaccacgcccggctaattttttgtattttaagtagagacggggtttcaccatgttagccaggatagtctcgacctcctgacctcgtgatccgcccacctcggcctcccaaagtgctgggattacaggtgtgagccaccacacccggtcacaacttaattttattaattgtacctttatgggtgattacaaagtgtatgcatatatgtttgtatgtaggtatatgtatatatagttaattgtaaactttattaaagcatataatattgctttatactgtttaaaatcatacaataaatgagaaaaatttatgaaaacacctcacctgagcacaggattgcatattagttaatgttggctttttatattctcaagtcatttttatctgtttttttatgaaactaaaaatctttttaaattttagggggaaaaaaatagtggctttgatgtcctctaccataatatgaaacatggacagatatcaacaaaagaactagcagattttgtaagggaacggtatgtattttttaaataagtaatttgtttaacaacttaatagcaatttaaattttagaatataaataatggagaaaactttatttggatttggaataaagtaattgttttaaaatatgtactgtaattatatctatctatttgtatctatcatctacacagctgagggctgtatagtggctcaaagtggctcaaagtttaatacccctggtttgtggattccttcttgaaaatattatctacatatttttcactggatatgctagcaaggtgatataatacagttgagaagtttgtaggataaaacattaacatttgttaaccatgctaaaataattagaaaagactaacttttctgaacttcagtttaattttgtgtttttgtaacttttatttttaaaagtcctaagtatatattttaaaatcttgcaaatttataaaatgtgattgttgttaagactcttagaatatagcgaatttaaaagctattaagaataaatataatttgattatgattcaaaatcaaacaactcaaaagctgctatcctactaacttaaagctattttgtggctaccccaactttgtaattatttatatgaacacatttaaaatctttaccttgataatatagggatactttggctttaaatttaatactccatttattcatgtattctttcaacaatgtatatcccatcagtgctgtgtaccagctacttgtctggattatgggaatatagtggttaagataacagcttctcccttcatggagtttacagactgataggaattggggaataaactattctataagttcggttcttttcttactccctcctctctactggaatcaacaaggaatgcaaaagctcaagtgctctgggtaaggctctccttcctccgggcttctacattatcattggcaggagcaaaggaaaggccgcagaactctgcatctcttggcatgttccttagccttccctcttcccctacacttcactactatcrctgtctactttgcaaccatcagggcagatattatgcctttgagccctgtttatgttagtcaccttaagaagtccaggactcctgggttatccttcctttgcccagaatctatccctttctgattctttgggtagtgagacaatccgtcatacttcccctttactactttatttttctccatagtatgtataactgtctgataaaagtgatatttcatttatttatttttctgtctcttcccactagaatataaacccaacaagggcagggatttttgtctttttttgcttattttgtctttttgctctatttatgcacttgtgatagtgcttgtcacttggtaggccctcagtaaaggtttttccatagaatgaatctgtaacttcattatgctgatcccagctatcattatttttgcctgaacttcagcagtagctcgtaactgctctatctacagttgttcttgttttcctgcaacttactctgtctactgtagttggagtggtttttttgaaatatagtacagatcagttgttacctcttctctttcagccatctcaagggcttcccattgctcttaagataggcctgcatattctgaccctaaaactacctttcaggtcttattgttctaggctctatgctaggcatgggatacaacagaatattgtctcacaggagaacatagaaacaattaacaaaaatgagtaataacaaaactgcatacatagtacaaagagatacatgaattacaggctgctccttattctttccactccagagatactgggtatcttatagacaggcttcctctgtctagtccaggctttgtaaatacttattcttctcttcacctagttaatgcctacttattcttttttttttttatttagaactttaatttccattcaaaagaagtaaaatataaattcaataagttggttaaaatattcctaaaatgactccacatttatattttatccctctgaattacatgtcaaaatcctatctttttcacagggtatcagtctctggaccatcaagatcatcaataatgcagcatttctttttatttttctttctttttctttttttttattttttattttttattattatactttaagttttagggtacacgtgcacaatgtgcaggttagttacatatgtatacatgtgccgtgctggtgcgctgcacccactaactcgtcatctagcattaggtatatctcccaatgctatccctctcccctccccgcaacccacaacagtccccagagtgtgatgttccccttcctgtgtccatgtgttctcattgttcaattcccacctatgagtgagaatatgcggtgtttggttttttgttcttgtgatagtttactgagaatgatgatttccagtttcatccatgtccctacaaaggacatgaactcatcattttttatggctgcatagtattccatggtgtatatgtgccacattttcttaatccagtctatgattgttggacatttgggttggttccaagtctttgctattgtgaataatgccgcaataaacatacatatgcatgtgtctttatagcagcatgatttatagtcctttgggtatatacccagtaatgggatggctgggtcaaatggtatttctagttctagatccctgaggaatcgccacactgacttccacagtggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttatctgatggccagcgatggtgagcattttttcatgtgttttttggctgcataaatgtcttcttttgagaagtatctgttcatgtccttcgcccacttttggatggggttgtttgtttttttcttgtaaatttgtttgagttcattgtagattctggatattagccctttgtcagatgagtaggttgtgaaaattttctcccattttgtaggttgcctgttcactctaatggtagtttcttttgctgtgcagaagctcttgagtttaattagtcccatttgtcaattttggcttttgttgccattgcttttggtgttttagacatgaagtccttgcccatgcctatgtcctgaatagtaatgcctaggttttcttctagggtttttatggttttaggtcgaacatttaagtctttaatccatcgtgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtagcagtaccatgctgttttggttactgtagccttgtagtatagtttgaagtcaggtagtgtgatgcctccacctttgttcttttggcttaggattgacttggcgatgcgggctcttttttggttccatatgaactttaaagtagttttttccaattctgtgaagaaagtcattagtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcccatcccttgtaagttggattcctaggtatcttattctctttgaagcaattgtgagtgggagttcactcatgatttggctctctgtttgtctgttgttggtgtataagaatgcttgtgatttttgtacattgattttgtatcctgagactttgctgaagttgcttatcagcttgaggagattttgggctgagacaatggggttttctagatatacaatcatgccatctgcaaacaaggacaatttgacttcctcttttcctagttgaatgccctttatttccttctcctgcctaattgccctggctagaacttccaacactatgttgactaggagtggtgagagagggcatccctgtcttgtgccagttttcaaagggaatgcttccagtttttgcccattcagtatgatattggctgtgggtttgtcatagatagctcttattattttgaaatacgtcccatcaatgcctaatttattgagagtttttagcatgaagggctgttgaattttgtcaaaggccttttctgcatgtattgagataatcatgtggtttttgtcttttgttctgtttatatgctggattacatttattgatttgcgtatattgaaccagccttgcatcccagggatgaagcccacttgatcatggtggataagctttttgatgtgttgctggattcggtttgccagtattttattgaggatttttgcatcaatgttcatcaaggctattggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaatttggctgtgaatccatctggtcctgtactctttttggttggtaagctattgaatattgccacaatttcagatcctgttattggtctattcagagattcaacttcttcctggtttagtcttgggagagtgtatgtgttgaggaatttatccatttcttctagattttctagtttatttgcgtagaggtgttggtagtattctctgatggtagtttgtatttctgtgggatcggtggtgatatcccctttatcattttttattgcgtctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagctttcgaatgtgtttgctcttgcttttctagttcttttaattgtgatgttagggtgtcaattttggatctttcctgctttctcttgtgggcatgtagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttctatgtagttgagcggttttgagtgagattcttaatcctgagttctagtttgattgcactgtggtctgagagatagtttgttataatttctgttcttttacatttgctgaggagagctttacttccaagtatgtggtcagttttggaataggtgtggtgtggtgctgaaaaaaatgtatattctgttgatttggggtggagagttctgtagatgtctattaggtccacttggtgcagagctgagttcaattcctgggtatcccttgttgactttctgtctcgttgatctttctaatgttgacagtggggtgttaaagtctcccattattaatgtgtgggagtctaagtctctttgtaggtcactcaggacttgctttatgaatctgggtgctcctgtattgggtgcatatatatttaggatagttaactcttcttgttgaattgatccctttactattatgtaatggccttctttgtctcttttgatctttgttggtttaaagtctgttttatcagagactaagattgcaacccctgcctttttttgttttccatttgcttggtagatcttcctccatccctttattttgagcctatgtgtgtctctgcatgtgagatgggtttcctgaatacagcacactgatgggtcttgactctttatcgagtttgccagtctgtgtcttttaattggagcatttagtccatttacatttaaagttaatgttgttatgtgtgaatttgatcctgtcattatgatgttagctggtgattttgctcgttagttgatgcagtttcttcctagtcttgatggtctttacattttggcatgattttgcagcggctggtactggttgttcctttccatgtttagcgcttccttcgggagctcttgtagggcaggcctgctggtgacaaaatctctcagcatttgcttgtctgtaaagtattttatttctccttcacttatgaagcttagtttgactggatatgaaattcggggttgaaaattcttttctttaagaatgttgaatattgaatgcctacttattctttagagctcagcaaagtggtcactgctctaaggatgcctttcctaatctctctgactaggtcaaaaacacctaatataatcttttgttacatcacctatctctttgtagtatttataaaatttggtaattatttatttttatttgtttttatgttcctctgtgaaacagtatttgtttgtatcccagtggctagcacaaagcctggaacaataggataatcatatttcttgaaggacccaatgagaaaggaaaaaacgtaaactttgtatacattatctgattgattgattgattgatttgagacagggtctagctctgtcacccaggctggagtgcagtggctcagtcaatgctcactgtaacttctgccccctggattcaagcgattcttgtgcctcagcctcccaagtagctgggattatagccctgcgccatcatgttcggctgatttttgtattattcttttttttttgagacagagtctcgctctgttacccagcccaggctggagtgcagaggtgcgatcatggctaactgcaacctccctgtcctaagttcaagcaattcttgtgcctcagcctcttgagtagctgggaccacaggcatgcaccaccatgcctggctaatttttgtattttttatagagacggggttttgccatgtcagccaggctggtctggaactcctgacctcaggtgatccacccatctcggcctcccagtgtgttgggattacaggcatgagccactgtgcctggccaggctcatttcattttagtgctgaataatattttgttgtctggatgtactacattttatccactgacttactcagggacatcttggttgcttccaagttttggcaattatgaatacagctgcagtaaacatctgtgtgcaggttttcgtgtgaacataagttttaatttaattaattaaaatttaaataccaaggaacgcagttacttgattatatggaaagaatatgtttaattttgtaagaaacccatcttccaaagtgacaataccattttgcattttaactagcaatgaattagagttcttattgccccacatccttgccagcatttggagtggtcagtattctagattttggctgttccaataagtatatagtggtatcttatcattgttttaattagcattttcctgatgacatatgatgtggagcatctttgcttttaatttttttttgtagaggcaaggtcttgctatgtttcccaggctagtctcgaactcctggcctcaagtgatcctccttgcccagccttgcaaagtgctgagattataggtgtgagccactgcacctggcttttttgttgttgtcaagatgtggtctcagcatgttgcccaggctggtcttgaactcctggtctcaagcagtcctcccgccacagtctcccaaagctctgcgattacaggagggaaccagcacacctttcctccatcttttcatatgcttatttgccagctgtgtatcttctttagtgaggtatctgttaaggtctttggctcatttttgtttttaatatggttgtttgtgttcttactattttttttaaaatttttttattatactttaagccctgggatataggtgcgaacgtgcagggttgttacataggtatacatgtgccatggtggtttgctgcacccatgaacctgtcatccacattaggtctttctcctaatgctatccctcccccagccccccagcccccaacccccaaacaggccctggtgtgtgatgttcccctccctgtgtccatgtgttctcattgtttaactcccactaatgagtgaggacatgtggtgtttggttttctgttcttgtgtttgctgagaatgatactttccagcttcaaccatatccctgcaaaggacatgaactcatgcttttttatggctgcgtagattccatggtgtatatgtgccacattttctttatccagtctgtgattgatgtgcatttgggttggttccaagtctttgctattgtgaacagtgctgcaataaacatatgtgtgcatgtgtctttatagtagaatgatttataatcctttgggtatatagccagtaatgggattgctgggtcaaatgatatttctggttctagatccttgaggaattgccacactgtcttccacaatggttgaactaatttacactcccaccagcagtgtaaaagcattcctgtttctccacattctctccagcatctgttgtttcctgactttttaatgatgggcattctgactgtcatgagatggtatctcattgtggttttgatttgcatttctctaatgaccagtgatgatgagcattttctcttatgttcgttggctgcataaatgtcttcttttgagaagtgtctgttcatatactttgcccactttttgatggggttgtttttttcttgtaaatttaagttctttgtggattctggatattagccctttgtcagatggataggttgtaaaaattttctcccattctgtaggttgcctgttcactctgatgatagtttcttttgctgtgcagaagctctttagtttaattagatcccatttgttaattctggcttttgttgccattgcttgtggtgttttagtcatgaagtctttgcctatgcctatgttctgaatggaattgcttaggttttcttctagggtttttatggttttaggtcttacgttgaagtgtttagcccatcttgagttaattttttgtataaggtgtaaggaaggggtccagtttcagttttctgcatatggttagccagttttcccaacaccatttattaaatagggaatcttttcccattgcttgtttttgtcaggtttgtcgaagatcagatggttgtagatttgtggtgttatttttgaggactctcttctgttccattggtctatatctctgttttggtaccagtaccatgctgttttggttactgaagcattgtagtgtagtttgaagtgatgcctccagctttgttctttttgcctaggattgtcttggctatacaggctgttttttggttccatatgaaattcaaagtagttttttctaattctgtgaagaaagtcaatgattgcttgatgaggatagcattgaatctataaattactttgggcagtatggccattttcacaatatgattcttcctatgcatgagcatggaatgtttttccatttgtttgtgtcctctattatttcctttagcagtggttcatagttctccttgaagaggttcttcacatctcttgtaagttgtatttctaggtattttattctttttgtggcaattgtgaatgggagttcactcatgatttagctctctgtttgtctattattggtgtataggaatgcttgtgatttttgcacattgattttgtatcctgagaatttactgaagttgcttaccagcttaaggagattttgggctgagacgatggggttttctaaatatacaatcatgtcatcttcaaacagagacaatttgacatccccttttcctatttgaataccctttatttttttctctttcctgattgccctggctagaacttccaatactatgttgaataagagtggtgagagagggcatccttgttttgtgatggatttcaaagggaatgcttccagttattgcccattcagtatgatattggctgtgggtttgtcataaatagctcttattgttttgagatacattccaccaatacctagtttattgagcgttttttgcgtgaagtggtgctgaattttgttgaaggccttttctgcatgtattgagataatcatgtggtttttgtcattgattctgtttatgtgatggattacatttattgatttgcgtatgttgaaccagccttgcatcccagggatgaagctgagttgatagtggtggataagctttttgatgtgttgctggattcggtttgcctgtattttattgaggattttcgcactgatgttcatcagagatattggcctgaaattttcttttgtgtgtgtgtgtctttgccaggttttgatattaggatgatgctggcctcataaaatgagttagggaggagtccctctttttctattgtttggaatagtttcagaatgaatggtaccagctcctctttgtacctctggtagattttggctgtgaatccgtcttgtcctgagctgtttttggttggtaggctattaattactgcctcaatttcagagcttgttatcgatctgtccagggattctacctcttcctggtttagacctgggagggtgtatgtgtatgtgtccaggaatttatcaatttcttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgaatttatcaatttctaatagattttctagtttatttgcatagtggtgtttctagtattctctgatggtagtttgtaattctattggatcagtggtgatatcccctttatcattttttattgtgtctatttgattcttctctcttttcttgtttgttattctggctagcggtctatctattttgttgatcttttcaaaaaaccagctcctggattcattgatttttttgaacgctgtttcatgtctctatctccttcagttctgctctgatcttagttatttcttgtcttctgctagcttttgaatttgtttgctcttgcttctctagttcttttaattgtgatgttagggtgtcaattttagatctttcctgctttctcttgtgggcatttagtgctataaatttccctctaaacactgtttcagctgtgtcccagagatcctggtatgttgtgtctttgttctcattggtttcaaagaacttacttatttctgccttmatttcgttatgtacccagtagtcattcaggagcaggttgttcagtttccgtgtagttgtgcagttttcagtgagtttcttattcctgagttctaatttggttgcactgtggtctgagagactgtttgttatgatttccgttcttttgcatttgctgaggagtgttttacttccaattatgtggtcagttttagaataagtgtgatgtggtgctgagaagaatgtatattctgttgattttgcggggagggttctgtagatgtctattaggtctgcttggtccagagctgagttcaattcctgaatatctttgttaattttctctcttgtttacctgtctaatattgacagcggggtgttaaagtctcccactattattgtgtgggagtctaattctttttgtaggtctcaaagaacttgctttatgaatctgggtgctcctgtattaggtgcatatatatttaggatagttagctcatcttgatgcattgatacctttactgttatgtaatggcctttgtctcttttgatctttcttgatttaaagtctgttttatcgaagactaggattgcaacccctgcttttttttgctttccatttgcttggtaaatattcctccatccctttattttgtgcttatgtgtgtctttgcatgtgaratgggtgtcctgaatacagcacaccagtgagtcttgactcttcatccaatttgcgagtctttgtcttttaattggggcatttagcctgtttacatttaaggttaatattgttatgtgtgaatttgctcctgtcattatgatgctagctggttattttgcccattagttggtacagtttcttcataatgtcggtggtctttacaatttggtatgtttttgcagttgctggtgttggttgtttctttccatgtttagtgtttccttcaggagctcttgtaagactggcctggtggtgatgaaatctctcagcatttgcttgtctgtaaaggattttatttctcctttgtttatgaagctttgtttggctagacatgaaattctgggttgaaaagtcttctctttaagaatgttgaaaattggcccccactgtcttctggcttgtagggtttctgcagagatatccactgttagtctgataggcttccctttgtgggtaacccgacctttctctctggctgcccttaacattttttccttcatttcaaccttggtgaatctgacaattacgtgtcttggggttgctcttctcgaggagtatctttgtggtgttctctatatttcctgaatttgaatgttggcctgtcttgctaggttggggaagttctcctggatgatatcctgaagagtgttttccaacttggttccattctccccatcactttcaggtacaccaatcaaatgtaggtttcgtggtttcacatagtcccatatttcttggaggctttgtttgttccttttcattcttttttctctaattcttgtcttcatgctttatttcattaagttgatcttcartctatgatatcctttcttccacttgatcgatttggctattgatacttgtgtatgcttcacaaagttctcatgctgtgtttttcatctccatcaggtcatctatgttcttctctaaactggttattctagttagcaattcgtctaaccttttttcaaggtacttagcttccttgcatttggttagaacatgctnctttagcttaggggagtttgttattacccaccttctgaagcctacttctgtcagtttgtcaaactcattctccatccagttttgttctcttgctggtgaggagttgtggtcctttgtgcttgaaacccagggccctggtggtgtaggcacccgagggaatctcctggtctgcgggttgcaaagactgtgggaaaagcgtagtatctgggctggaatgcaccattcctcacagcacagtccctcatgccttcccttggctaggggagagagttcctgaccccttgtgcttcctggatagggtgatgccccgtcctgcttctgctcgctctctgtgggctgcacccactgtctaactagccccagtgagatgagccgggtacctcagttagaaatgctgaaatcacctgccttctgcattgatctcactgggagctgcagactggagctgttcctattcagccatcttgccagctgcccccttattgggttttaagagttctttatatattttggataatggtcttttatcagatgtgtcatttgcaaatattttctcacagtctgatttgttttctcattcttttgaatttgtctttcaaagaacaaaagtatttaattttaagaaagtccaacatatccattatttattttatggattttgggtttggaatacctttaggtattggaatgcctttagatattgtgtctaaaaagtcatcaccatagccaaggtctggtgtattggagtgcctttagatattggaatgcgtttagatactgttctaaaaagtcgtcaccatacccaatgttgtctaggttttctcctatgttatcttctaggggttttgtagttttatgttttacatttaggtctgtaatacattttgagttaatttttgtgaagggtgtaaggtctgtgtctggattcattttttttttttttttttgcatataggtgtccagttgttccagtaccatttattgaaaatactatctttgttccatcgtattgcatttgttccttttttttttcagagtatctctctgtcgccgaggctggagtgcagtggcgcgatctctgctcaccgcaagctccgcttcccgggttcatgccattttcctgcctcagcctcccgagtagctgggactacaggcacccgccaccacacccggctaatttttgtatttttagtagagacggggtttcatcatgttatccaggatggtctcgatctcttgacctcaggtgatcggccagcctcagcctcccaaagtgctgggattacaggtgtgagccaccatgccsggcctttttaaaatacttttaagttccgggatacatgtgcagaatgtgcaggtttgttccataggtatacatgtgccgtggtggtttgctacacccatcaacctgtcatctacatatctacattaggtatttctcctaatgctatccctcccctagctttatttttttatttttatttatttattttttttgagacagtgtcttgttctgtcactcaggctggagtgcagtgcagcctccacgtcttgggctcaatcaattcttctgcctcagcctactgaatagttgggactatacatatgtggcaccatgcccagtgtctttcaaagtgacaatacttttttttttttttttttttttggagagacaaggtttcaccatgttgcctagactggtctcaaactcctgtgctcaaatgatctgcccacctctgcatcccaaagtgccgggattttacaagcatgagccactgtgccccacctgatttattgtagcttcataataagtcttgaagttgggtagtatcagtcttccaactttgttctgctccttcagtatttttttggctcttctagatcttttgctgttttcggttttttttctattaccaagtaatgttgccttgaatagttttgcacatatgtcctggtatgcatatatatatatatacatttatattgggtatatactctggagtagaattgtgaggccataaggtatacgtgtgttcaactcgagtgactaatagcaaagaattttccaaggtggttgtatcagtttacaccaccttccatccttatttgagagttccagttgctttatgttctcatcaattcttggtatcgtcagttttttaattttagcttgctaatagtagtatctatcttattgtgaccttaatttgcatttctctggtgaataatgggatgatatatttttctttttctctcctcacaacttgtcatttatgtgaattattgaaatttgtgtgttaaatcaacttcccattcttggtctaaacacaatttggtgggaatgtagttgatcattttatgtgttagtggatcaatttgctgctattttatatgcaatttttacatctatacttgtgagtgagattggcctgaacattttctttctctaagtgtacttgttaggttttggtatcaaagtttgttggcttcataaaatgaattggggagtatatcctattgttgtattttctggaaaaatttttgaaagattattgttttttccttatgtgcttaatagaattttctggtaaagccctctgggcttgaaactgtctttataggaaagttttaaattacatatttaatttctttaatcattataggaccattcacrttttttagttctgtgagtttgaaaagttatgtttttctatgaatgtcttaattttatccacactttaaggtttgttgcaaaaatttattattattattatttttgagacagggtctcactgtcatccaggctgcagccttgacctcctggtctcaaatgatcctcccactccagcctcccaagtagctggggctatagggatgcaccaccatgcccagctaatttttgtatttttttttgtagagatgagggttcaccaggttgcccaggctggtctcaaacaccagagctcaagcgatccttctgcctcggcctcccaaagagtcgggattacaggcatgagctgttgcacctgtcctaatttctatatgttacacttggttgatatgccttttgagtctcttaatctatagccacccacctccttaccttttgttgttgaagaaaccagagtatttgttctaatagggccccatatcctggaatatgctaattgcatatgcatagtttattaaatatcttcctttatccctgaatttcttaaaaattgtcatttaaatctagcagcatgatcaaattctattcagtacttttttttttttggactgagtctcactctgtcacccaggctggagtacagtggcatgatcttgactcactgcaacctccacctcccaggttcaagtgattctccttcctctgcctccccgagtagctgggattgcagatgcatgcccccacgcccatctaatttttgtatttttagtagaggcagggtttcaccatgttggccaggctgatctcggactcctgacctcaggtgatccacccacctcggcctcccaaagtgctgggattacagacatgagccaccacgcccgcctctattcagtattttggaaagaatactwcttaggtggtggtgtgtacttccaccagaggcatatattatccaaatataactgtttcatgatgttagtggccattggtgataatcacctagatctgttattttattaaggatttgctttcatttatatttttgctgggtatggaattccagttggtagatttttttaattaattttttttgaagatcgttccattatctatagttgagatgttagctatcagtctagttattggttctttgaaggtaacatttggtggtgggaagagtttggttgctttcaagatttattttgttctttctctttttaattttcagcggtttttactctaatgtgactagaaccagatgtaattgtttttaaacaatttatcctcttaaagtttgttgggctgcttggatctgtggttaatatcttttatcagttttggaaaattccccattattatttcttcaaatattttctctaactcattctttctctttactcatttatctgacttttcttgctttgtcctttacatctcttctctgtttttcattcttttttgtctttctgaacttcaatgttggataaattattctcatctatcttttaattaactagatctctttattttttaaattttccttttttttctccatctcctttttatggtataaatctcaatatagtatatctaatcagctgctaaaccccatccaaggagatattaattttggttgttgtattttctagatctgtaatttgcatttttttttcttttttgcaaatttggtgtgctttcctccacttcttaaaatgaccagatctctaatgaaattcttcttttggagtctttacttgaagggcgtgggatttttctctgctttctacctttagtggacctgaactctttttcttttggctcccttaacctgtgaggctgagaaaagctctgtttcacttctcaactgatcagctacctcttctggatacccccaaggaagaagctgcccgacatacctgactgacttgtctggatgcccttctcttggatcttgattcttaactgccccttaagttttctaatgcttttcagttaccttgcccccaccctcaacttaccatgttttctaaattttcctcagtgagaaaagtttttgtgtcaataatcttattcactattacaggttaagtatcccttatttgaaatgcttgggagcagaagtcttttagaattaggatttttttcagattttggagtatttgcatatacatagcaagaaatcttgaaggtgagacccaagtctaaacttgaaatttgtttatgttttatacacaccatatactcatagcctgaaggtaattttatacaatattttaactatttttctttttctttcttttttttttcttttttttttttgagacggagtctcactctgtcgcccagctggagtgcagtggcaccatctcggctcactgcaacctctgcctcccgggttcacaccattctgcctcagcctcccgagtagctgggattacaggcgtgtgtcaccaagcccagctaatttttttgtatttttagtagagatggggtttcaccgtgttagccaggatggtctcgatctcctgacctcgtgatccacctgcctcagcctcccaaagtgctgggattaccggcgtgagccaccgtgcccggcctattttaactatttttctacatgaaacaaagttttgactgaattttgaccatgacctgtcatgaggtcaggtgtggaattttctgcttttggcatcatgttggtcctcaaaaaatatatagattttggagcatttctgatattttgattagggatgtttgtttgtttatttatttatttgagacagagtttcgctcttgttgcccaggctggagtgcggtggcatgatcttggctcactgcagcctccgcctcccggattcaagcgattctcctgcctcagccttccaagtagctgggattacaggcacccaccaccatgctcagctaatttttgtatttttagtacagacggggtttcaccatgttagccaggctggtcttgaactcctgacctcaggtgatctgccagcctcggcctcccaaagtactgggattacaggcgtgagccaccgtgcctggctgattagggatgtttaatctgtactggaaattgaacttctttaccttgctgttaaactcacacattgatatactaatattaacttttttgggtgaacaaagtattactcttgtagtaatagtattttaaaatgacagaagaacttaaaggagcaggaaagagtcacagtactatcagcgagaggcagttactgttaatatttcctttttgttagagagctggtttttgtgcaaatttggttgggaaagagtttggagattagtttagatattctgagtttgaggtggttcacatatcttaattatgtttggggcagttagatattgaacaggtgggtcagtgcaagagtagtgtgaagatctggatttagacattagaagcagaaagttggttggaccaatcaaagtaaatggagggatgatggtggttgtagaatgttcccctattaagggtagcacacattgagaagagccaggcaaaaggtaaaactataagttttgtagtgttaagaaggccaaacaggccgggcgcagtggctcatgcctgtaatcccagcactttgggaggctgagtggggcggatcacaaggtcaggagtttgagaccagcctgaccaatatggtgaaatcctgtctctactaaaaatacaaaaattagctgggtgtggtggcgggtgcctgtagtcccagctactcgggaggctgaggcaggagaatcgcttgaatccgggaggcggaggttgcagtgagccaagatygcaccactgtactccagcctgggtgacagagccatattccgtctcaaaaaaagaaggccatacaaaatgtgtattctgtatttataggttacatgtctgtaggataatttgtgtcttttagaattctatatttaatggctgtggatgttttttacggaataaaatctcatatgctaaacagtagttatataaaacacagttttctagtgtgaaatatttgctaatattttagatctgatcacaaaataaattaagccatgaatgaagttcaggatttcagacttdatgatatatttagttttgtgcaaatgactgtcattaatctcttgttctattaaatgtgcatcacagtgttgaagaataataaaactaagtacaacaaagaattattaaatacaaatgacacacttatcacagtgaaccagcttacagagacagagagaatacaagaagtagcactcatgtatttcctgttcagataagcattggtactaaagataaaaagagttgtgattccattaaaattttttctgtggctgagcgtggtggctcatgcctatgatctcagcactttgggaggcctaggtgggaggattgcttgagccctggaattccagattagcctgggcaacatagcaaggccccatctctacaaaaaaatacaaaacttagctgggtgttgtggggcatgcttgtagtgtgagctactcaggaggctgaggtgggaggattgcttaagcctaggaggtcaaagctgcagtgagctatgatcataccactgtactccagcctgggtgacagagcaagactgttttaaaaaaaaatttgtgtgtgtgatataaattattttagttctataccagaaaggacatttgaagataggccggaaattcatgactacatatatgtacttatttttaacatgtaatttttgaggtatctttttgttttgcacttttaattgtattttgataactttgctgtttttggtcactaaataagaagtattatgatgtggatatttgatttaacagagctaccatagaggaggcatactccaggtcaatgacaaaactagcaaaatctgcaagcaattattcacaacttgggtgagttaatttcttcctctttttcagtgtttatttaggcaaagttcttaaggattctaggttccttttgaggacataacagttcaaaagcatagtaaaatatatgcttatttaaaagtatctgtaaatattaatatattcttcacttgatagaaaatataattgaacttgctgaatcagtcaatgcagtcaaaactaaatgaaatttattttttccctttttaaaaactagtcattcaatagtgtttgagattataaatgttatcttatgcacatgcaatgtatttattctagttgtctgtaagttcctatttaaattctgttgtagtttaacagtgatctttaaaaactcacttaagataaactttattgaaatgattaagatgcattaaaaatgtctcctgtgattttatagactgtcattaaatcttccttttaaaaatttgtattaaaaatgtgttccttgaaaaatgaaaataatgaaaagaatacatttaaaatgagatgtgctcattgccataacaattatggaaagaataattatctaaaaattgggcttttgcatgtttaaattcacagaaactttatttttgatgaagtattttaaatggaatacttgttttaaattgaagtttgataatagttaatttttaacaatagacagtgatagaaaggcttctgatacaagtataaatactaaatcaattcagaaattaatataattaagagggttaagacttgtgataatgtaattaacccatttctatattcctgaggtccaaaaatattttaaataaccaatgacaaaaaaaattcaaggtcagtctgtcaatcattttattcattattttaatttcatcttttgcctaaataaagttgccatatrtaccactattatttccactggttccttgttagaaccttaattttcttttttacttttaataagttattcccatattttttattttcttagaacatttgcaccagtatgggatgtattcaaaacatctacagagaaattagcaaattgtcacttggatcttgttagaaaattacaagaattaataaaggaagttcagaagtatggagaagaacaagtaaagtctcataaaaaggtatcagtttttttcttgttaaataattgattggtcagatattgaatactttatagttcagtcattttgatggatcatttcatactaaacagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggtaatcataataaaaattacatatctgtggtttcaaagcaccttgacatacaaaattgcatttaacatttagatcaaactgaaaattatctcattttaaagatgaagacactgtgccttacagtcctagtgattacccaagtaaaacacaggagatttgtaaagtatgttatctgtggtaaataggttagcgagcactaaaaaacaatgattgatttgagacggagttttgctcttgttgcctaggctggagtgcagtggcrcgatcttggctcactgcagcctctgcctcctgggttgaagtgattctcctgcctcagcctcccaaatagctgggattacaggcgcatgacaccacatccggctaattttgtatttttagtagagatggggtttcgccatgttagtcaggttggtctcgaactcctgacctcaggtgatccgcccaccttggcctccccaagtgctgggattacaggcatgagccactacacccaaccaaaaaacaatgattttttaaatgtcagtgacacattttcaggatatttttgtagtaacataattgaggtaattactttgtgtaaaatttaaccatgaggtaaaattgttttgaaacaagattttggtatatttagaaagatacaggtaggtacttgcacataagctttaaatgtgtgttgtggtgatttattgctgactttgagcacatttatgtagcattgtggtaaaccacaaccttttcttccatttatgttttaatggaaagtagctttttttttctcctttcaaaacagtttaaccatttacttatttgatgtggtatatctcacttaagaatgagccatgtggagtgataattttgaaagctttgtaaaatgtttgaaatatccagtaaaaaaggaaaccaaattgtaccaattgtatgattatgactataaaacagctgtgtatttatatacttttacatgtttaaatgcacagatactttatttttgatgaagcatattaaacggaatactagttttacattgaagtttgataagagttaatttttaacaacagatgatgatagaaagtcttctgttacaagtctgaataaccaaatcaactcagaaattaatatcatataattaaataagaggggctgttacaagacttgtgataatgtaattaatccatttctatatacctgaggtccaaaatattttaaacaactaaccaatgaaatatgatatatgactatacatgggcaaaaaactagaagagaatgtggaaaaatgaaaataggtgatttagaatttggagcaataaggcacataatctcaggaccttctggggactgtgtcacagatgaaaaaaatgaatttggagcaatatattgtgtttgtataataaataaaaattggatttgtataataaaaattgggaggggccaaaatgagacacagtaaattcatggtttgaaaacaccctctgcttcagacatagcaattatgaataaaatataaaaagggaaaacgaaataacagggtccaaaaagaataatattttatctctgtgggccagaatagaacagaaatccaaaatggcacgtagagattgattatgcaagctgttgaactcaaaagtcctaaagtaggcagtgggatttggctcttacgtggcaaaagggactaaaagctcccctcttaggatgaggtacaaagagcctggctcattgcctgaaactatagatagggagaaaagaaggctcttgggttgctgacaagaactaaagccttattgaaagttggggatttagggacacagatacagagacacaatcctgacttgaaatcaagccaaggaatcatttcatgactattttggccatatctacaatattcttgcagggaagtaattaaaaattactttcataagactgaaatgaaattggggccttggaggggtggcaggagataacctgaaaactgcttggggatgggtgagcataaagtataaagcataacacaattctaggaggtaccatttatgttttattctatgaatgtccagcagtactgatgaagggcgagagagaagaagagaaaagagggcaaaataaaaaaaaaaaactcctattctgaatgagcaaacaaccaaaattgtagcacacacctaagaaatctaatactagaacaaccaataaattcaataattggaataagaatttactccagatgaaatttaaatttataaaaaatgaacaaaaacgatgtgtcttgaggatgttcaaataaataaacataaacttacattaaagaagattaagaaattaaacgtaatgaaacaagatctactagatagaaaaaaacagctaattagaaaacttggaaatgaaaaatagagttattgaactttttaaaaagcaatagagaaaagaaactttagacttgatatagtcaaagaatgagttttgaagatagtatggagggaccttatccagaacatagtaggagaagcaaacgttaccaacattcatctaatactaatttcagaaggaaaaaatggaggaaatggaaggacaagtaatatttgaagagttaacagctcaaaatgtttcagaattgaagaaattcaagagccctcatattgaaagtacattataggtattaagcaggttaaataaattcagacctagaccccagagaaaaagaaaatgggtatttttttttcctcatatgaaatcagaatgcattttcaattgatggtattgtatagtcatggttggtaagatagcttttatggtgtagttgaattgcctgtacaaacttcgttgcatgattggacagctacaatgctttgatatttcagttaacagaccttttaaggaccatttgaggaagtaatggctttgattattttctgaaaatcttttagtgataccttttggtaagatcaagtgcttggaagaaaacctgaagataataatggagcacttnaaagaaatggtctgtcaactgacaaaaacaagcaatggggaaaggattccctattcaataaatggttctgggataactggctagccatatgcagaaaattgaaactggaccccttttttacaccatatacaaaaatcatctccagatggattaaagacttaaatgtaaaacccaaaactataaaaactctggaagacacctgaggcaataccattctggacataggaatgggcaaagatttcatggcaaagacaccaaaagcaattgcaacaaaaacaaaaattgacaaataggatctaattaaacgtaatggtttctgcacagcaaaagaaactatcaaaagagtaaatagacaacctgtagaatgggagaaaatgtttgcaaactatgcatctgacaaaggtctgacatccagcatctataaggcacttaaacaaatttacaagagaaaaacaaccctattaaaaagtgggcaaaggacatgaacagacacttctcaaaagaagacatacatgcagccaacaagcatatgaaaaaaagctcaacatcactgatgatcagagaaatgcaaatcaaaaccacaatgagataccatctcacactagtcagaatgactattattaaaaagtcaaataacagatgctggcaaggttgtggagaaaagggaatgcttatacactgttggtgggagtgtaaattaattcagccattgtggaaagcagtgtgtggcgattcttcaaagagctaaaaacagaactaccattcaccccagcagtcccattactggatatatccccaaaggaatataaatcgttgtaccataaagacacatgcatgtgaatattaattgcagcactattcacaatatctaaatgcccatcagtgacatttgataaagaaaatgtggtacatattcattgtggaatactatgcagccataaaaaagaatgagattatatcttttgtgggaacatgggtggagctggagcccattattcttagcaaactaatgcaggaacagaaaaccaaatwttgcatgttctcacttataagtgggaactaaacaatgagaacacatagagaggaacaacagacactggggcctactggaggagagagggtggggagaagggaagaaggagaggatcagaaaaaatacctgtcagttactgtgcttattacctggatgacgcataagctgtgcaccacacccccgtgacacacagtttacctatataagaaaccttcacatgttcccctgaacctaaaataaaagttaaaaaaggaaatgctttgtcagtaaacagaaaactgaaaataatttgaaagaaataatcataatacatataaatgtcttggactcctggtgtggtttgttttctgttgcttatgacagaatacctgaaactgggtaattttttttttttttgagacagagtctcactctgttacccaggctagggtgcagtagccgcatctcasctcactgcaacctccgcctcccgagttcaagcaattctggtgactcagcctcccgagtagttgggattacagtcatgtgccacctcgcctggctaatttttgtgtttttagtagagatggggtttcaccatgttggccaggctggtcttgaactcctgacctcaagcgatctgcctgccttggcctcccaaagtgctgggtgtgagccaccatgcctggcttgaaactggataatttataaagaaaggaatttattttttacaattatggaggatgagaaggacgtccgaggttgaggggccacatctagtgagagccttcttgcttgtggggagtctgccgaattctcagaaggtgcaggacctcatatgagggggctgagtgtgtttaggtctctctttgctccttataaagctgtcagtcctatttccatgataatccattgattcatgaaccgattaatacattaatagattaatctatttatgagggcagagccttcatgaccgactcatctattaaaggtcccacctctcaataccgtcacattggggattaagtttcacaagcattcaaaccatagcagctcctctaatcatagatcaattgtcaaattgaaaaaaaaaatcctgttggcaaggcatggtggctcacacttgtaatcccagcactttgggaggccacggtgggtggatcacctgaggtcaggaattcaagactagcctggccaacatggcaaaaccccttctctgctaaaaagacaaaaattagccgggcgtggtagcgggcgcttgtaatcccagctactcgggaggctaaggcaggagaatcacttgaacccgggagttagaggttgcagtgagccaagatcgcaccactgcagtccagcctgggcaacaagaacgaaactctgtctcaaaaaaaaaaaaaaaaaatcctgttatgtatttcatataatgggatacaatacagtagtttaaataaatattactcttgcaaagaaaaggggaaagaatagattgagtcttgaagctaggtgatggattcatgttaaaaaagaatgacatgtattaacgtgagtaaatgtaaaaagcataatattgagcaagaaaaagtttcaaaaggatgtgtagaatttgatgccttttatataacctttaattctctgtaaaaacagaaaaaagctattgactctctgcttacccccctcccttaccccttcatccttgctccctcccccactgtccccttccccaattaatccttccccttccctcctggtctcggaggacccaatcctagcccgacctgtctcggcccgcaacttccccgaagctgttggtgccactcccagcccatgtgggcccccgcaggctgccaacgcctgtccgccagctccccgttccgctgggctttccaaaacctcgccaggggtgactttctgagccgcttgctccatacccctctctgcagcctctcctgccacttagggctgccgttccccctcccggcaacggggggctggcggagctgtgccacgggggcccccggggccggcggggccggcagagcaggcagtgccagggtcatcaggatgatgcggacgcagtgtctgctggggctgcgcacgttcgtggccttcgccgccaagctctggagcttctccgcccttttgcggtggcagatctgcatggtaattcagcaccaaactgttcgatatgatatcatccccttatcttcttgtcctggaatcagctaggtgaagaggaagatcatggtgctggatccggatgagatacttattcactcccaccatgatggggtcctgaggctcacagtctggcctggaacgcctcctgacttcatcctcaaggtggtaatagacaaacatcctgtccgtttctttgtacattagaggccccatgtggatttctttttggaagtcgtgagcgagtggtgggagctggtagtgtttatagcaagcatggagatctatggctctgctgtggcagataaactggacaatagcagaagcattcttaagacgagatactacggacagcactgcactttggagttgggcagctacatcaaggacctctctttggtccacagtgacctctccagcattgtgatcctggctaactctccaggggtttacaggagccatccagacaaggccatcaccatcaaatcctggttcagtgaccccagtgacacaacccttctcaacctgctcccgatgctggatgccctcaggttcaccgctgatgttcgttccgtgctgagccgcaaccttcaccagtataggttctggtgacagctgctcccccttcacctgagttggggttgggggaaagggagggcgagcccttgggataccgtttgatgccctgtccaatgtgaggactgcctgggcagggtctgcccctccaacccctctctgccctggaagccctacactccacttggagtctggatggacgcatgggcctgggaccctgaagcagcctcactctaacttcgtgttcacactccatgtgtgaatggagttcaggctgggagacaggcagaggcctaggagaactaaaacagtgtttgtggtggagcggcaggacccgccagagccacagatatatggtgatccaggaggctcaaagagaagccaagtcagctttgttgtgatttgatttttttttttctaaactcttgtacaaaactgaaaaaaaaaatgctatttatatacaggtaaagtattagggacatgtatggggacagtaaacaataagcacatgatggaaattacttgtgatgagaatgtaaggggaatgggacaggagctgactttattcaaaataaaataattactttaaaaaatgtggtcaggcgcggtggctcacacctgtaatcccagcactttgggaggctgaggtgggtggatcacgaggtcaggagatcgagaccatcctggctaacacggtgaaaccccatctctactaaaaatacaacaaattagccaggcgtggtggcgggcgcctgtagtcccagctactctggaggctgaggcaggagaatggcgtgaacctgggaggcagagcttgcagtgagccgagatcgagccactgcactccagtctgggcaacagagcgaaactccgtctcaaaaaagaaaaaaaaaatgtaagtcacaggagcagtttactcttggtagatactataacattcatgcccaacagtgaattggtatgggtttcatatcattaatgcaaatgtctatgatctaaattagttaaaactatccagaggnttaaagtactgctgggttaaataccgttgtcttcttttttgtgaaccccagtgggctcaccatagtacctagtatgccgtgaccactcaaaaaatatatgatgactagcgattacacataaataaatgattctgagtcttttcatgtaaaccaaaacaagtttaatgtaatgatttagatgcaattaaaggattttttttttttttgtctagagatgaggtctcactgtgtcacccaggctggagtgcagtggtggtatgatcatagctcactgcagcctggaactgctgggtgcaagcgatcacctcactgcctcagcctctcgaatagctgggatcacaggtgtgaatcatcaggcccggctcatgatttcttttttattaaaatattgagcaggagtggagcatgtagttgtgtccaagggttgtgagttggctaaaattcaccctgtgcttcacagggatggacttcagtgggatggactactcagaggaaggggtgcttttttctaattggtctcctcagaggtggcatctctgcttgtgatattagatagtgggttctctgatttgtaatatattttaatccaagtcagttattttggcctatcgtaaggtttttattaacaagaatgtagattttttttaaaagtcatagatctttgaataatttttttgtgacttaaaaacataaatactataggtgttataacataatttggttatctcattcactcattcacaggccttttttttttttttttttttttaagatggagtctcgctctgttacccaggctggagtgcagtggcacgatcttggctcactgcaatctctgcctcctggattcaagccattctcttgcctcagcctcccaagtacctgggattacaggcatgcgtcaccacgcccagctaatttttgtatttttagtagagatgggatttcaccttgttggccagcctgatcttgaacttctgacctcaggtgatatgcccgtctcagccttccaaagtctgagatcacaggtgtgagccaccacacccaaccacaagccttcatttttataaaacaccacttagtaggtactcatgtttgtggactattgactaagtactyattttatatgtatatgctggcttcatggattgtactataaaagtcatargcacttaaaatgtttttggtagtatattaatttataatgctaaggaaatgaataaaacttagatttgttttattatcataggtaatgtattaaagccactcttgcttatgagaagaaatgtagctattacttgtaaagcacagtttcctcttaagaacaaatgctccagcttcccttttattttaattaattagtgaattaattaactagtgaattaatttttcaagacaggttctccctctgttttccaggctggagtgcattggcacaatcacggctcactgtaaccttgaactcccagacttaagcaatccttcacctcagcttccagagtagctgggactacaggcatgtgccaccatgcacagccaataaaaaaaaaaattttgcaggccaggcacggtggctcattcctgtaatcccagcacttagagaggccgaggcaggtggattacctgatgtcagcagtttgagaccagcctggccaacgtagtgaaaccctgtctctactaaaatacaaaattagccgagtatggtggtgtgtgcctataatcccagctactcaggaggctgaggcaggagaatctcttgaaccggggaggtggaggtttcagtgaacaaagatcacgccactgcattccagcctgggcaacaagagtgaaactcagtcttaaaaaaaaaaaaaaaaaaaaaaagctgggggcagtggctcacgcctgtaatcccagcactttaggaggccaaagcgggcggatcacttgagattgggagtttgagaccagcctgaccaacatggagaaaccccatttctgctaaaaatacaaaattagccaggcgtggtggtacatgcctgtaatcccagctactcgggaggctgaggcaggagaatctcttgaacccaggaggcagaggttgtggtgagccgagattgtggcattgcactccagtctgggcaacaagagtgaaacgctgtctcaattaaaaaaaaaaattgtagacacaaggtctcatgttgcacaggctggtctcaaattcctagtctcaagccatcttcctgcttcggcttcccaaagtggtgggattacaggcatgagccaccacacctggcccaacttcccttttaataatgactataaagattgtcacttttttatgatgaggccattcagtttctataattctaccttaagaatttatagcattcctaactaagcataatatgttatttagaaagttgttttgacttaataatttagtattgtgtagctgtttcttatgaaagatgtttcttgctttcagaaaatatacatgtttctggtggggcatggtggctcatgcctgtaatcccagtgctttgggaggccagggtggagggataacttgaggctgggagtttgggaccagcctgggcaacgtagggagaccccatctctacaaaaagtttttaaaaaaattagtcagtgtgagatcgcaccattgcattccggcccaggcctacaacagcaagactggtggcacatacctgtagtcctaactactcaggaggctgaggcaggaggaggattgcttgaggccaggaggttgaggctgcagtgagccatgattgcaccactgcactacagcccagatgacagagcgagatcctgtctcaaaaaaaaaaaaaaaaaaaaaaagaaatgaaaagaaatttctttattagttagtgcttctcttgtcagttttctagatgcttctctatttcttttttctttcattttttttctccctatcatcttgtattaaagatgcttcttaaagttgatttgtaatttccttaggattctgactgtggcatatcaattttacctttcaagagtgagagctaggctgggcatggtggtggcttatgctggtaatcccagcactttgggaggccaaggcaggagcccaggagttcaaaaccagcctgggcaacacagtgagagcccatctctacaaaaaaagaaaaaaaattagccaggcgtagtggcatgtgcctatggtcctaggtacttgggaggctaaagtacttgagcccagtagtttgaggctacactctagcctgggtgacagagtgataccctgtctcaaaaaaaaaaaaaaagagctgattgaaaaaatataagtcagaacttaaaaagagtaccttctttcttcatgctttcaaataagataaataaaattttataatttcctgatatcagagggtacgcttcataaaacttctttgtttaaaattttgatttagatccagccgttaacctttgagataaagataatagttttatagccagaagtagtgaacaaataagtgctgaatgtatagaccaggatttatagtgagaatatcatgagaggaaaaaaagaaatttatgaaaatatgctggtgtaaaagccttaatggttttatccctcttgactcagtagagatttgagtagcaaaattagttagaattctagagactacgtgagtataggaagatgaaatgattcaggatcttccctccatgtcttaaaggcctataatgtttgatgcatagtgttataaaataatttctttgtttatactttagaaatacatgtcttttataagtagtaatgttcctccatgtngtcatcctttatttctattaggttataaatttcttgttagtgagaagctatcattgcattgtccataacacagcatatatatttacttggaaaataatcatagcaaaatattatttgaattcttccacttcattaatataataaaattagtttgagtttattttagctataggctttagaatagatgcttactttttaaaatgatttattcaaatatttttctgatttgccattatatcatgaagtgataatttgcatgcaacagtaaataaatgtttagttcctagcctatcaccacgctgggaactatgaatgtttttaaggctaaatacatgttattgtttctgtcttcaagaagctttctttttcttggagagccaagacatattaaatagtacagaacaagaagttagagagagggttgaatggtaagttgagaaggtgtggtatcttattttgtacacagtctataaaaagaaaacctgctaggtgtttgtctcaaaagaaattgctattaaaagaaatttatttttaaaaaagtaatttatttcacacaatctttcccgttttatttttatgatatttgtttttttgttttttgagtcagggtctctgttgtctgggctggagtgtggtggtattatcatagctcactgcagccttgaactctggggctcaagtgattccwcctcagcttcttgagtagctgggaccacaggtgtgtgtcactgtgcctggataatttattttattttattttatttttggagaatggggtcttgytatgttgcccaggcaggtctcgaactcctgggctcaaactattctctgcctctgcctccctaagagctggggttacaggcatgagccactgcacctggcttattttttaaaaatttttattgtattttatttttttaaaatttttgtagagacagggtctcactttgttgcccagtctggtcttgaactcctagcctcaagtgattcctcctgccttggcctcccaaagtgctgggattataggcatgtgccaccatgcccgcccagtaaattacttgtaaaagtgtatgcacagtcattataattaggtatttttggaattttccagttttatgggtctccttttgacttgtaaatatctgtattaggaatgatcacaacttgtctttatcaatagctggcatataaattattaagcaataatttagtgagcagcagagaaaaagaaaaaagtaggtatcaggatgaggtattaggaacaagcaaagaaggggctttcagtagggttacatcattatgctaggctgtgtcattaaaaatcactctgaaggcccagtgtggtggctcatgcctgtaatcccagcactttgggaggcctaggcgtgtggatcatttgagttcaggagttcgagatcagcttggccaacatggtgagtgagaccccatctctactaaaaatacaaaaattagctgggcgtggtggcttgcacctgtaattccagctacttgggagaccgaggcaggagaagcgcttgaatccgggaggcggaggttgcagtgagccaagattgcaccattgcactccagcctgggccacagagtgagactccatctcaaaaaaaaaaaaaaaaaaaaaaaaaattcactctgaaggactgtaggtcgtttgattgctcttatactcactgaaaatacaggtattagaagaacaaactaaaatttatttgcattaaaaaaatccaaaaggaaacccggattaagcatgccattataattgtttttaaaataaattctagcaaacttggttatctgggtttcttgcgaaggtacttggtaaactatccatttcatttagctgttacgtatttgaacaggggcaggatattagaggattccagtaactggtataaaataatgtcagctgtgtggaactgggagaagagtaaaacaaaaaaaatctataggagcaaactagaaaattgttacgggttttagtcactttcgctagggataggcagctcaatacaactcagtaactcggatatatctttatattacagcaaaatatcatgatgtgttttcttgatgatatttcttgttagaaaccataataaaagcaggcactatttatttttaaatttaactgtatgccagaccctattccaagcattttgtataactacattactactacagcttttttwaaaaaaaaggtgatattgttccctttttagtaatgagagaactgtataaatttctaagacaaggtcagatgggtagtgcagtgctgagatttcactttccttggtttcagttacctactgtccagtacagtagaatatttagagagagagagaccgtattcacatatgatgttattacagtatgttgttataattgttatattttattagttgttaatctcttactgtgcctaatttataaattaaactttatcatagttatgtatgtataggaaaaaacatagtatataatacagagtctgtaccatccatggcttcagacatctactgggatcttagaatgtattccccatggataaaggggcagtagtgtaaacggtagagccagaatttcagttgaatttcttctggctccaaaatcagctttgtttatgtttcatggtaaagtggcatcctatattctttaagaaggcaggaaagtacataacatatatacttaatatagtataaacaattacattttagagagagtacaaagttgcttgtttagggagtaggactatatgtacctcttaccaaacccaaacctcagggtaaacccagttttctctttgtagttttttgtttttagattcctgatcatggctaaagataattacatattggtactgatcggctttaaacaaattaagtattttacagctttccttggacttcagtggcacttagcaacacttttattcatctagtcatgagctcttgcatcctccacaattatggtttgaaactttttttgttctccttaagctcccaacctaccctactgtttctcactcataccagacccatctgttacctcgtcaagaaaatggggatttttatatcttgaaatcctatagcttgtctttctttgatctcctttaaactcttttttagtccaaccacatcactccatcttcctgtatccaagttgatcaggcctttgagaatatcaagcttcttgatagctgtgtatctgcttcaacctacaaactacacataatcttttcctttctcaaatgcctatcttcttataatttaccttaacttctgtggctgtgttactttattgcaatttctgtttatgtataggttgtacagtactgcttaatatgtttttttaattaaataagtaacttataaaaccagaactatactattatggtaacagtttcgttttttaagtcttgaaaaaataggcaaagattgaaaacaagtttctgtatttgctggagcataatggaagctgagaaacatcaaggaaaccagccttcacaactttcgagataggtttatagtttatagataggtttaatcagacattgaatgaaatatatgtatgctgtggtggaggaaaattcacagctgcgaaaaggagtgtcaagcacgttctggtggtattgtgacatttttgtatattgtctggaagtttctctccaacagtgtgttaacatatcttagtaacactgtagcattataatgtaattatgcaatcttagtctgggatttaaaatgagagtattttaacttttcaaagcacattccatcaaacagaaaagagaatcagtgtttacttcctgacttcttggctgactgtaacaacaacaataaaaaaagactaaagagggcctcacaacaagtatcaaagttagttatatgtcatattgaactcttaaaatgtattttaatttgttattcatattaacttacattaggaaagaaaaaaggtcaatgcacagttaaaagttttttattttattttattacaggcagctgttaaatctaagaaagctacagatacctataaactctatgtggaaaaatatgcattagcaaaagctgatttcgaacagaaaatgacagaaacagctcaggttggtattttaaggcttcagattgaaaacagggcatttatatttgtgtatattgattaatttttctctcatataattttttagtgttggaagttttaaaatgcacaatctcaatttgttaatgatgctgttttaaaaatacatgtcgcgttttggagattgaggaccaagatgcaataattataatgtcataaggaattatacaggtagatcagaagagcctgtttaaaggtaattggggaaactgagggcattggtacatgatgaagacagtgcttaagaagcattaataagaaaactggaagtgacttagtagtgaggctacggcagtcaatacaacccaaaaaatccctggtctcaaagaacttacatattagtgagggaagacagacacaaatgtctgccatccattagcttgggataaattatatttggtgtagtgttcttagaaccttaattaaaggcctcgtttaaggtggctgccttttaggaatcatacctaacatttccactctccgctgcccctgcttcttgtccttttccttgttttattttcctgcttagcacctatcgtgatcttacataccaagaattttattcctgtatcattcaggtcagagtaagtatgctgtggtgacacaaggccccagaaatctcagtggcttacaatatcaagggtttattactttctcatgctgcgtgttcattatgggttggctgcagctgttttacatcgtcttcactgtagtcctgaggctggtggatgaactcctttttggaatgttcttagttatgtctaaggggccagaaacagtgaagcacatgagttcttttacctatattttttgtctgtttttctccactaaaatttaagtttatgagagcaaggatggatttgttttgtttactgctatatcctcagcttttagaatagttcccagatcatagtaggcactcagttaatatgaaagaaggactttgtgaatctgaatttttggactctatgtcttcattatgtcttcccatttgaagtagtgaacagctcatatcttagaaagcgaagtcttgcatacttgtgtgcatgtatgtgcatatccatctttacctacaatggcatagactctgttaggtgctggtgtgtatacagtacatctgtaaataagacaaatatctccgtgcttgagatggtgtttacagtatagaggagggaggcagacattaaatacatgcttaaatataaagttataaattattataagtattgcaaaggaaaataataggcttccatgagatagaataatagcagtgacttaatttggattagggagtcaggaaaggccttttaagataagtgatgtttaaaactggaacttgaagagtgagtaagaaattaatagggcaagagcgttacwggctttggggatcatgagtatgaaggcccagagggtataaaagaacttacattctggaaagtaaaaaatgcttactaaacctgagtaagggaaaatggtagtgagaaatgaagttgaattgatacacaaggactaggttacattaggttggtgcaaaagtaattgtagtttttaccgttacttttaatggcaaaagaatttaggttttcttctaagagcaactagaagccgcctaagggttttaggcagggatgtgacatgatctgatctacatttaaagataattctggcagttttgggaagaattgattagagtatgtctaaaggagaatcaagagtccagtttggaagtcagtatagtagtcaggtgagaaggatgagggccagcgtagtggtcttggagaaggagacaagtgaatgcattggagatggcagggataggatgggttgaggaattcttcggaagattaggatcccttccaggttttagcttgttaaatctatgtggagagagatgaatggggaagattagatgaagaactgttagtttgatggaaggaagggatcaatgttcaattttgaacatgttaattttaagacgcctatgagatacataattggtgacatcaggagggcagttttggaggagccaagtaatctgggctggacataatgtccacagttccttatccacaattccgaatccgaagagctctgaaaaccaagtatttttttttctgtgatttatttgacaacaaaacttgacttgaactgatacgaggctgtctatagtctttatcctacgtatattttcctttagaaatattaatgtgtttgataaacagatgccactacagatcctgctggtagtattatgaatgaggtatatggcattctaaataatactatatatctttatttaaaaaacaagggaagaaaaggaattccaaaactcgcctggtcccaaaagttttgaataaggattatcagaccatataaaatagggttttgtcagtacacaaagccatgatgacagcacttttagagtgtggggaagaaagggcctcagggccaagctctgagagactcattattgagattttaatagaggaagccaaagaagaaagaagaaaactggaagtgtaatgtcatggtagctggaaaaagaagcttcaagaaggaagggtttaggtagttgtcttaaataaggcttcaagtctagtgagatagaaagttgcaatttctgtagcaactgaggtcattgcaggcttcagcaagtgctgttttgtcttttaaatcattaggagcacacatttataagggagttattgttgatatgttaatttcacattaaatggttagtctttatcagctaagcatttgccgtttcattaatttttaaaattggaataaayagagtttgctatagtcagagttttttgtttgttgatgttactttataaaaaagagcgttcagcacatctttccatttccttttcatgttctgcttcctcattacatttttttccaaaatggcattttaattgttcatcctgcctttctggtttttttgtttgttttttgttgttttttgagacagggtctcactctgtcaaccaggctcgagtgcaatggcacgatcttggcttactgcagcctttttgcctcccaggctagtgaccttcccacctcagcctcctgagtaactgggactgcaggtgtgcaccatcatgtccagctaatttttgtatttttagtagagacagggtttcaccatgttgcccagggtggtcttgaactcttgggctcaagtgatctgtccaactcggcctcccaaaatgctggctgggatcacaggcaccgtgccagcccattctgccctttttaagatgggaacattaatttatttgagcaaatgtgtgaccatgctgcttttaaataaagatgatggcatactttactaatgtgtgtgtatttgttctttctcaagatcttagagatctctgtttctgtctcaccctctctttctgtcatactctacagctgcagaataggttnattattgtttcttcatagagaatagactttaatttgggttagtttagaagggaaagtaatccttttacttctccacttaactgtttttccaggccagctgggttgaccagtctcagtgggaaagaaagaacctgacagtatagtgagaatcaaatttgggtggtaggacctatatttactagtgggagaagatcattgagtctctagggtgaaagaggttagaatttagagtatttgtgatttaagtttttaaaatttaggtttaggataaaaatgattgaaattgtgactttttatgctcatgcttttaccactattaattaatgagacacttgaaacagaatatggagattttgtttactttaaagcagtgagatggctagtttatggaaactttgagatttgttaagcagtaccctcagattaaagattattaggattagcgtacttttatatatctttagtggctgagaagatagtgtagccctgtgtcgcttaacaacagggatacactttaagaaatgtcgttaggcaattttgtcattgtgtgaacatcatagaatgtacttatgcctggccaggcatggtggctcacgcctgtaatcccagcacttttggaggctgaggtggacagatcacctgaagtcaggagttcaagactagacttgctaatatgttgaaatcctgtctctactaaaaatacaaaacttagccaggtgtggtggtgcacgcctataatcccagttatttgggaggctaaggcaccagaattgcttgaaatgggaagcagaggttgtggtgagccgagattgtgccactgcactccagcctgggtgacagagtgagactctgtctcaaaaaaaaaaaaaaaaaaaaaaaaaaagagagaatgtacttacttacacatacctagatggtgtagactgctacagacctggctatatggtttagtctgttgcttgtaagctacaaacctgtacagcctgttactgtactgaatactgtaggcagttataacaaaatggtatttgtgtctttaaacatagaaaagatatagtaaaaatcagtataaaagattaaaaatgctgcatctgagtagaacacttatgttgaatggagattgcaggactggaagttgctctggttgagttagtgaatgagtagtgagtaaatgtgaaggcctaggacattactgtacactactgtagattttataagcactgtagatttaggttacattaaattttattaaaaattgttttcttccttcaataataaattaaccttagcttattgtaacttctttagaaacttaaaaaaattttaaacattttgactcttttgggatgacatcttaaagtagaaacacattgtacagttgtacaatagtattttctttatatccttactcgatcagctttttttctgttttaaaatttttatttttttttaactttttaaatctttttcctaaaaactaagacacaaacgcacacagtaaacatgtgcctacataggcttagtatcattaggattgctcttttatctccacatcttgtactactggaaggtcttcaggggcagtagcatgcatagaactatcatctctggctggacttggtggctcacacttgtaatcccagcactttgggagggcgaggtgggcagatcacttgaggtcacgagtttgagaccagcctggccaacatgatgaaacctcatctttaataaaaatacagaaattagctgggcgtggtggtacgcgcctgtaatcctagctgcgtgggaggctcaggcatgaaatcacttgaagctgagaggtggtggttgcagtgagctgagattgcgccactgccctccagcctgggcaacagagcgagactccatctcaggaaaaaaaaaaaaagtatcgcctatggtaacaaagccttctagaatacctcctgaaggacctgctggaggctgttttacagttattgttttttctaataagtagaaggattacactctaataataaaaagtgtagtttagtaaatacatttaccagtaacatcatttattatcaagtattatgtgctgtatattatgtgctatgcggtacttttatgtgacaggcagcacagtaggtttgtttgtatcagcatcaccacaaacgtgagtaatgcgttgcactacgttatggcagctatgatgtcactaggcaatagaaagttttcatatctattataatcttctggtaccactgtcatatatggcattagttgttgacagaaatgtcattatgtggctcatgactatacttttaaaaattaatgtaacaggctgggtttggtggctcacgcctgtaatcccagcgctttgggaggccgcggcaggtggatcacgaggtcaagagattgagactatactggccaacgtggtgaaactctgtctactaaaaatacaaaaattagctgggtgtggtggcacatgcctgtagtcccagctactcgggagcctgaggcaggagagttgcttgaacccatgaggcagaggttgcagtgagccgagatcacgccactgcactccagcctggcgacagagcgagactccgtctcaaaaaaaaaaaaaaaaaaaaattaatgtaacaatacatgtgaacacagtgaatttgaagttgcagggagtaaagtgcctatctaatttgttcaggaaagttcatttatgtatactcaagcatttgagactatatccatttcccattgctgaattactctgagcttagtagtcactaattttgaggaattgtgatagttagcagtgtgcccctacccccaaaaccccacagtttcaaaattgcatctgattcatgccttgagtttctctgtggattcatattttaagatatttctaaataaataaagatctgccttgttgagtgtagctttttcaaaagggaatgaagacagtttcctcggaattaagggtcattcaaatgaaattaatggctacctgtctgagaaaatatcttgtttattaaattgctgaaatttaagttaagggccatccttctagtaaatgctcctcagttcttgagagtaattcaggatcttgaaatactggtactgtattctcgttgacttggtcaaaattaatcaatgacaagtattccactttaactctgccattcctcataaatcaaattgattcaagtttttgggctgttgcaatactgccgaaactgtaatttcaccattctggatttttttttttttagaggttcttaccatttacacattagatatcatttggtgatttctggtcaccaaagtgactgaagaaatttagacattaaatatagggtcagggaattaaatttcataaactaacaagataaaaatagtaaggcttaggcccattccttagaactgatttaatttggaaaaaaatagataaccaggtttgtacaatagaaatgacaaatgtattttgtttgaaaatgggtagctcagcatttcccaaagcctgttttgaggactattattgctctgtgagatattaatagatgttcagggaagaagaaaaacaaaagtgttgtaaggtcaaagaaatttagaaaatgccgggttaagcaaagtgaaacgtgtcattatttcagtatttctcagaccttcttttttttctccaagatggagtctcactctgtcgcccaggctggagtgcagaggcgcgatcttggctcactgcaatctccacctctcaagtttaaggaattctcctgggttcaagctattctctgcctgaacctccttagtagctgggattacaggcatgcgccaccatgcctggctaatttttgtatttttagtagagacggggtttcaccatgttggccaggctggtcttgaactcctcatctcatgatcagctggcctcggcctcccaaagtgctggaattacaggtgtgagccaccgtgcctggcctctcagagcttttgatatatttattgtgaaggcaaggcaagcagtggtttcctctctggggatatcagagtaacttggaaattttttccaaacaactttctcatctctttcaacccccattacccaggcagtactggaggatctatttgttttgaagtttgaaaaggttctccaggtgatctaacacatcctcacttttggttgagaactgctgaaatagagtatataggctttcccagatttctttgatgacagccatctcttttggggattgtatattattatttcttttttcttttttttctttttctttttttttttttgagatggagtctcactctgtcgcccaagctggagtgcaatggcgtgatctcggctcactgcaacccctgcctcccgggttcaagcgattctcctgcctcagcctgccaagtagctgggattacaggcacgcgccaccacgcctggctaattttttgtattttgagtagagacgaggtttcaccacgtttgtcaggctgatctcaaactcctgaccttgtgatctgcccacctctgcctcccatagtgctgggattataggtgtgagccaccgtgcccggtgtatattattatttcaaggattagaaagacattttgaaaatctatgggctagattataaagcatttgaaagtaaactgtagtttttgctttgccaactgattgtttttcagtttttaaaactctttgttttttttgtaacattattctcttctgggtctcctaattttctgatcacgattatagattttaatgtgtaatggctccaaattcggctgggtgcggtggctcacgcctgtatcccagcacttttggaggctgaggcaggtggatcatgaggtcaggagatcgagactttcctggctaacacggtgaaacccgtctctactaaaaatacaaaaaattagccagcatggtggtgggcacctgtagtccaagctactcgggtggctgaagcaggagaatgatgtgaacctgggaggcggagcttccagtgagccaagatggtgccactgcactccagcctgggtgacagagcaagactccgtctcaaaaaaaaaaaaaaaaaaaaaagctccaaattctagaaaagtttgtatttacctaagaaatgacataacaaaaagttaactttttgcagtgccatatttcagtttacctgctagatctgtctgtcttgaggcttggttaaacattgtgtaaaagtggtaacttggaaaatttggttatattgagttgatttcttttttttttttggagacggagtctcgctctgtcgcccaggctccagtgcagtggcgtgatctgggctcactggaacctctgcctcccaggttcaaatgattctcctgcctcagcctcctgaattgctgggattacaggcatctgccaccatgcctggctaatttttgtatttttagtagagacagggtttcaccatgttggccaggctggtcttgaacttctgacctcaagtgatccacctgcctcagcctcccaaagtgctgggagagatgatttctgaaagctcttttgattccagaatatatatgtatgtacctgtatatgttataaatctataactttgtatatgttacccagaaatttcaagatattgaagaaactcatctcattcacataaaggaaattataggatccttgtcaaatgctataaaggaaattcatttgcagataggccaggtaagtttttttactttatgttgaactattcatgaaaaatttgtttatttatagctctttaaaaatattttctcactctgttcaaagttcataagtataataccgaatttttccaaataaagaatatgtaaagataatatatttacatgtagtaaatagaaaataaactggatattttatcatttggccaccgaggatgataattcaaattaattttttaaattaactatattcagttttctttatattgaatttctaaagctatcaacttttgaatatttcttttttcaagctttactatttttaaatttaaagcagcaactttattaaactatagaacttttacttagaagtgttccacaaatataaaaggtttaatgatgacaatttggggtatactgaaatatagtagagaaagatgaagtctgttattcttcaaactagccaggcacggtggctcatacctgtaatctcagcagtttgggaggccaaggcaggaagattacttgagcccagaagtttgagaccagcctgggcaacatagggagacctcatctctacacaaaatttaaaaaatattttaaattgtttaaatattaaaaaakattttaaattgtttaaatattaaaaaagattttaaattgtttaaatattaaaaaagattttaaattgtttaaatattaaaaaagattttaaattgtttaaatattaaaaaagattttaaatwgtttaaatattaaaaaagattttaaattgtttaaatattaaaaaagattttaaattgtttaaatattaaaaaagattttaaattgtttaaatattaaaaaagattttaaattgtttaaatattaaaaaagattttaaattgtttaaatattaaaaaagattttaaattgtttaaatattaaaaaagattttaaattgtttaaatattaaaaaagattttaaattgtttaaatattaaaaaagattttaaattgtttaaatattaaaaaatttttgggtgtggtggtgcatgcctatagtcccagctacttgggaggctgaggtgggaggatcacttgagtccaggaggttgaggctgcagtgagccgtgacacccagccatctgggtgacagagtcagactgtgtgtgtgttttttttaagccaaaagtatttttgttgtctgtataagtcttatcataagaatgatgtctctagaacgctcaaagatgggaacagaaaactgctttgacttctaggggcgtgaggctatgtgttaaggggttaatgtaagtcatggttggtccctacagatccagtaatgctggaagttaggtaaattaaagtcctcaaagggccttgggtcaaaaatacatattttgatataattaattttaattgtcttgtgtaagttttatctgaaatacactaagaatgtggaaaaagaaaaagttatctttatttcattttaataggtccatgaagaatttataaataacatggctaatactacagttgaaagtttgatacaaaaatttgctgagtcaaaaggcactgggaaggaaagacctggtaagatgataaactctgcaaggaaacattttaaattttcccatatagtaactaacatatttgccttgaagatcatgtgggtaaggggtaattttaactttatatcacatatctgaagttaaaaatatttccaaactgtgaaatggagccaacccaaaaaatggagtatacctaaaaatttgtataaaatctcagatattactatttttatgtctgatgatacattaagatttttgttttggcttttagtggttaatacaataatttagtattatttaaagtggttattataacattttactaaatctgtcacagttttagatttttcaaaatagagtcacctacagaaggctattttaataaaagaaagattgggagagaatattgaacgctcagaacattgagaccaacgtagaacctttcttaaaatttaataacttctttcttttctcatttatatatacatttaacaaatatatttattgagttctaacaatataccagaccccattctagaaatttggggatacaccagtgaacaaatggatataggaatcctggctcctatttttatgaaaaaatgattacagaagttcaaattctacttttaattggcatgttatgatgtatcaaatgtaataagtaccccattcccttccctgctcagcatacttacagtcctccagatttctttaatctatttattagttactatatcatgttcttgcaagatacatgtttcactccataagtaaaaataatttagtgcattaaagaagttaaaatatgatatggcattccagaaaatgggtaagagatctgtgaagtttgggaaccatatttcctcagtgcagttcatagacctaaggcttgaaacctaaatcatctttaatttcttcttcccaaatttcattaaatttttaatcttactgattcaattgtattagtatttttcccttcagactttcttttcatgttttctctagctgcctaattaatttgcagatttcatactggtacagcagacgtttcttctccaatctattttacatgttatagcacactcatcttttgcctatacagttatgaacttataattgtaccacttacaaatctttaaattttcacgttgacagaatgaaagtgggattctggacttggtttcagagcctttaaggatctcgagctgaccagattttagtcttaactttcttctttttttttttttttgtttcaaccacaagtgtttattgatatattttaatggaacaataaggcacaaccgtggattaaaacagtttgctatacagccaaaagaggggaaagctataaccttaggaactttagatatgcaaatcaaggagcctctgaagtacctctctatagatcagtgtcagacattcttccgttttcacttgatcacaaagtctgactgatacttcatgaagaatttctcattcatttatatttgagccatccagcccagctacttccctgttctctacccttttccatcactttgcagtggtattttttttagcaatccccttcctaaataattatgtacacatcttcaatagttttccaaagcaaggaaacaagcacgcaagcagtgaatcagagaaagtcagccaagggcagatgtttggataaatagactcatagggacatacattaggatggcaatagcttgattcactgaagtctaaactaagctgactttggcagaaaagttgctgtggcttgttcgaagacctgtaatgccaccttaggttgtgctactagtgccagacctcatttttaagggattagcagtggtctatacaaggaagtaggaagctagtgtaaccaggcagctaatgatacaatagtcaatgctttggacatgtattaggagctgactatggcttccatcattaacatttgccaagtgtaaaattcataaagaattttgtgactgagcatggtggttcacacctgtaatcccagcactttgggacgctgaggcaggaggatcacctgaggtcaggagttcaagaccaacctggccaacatggtgaaaccctctactgaaaatacaaaaattagccaggtttggtggtgcacatctgtaatcccagctacttgggaggctgaggcgggagaattgcttgaacccagaggcggaggttgcagtgagccaagattgcgccattgcactccagcctgggtgacagagtaagactccgtcttaaaaaaataaaaaagaattttgtgcaaaacttcaagatacggaggaaacaatctttaaatgttttggactgggataagttaacgctaatctttctacttggaaatgtgaagtgaaaaacattccagtgcacgtaacactaagtcataaaccatgctgcaaaggtgtgaatgcgtgaggctttatagggtgtccagctgccttgataaaaagccatgaaaaagtccccaggcatattgccagagcagtcattctggtggtaacggtgtccccaaactaaacaaacccataggcatattgctattttttgaacagtcaacactgcactaacgaggagccatgtaggtaaaagttgagaatcagaggccagaggtagagtgatgtgggcaagcaacccagaagacttgtctccacacctctcaccaaggccacctttcaagatgagtatctccacccagcagccctttgatgacagagtagaatgcagaggatagtgtcatacttctcagagaagtgttggttaccaaaaagctcctggagaggcaacatcccagaggcccatttaataatgaaggtaaataaaaactgccagacccctgaactatcctgtcaagtcaggaatacatagggcatagcagtgccaagtagaacagattagattttgaggcttactgaaaagcagaaagactgccagactaagcaaacagtatgttggatgacacagaagtaggaagcaaaggacatatgaaaaggatgaagaagcatggtggcatacttgctagagggaaggcagtagggctacagtctacatctggtgaaagagctttgctggcttgttcttggcatgattccgtctctcactttctcagactgtatggatatgcattcagcagcagaatggggaaaaagatacttataaatgaagaactagtgactggatactgaacagaaatagactgggtgtaccattctgtaatgccctgtttatgcatcaaaggcaggtttgtgttgacagaacatatttggggttgtcgtgcaacagcagtagtactttgggagaaggggaatgatnggttggaggtggggttggtagaaggaggactttcaagttccagttattaaatactagaccgcaaggaacagtttggtctctgtcctttagtgaagaaattggatgctcattttctgttctacatccaccttctccaaaaccttaacaaattctgtgagagatatggcactgtccccatcctgatcagcctcttgaatggtcctgtctgcgatgctgccgagctgctcatctgagatatttactctgaccattaagtgtagcacctgtatcagctcaccacgggagagcttatcatctttatcgaaatcatatagtcgaaaagcaaactgcagtttgttgcttcggctgttgagtggttcgggtccattcacatctttgctcttttcattatcctcaatggggtggaaatgagccaaagttcacatgaatccatggaagtttacctggtcctctccctctggaaagaagacattgatgattcggtcccccagtgggttgatgacaagttctggaatcctcaggaaatcttcatggctgagaatgccatctctcctttgtccaggctggtgaaccggctgtagagcaagtgatttgactgtgggaaaaactgatcttctttatctcctcaagctcttcatcccacagtaacatggagggctgagaacccatcaccactggggagctcctatgggtgcagcggtgccagaagtgatggcgacaggagggaaggagggagggtgagaaaggataggggtcaagaagggagagggcagtcttaactttcttttactcctattcaagtaccttcactgaggccaacctgaactgcttgctgtttcacatacatgcttccttttttcctttagtactttagttgtccttaatccttactctagaaaatgctgtattccactactttcctacaccacatctttaccacattcattcatcatgtgttgaatgaatgaactctttaaagagcccggttattatctttaatgatatctttctccatcaaaagtgccagagaacttatatatttctttcttgccttgttgctgtctaccattaaatcttaatagtttgtacttgtgaaaaagttctgtatttgattcatctattttctctatttgtaagcagtatatatttttgttaaatgaatgaacaaatgggcatttaatggcaagattagggtgttaagaaggttggaatggagtggctattagaaaattttttaagtgaatgctaaataattatggttaatgtttagtgagctcttactgtgtgccatgtaccatgccaaccactttgtaggcacactttgattttcagcaactttttgaagtatgtactattattctcattttacagatgagggaaatgttcagaggtaatgttgagagatttgtctaagctagtacatggcagaaatgggattcagttctgggatttttgatcctggatcacaaatcaagtcacatgctttggaaaaattagactagaactaagtgtagatatgttgacataaattttaattttgagaatgcctttaaaccagggggacttgaccttaaatgtgaacctaaactgatgaacgataaccttttttccctgggtcacaaatgatccagagtatatttaagcaaaaagaaagaatacagagaatgagcttgaagtggatcagtgtttttcttaaagtattacactagagagtaattggaacattaaaatgtgttctgaatcaagccaattttattttgatttgccatttttttgtgactttttttcttttccctgatgcaatttttcccactctgctttggcttcctgggctctttttactgctttttgcttttatatgccagtgtcatttcctaagacactgctcagccaaaggctgacaagtatgtggcatgtgctgccttattcatggcagataccgttgctagatcattgcattcgtccccggaggagatctcagtctctctcatctcagtgctgtaggcagtcactgccaatattgagtgttggtactcatgttgaaacctgtcatctccagcttagttcaatagagactttttgtttgcgaatgtcagaaagccatataaacaagcttaagcaaaaattccatgcattggctattttaacctggaaggctggaatagattcaaggtccacatggatttcatcaggactttggttcactcttttctttcatttttgcttgtctttacttggcttcagtttattaagttcctactgtagactttttcctcatagctggcaaggaagacatcaacagtccaagcctatatccattctgtttagaaccctagtagaacttattttttttttgtagtgtcagcatattaatttcaggaaaggttctgcttttgtcacatgcttatctttgaataaatctctgtgtttagggtagtaggatattataattggtcagcataggtcacatgcccagatcatggaggagcaggatttgtattctgaaagggataatggaaatatcttttgaacagacaaaaattactactgtagtacattgtagaatcacagtacaaagataccaaaccccaaaatataacgttttagaactacaataggttgtatatgtatttcaggtgtaggatttaatcatgttattaatgtttaaataattagaaataacagtttaagaggcaggaatttactttataattagataaaactagaagataaaagttacataattcggtttgtctaataatcatggagttttattgcataagggggccttaaaattaatgtagtccaaggctgggcatagtggctcacgcctgtaatcccagcactttgggaggctgaggcaggtgtattacctgaggtcaggagttcaagaccagcctgaccaacatagtgaaactccatctctactaaatataaaaattagctgggagtggtgatgtgtacctgtaatcccagctacttggtaggctgaggcaggagaattgcttgaacccgggaggcagaggttgcagcgagctcagattgcgccattgcactccagcctaggcaacaagagcgaaactccatctcaaaaaaaaaaaaaagtaatgtagtccaaacacatttatttaacacacagaaatatgttggaacttatcaaatatatgccactaatttcgtttaatatagacttgcaggtgaatgaaagttttgtcagttcttagaaattttgctaactcaacatatggggattgctgaacccttattcatcataatgtcctacttgtcaacctactcatttattctctatgaagaactcaacaaatatacagttattataaattcctttctgttggttaggtaataactgtatattaggaattacctttaagctcactgcttgattccttttgaattctggacatttagatcatgtttcttttttcttttcttttccttttttttttgagacatggtcttgctctgtcacctaggctagaatgcagtgatgcaatcatagctcactgtagcttcaacctcccaggctcaagcgatcttgccacctgagcttcccaagtagctgggaccacaggcatatgccagtacaccccactgatttttaaaaatttttagtggagacagaatcttactatgttgttcaggctggtcttgaactcctggactgaagcaatccttctgtctcagcctcctgaagtgctgggattacaggtgtgagccactgtgcctggctcatgtttattttcttgtctgtggtgtagtgcagtggtttgtgacctgctctttactagcagtgagacttttttttttttatgttttattttttttggagtcggagtctcgctccgtcgcccaggctggagtrcagtggcatggtcttggctcactgaacctctgcctcctcggttcaagctattctcctgcctcagcctcccgagtagctgggaytacaggtgcccaccaccacacctggctaatttttgtatttttagtagagacggggtttcaccatattagccaggttggtctcgaaatcctgacctcatgatccgcccacctcggcctcccaaagtgctgggattacaggtgtgagccaccgcccgcggcctagcagtgagacttttaaacctcagtgccctcatctgtaaagtggggataataatagtaactgcctcatggggctgttgtgagatttacatgagatagtctacatttattaataaatattgttttcaaaaatgatacatttctcatgaataagtagccactaatgtagtttcattataaatttaattttactggccttaagatatacgaagtcatgtagaaaatacttacagctagatggtaggaggtaatagggaagccaagaacggtgatgacatgggctttcgtagagtcactaaacccagaattaggtggctgtttcaggaccccaaaaagagtcatagaactaggacttttaaacagtcctagaacaaactaactagtgtggggtggagtggaagggataaatattatttccctggttgagttgctatgggtgactaattgcagctttttcatatgtttttgtttgtttgtttttttcttttttgagacagagtttcacacttgttgcccaggctggagtgcaatggcacaatctcagctcactgcagtctctgcctcccgagttcaagcgattctactgcctcagcctcccgagtagctgggattgatggggcccaccaccacacccagctaattttttttttttttttttttgagatggagtttcgctcttgttgcccaggctggagtgcagtggcatgatctcggctcactgcaacctccgcctgccgggttcaagcaattctcttgcctcatcctccctaatagctgggattacaggcacccaccaccctgcctggctaatttttgtatttttagtagagatgggatttcaccatgttggccaggttaatctcaaactcctgacctcaggtaatcctcccaccttggcctcccaaagtgctgtgattataggtgtgagccactgtgcctggcctcttttgtatgtttttgatcagtttatgggcacctgagcaaatgagtctagtgactcactgcaataacaaaacttgtgcttcctagaaaaataacatagacaaaattttgcttgtgattgtgtggaatttatggacttaaaggattttgttttgtaaagtctattctaaccttcaattgttttatactattgatttctgttaacattttatttctcctcttttgtaaggagcccctctggcggatgagttccaccctaaactagctttagttctgtgggatagagatctttaaaagaaaacaaaagatccaattcttttaaaaatttgtatacatagctggatgtggtggctcacgcctgtaatcccagcactttcggaggccgaggcgactgaactctaactactccattgagaacgcctgcagaaaaaggcaaggatcgaggtagagagaccactgcatgactgttggaataatccagggtaatttaagaagaaaagaggccaagtgcagtggctcacacctgtaatcccaggactttgggaggccaaggtgggtggatcacctggaacacctgaggtcaggggttcgagaccagcctggacaatgtggtgaaaccctgtctctactaaaaatacaaaacttagctgggtgtggtggtgggcgcctgtaatcccagctacttgggaggctgaggcaggagaattgcttgaacctgggaggcggaggttgccatgagccgagattgcatcattgcactccagcctggacgacaagagcaagattccgtctcaaaaaaaaaaaattgtatacataagttaacctatttctctgatgctgcaaaatgacaccaattttatttttagtcagttatctattgaaagatacaacctgtcagtttgtgttttcagttcttaagtcaaactgagagcattacaaatttttttctaactcgttatgataatgttatattacttattgtatgtactgacactttttgtcattgcctttttgtttgttttgctttttttgagacagagtctcattctgttgcccagtctggagtgcagtggcatgatctcaggctcagtgcaacctccacctcccgggttcaagcaattctcatgcctcagcctcccaagcagctgggcttacaggcgtgcatcaccatacctggctaatttttgtatttttagtagagacatagtttcaccatgttggctaggctggtctcgaactcttggcctgaagcagtccacctgcctcagcctcccaaagtgctgggattacaggtgtgaaccacggcacctggcctgtcattgttttttttttgtttgtttgtttktttttttttttttttagtgtagtaatggctggttcctctggaatttgagtcactgtaagaggatgctttgaatattaaggcacctgtggtctgaagggatcatgaataaactggtgttttctaattttgtatatctttttatattccattgacattgcccttgtaaccctaaccactctcaggtaattcagttgctaaaagagagtaaaatccatattttcaatgttttctattttacagtcattttggtaattttactttatgctatttataattcataaaagttcagcaggtttccatttatatatatacatatagtgactattttctcccagtctggcttgttctttttttttttttccggtgtttttgaagagcaaaagttaattttgatgaagtgcagtttaccaaattttggttttttatgtgttatgcttttgtgtcaaatacaagaaacgtttgtctaatccaaggtcacaaagatttttaaaaatttttctatttcctttagttgaagttttgtagtttagaaggacacaggtgataacctgaaaagagttcccagtggccaaagctggaattacttgagcaagtaataagtaatgaatatattagatcataacacaaagaataaaataaatagccattaatccatacagataaaaataaatgagtaaagaatttaaaatttatttcaaaattttgtatacatgttaatacaaaaggtgaccaaaagatttggacacttcctaaaaatatatatatttatgaatgtcaagtaagcacatgaaaagataccccattcgtaattagggaaatacagattaaaaccacaagaaaaatagcagtagacacttawtagagtgataaaaatttaaaaggctgactataccagccaggcatgctggctcacacctgtaatcccagcactttaggaggccaagatgtgtggattccttgagcccaggaagtcgagaccagcctgggcaacatgatgaaactctgtatctacaaaaaaatacaaaaattaggcgtggtgttgtgcacctgtagtcttagctacttgggaggctgagaggggagtatggcttgagcccaggaggcagagaggttgctgtgagctgagattgtaccacagcactccagcctgggtgacagggcgagactccatctgggaaaaagaaaaaaagactgagtataccaaatgctatcaaggttgtggaagaactgaaactcacaaagactgctggtgaaaatataaaatggtgcaaccactctggaaaataccttggcagcttcttagaaatttaagcgtacacttaccatatgatccagttgttctacccctaggcatttacccaagagaaaaggaaatatatgtgcaaagacttgcatatgaatgttcatggcagttttatttgtagtagctccaaactgtaaacaacccaaatgtccattaacagatgaacggataaacaaattgtagtatttccatgcagtgaagtactactcaacaataaaaattaataaactactgatacatgcaattacatggatgaatctcaaagtaattttgctgagtaaaagaagccagaccaaaataagaatacatattatatgattctttttttttttttttttttttgtgacaagagtctcgctctgtcacccaggctggagtgcagtggcgcgatcttggctcactgcaacctccacctcccaggttcaagtgattctcctgcttcagcctcccaagcagctagaactacaggcacgcaccactatgcccagttagtttttgtatttttagtggagacagggtttcaccataggccagggtggtcttgaactcctgacctcgtgatccacccgcctcggcctcccaaagtgctgggattacaggtggagccaccgtgcccagcccatactatatgattctatttatataactttctagaaaatgtacactaatttatagtgacagaaagcagatcagtgattgccttgggaagggtggaatgggttacaaaggagcatgaggtgataattatatatgttatcttgtggtagtagactcacaaatgtcaaaattcattaaactgtacaatttaagtagatgtagtttatcatatgttaattatacctcagaaaatctgtttaaaaaggagttgggaagaatcattttaagggttttggcatgagtaactgaaaggatatggttgcaactaacatggagaatgcttatagacataagtactataattgaaagtagaaacaagggctttatcaggatcatggaagatgaaaacatgactcaaccttatgagtatggggacactgtcaaaatgtgtatgtaagaggagattatatttcagtactaagattctgtggagaactagataaaattttggaatgtttcacagtgactgaaatctgtggttaaaaacctatttctttgatttaagactatagtttctaaatttttctcatagttttcaagccttgggtactgtattcgtccattctagtgttgctaaaaagaaataatctgaggctaggtcatttataaagaaaagatatttaacttggcgcatggttctacaggctttataggaagcatggtgctggcatgtgcttctggtgagaccttaggaaacttaaaatcatagtggaaggcaacagagagccaccatgtcacatggcaatagtgggaacatgagacagatgggggaggtcccagacactcttaaacaaccagatcttgtgtgaaataacttagcgagaacacacttattaccaaggggatgatgctaagccattcatgaaagatcctcctgcatgatccagtcatctcccattaggccccacctcccacgtgggaatcgcatttccacatgcgatttggagggtacagacatccaaaccgtatcaggtacatacaagaattatttttggacatttttttctttgcatttttctttttttatgtacagaaattgatttcttttctttctttctttttgttttttttttttttgagacagagtcttgccctgtcacccaagctggagtgtagtgacatgatcttggctcactgcaacctccgcctcctgggttcaagtgattgtcctgcctcagcctcccaagtagctgggattacaggggtcctccaccatgcccagctaatttttgtatttttagtagagatgggttttcaccatgttggccaggctggcgttggactcctgacctcaggtgatctgcctgcctcggcctttcacagtgctgggattacaggcatgagccaccatgcccagccaagaaattgatttcattggtccagggtggataccactatattttaaaactcctcagctgattgtaactagcagccattgttgagaacctatagcatcacactacatgaatgcttgttataaatggagaatctcaaatcctatcccagtcctactgaatcagaatccgtattttaataagatcccaagatgctctgggctttgtatgcacagtataattggagaagcactgtctagactaattaaatatctaccagtggccacagagtctactaggrctgtatttctcaaaatgtgattccaggaccagtggcatcacctgggaatttgttaaaaatgcaaatatttgagctccaccctagaccttctgaatagaacactgtgggagtggagcccagtagtctgtggtttaacaagttctccaggtgattctcatacataatatagtttaraagcattgcgccaggagtctctcatgaggtttgaaactgctgaattgaggaaattgattcarcaagtccttttttaaaacacatactcctgaagtgaagtgtcattgatgtctgcaactttcaaatggtttagcaaaagaaaaaaattgtataaggctatgtggagagagagagaaagcaaatgctatatttgttatcatttaccttttataaatgatacaacctaggttcaaaaagagcatctagttcaaaaagagtatccaaattagaatttgagcctctataccctgtgcatatcaccacaaactggagtgtgattctcttttttgtgttagcttgcctggcctatcatcccaggcatctgggaatgtgactgtgttgcattccacaggcccaggagcaagcttgaaaatgtagtaattgatttccattgttatgagtcacaactctttccttgctcatgcacacatgcacacaccccttcattatcatcattccttttattaaacttttagtgtatgtctgagagtgtttgtgtttagctctgattagaagcagaaatatgcttgatttgaatagcccagactttctatttgagttttgagggcagtttttaactaatgttaaaaacttgtcctgttgatggcctgagatttaggattgattccgaagcaacagggattattaattaaatatttcacatattttgtacttttcctcagtccacaaaacatttgtggtgatcaaagattaccgttcagtaagttgcttttcttcttgtaacatcttttcaaagttttaatccaaattaggtttgaatggattctttaggttgatggcttttcttatagcatttatttattcctacctgatgattaaagcatcatatttaagaattgttttgctttgaatcattgacctcttagagctgttcttctgttctatgagtttaattgaactcatagtggtgttttaaaataatgtgtaaaagagcatcaggagacagagccaaaatggttttatttgcttttatacaaactaaattgcccttgtgacccaacataaaatttaagtgctaagagcagttatttattttgacaaaagaattaattgagtctaaaacagttaaaattccagttgtagcaaactattcattaagactctcactctggctttagtactgtcaaaaaaaataacttgtcttatgattaaatagcagaatgatgggcagtggactgcatttgaaggagatgctgaataaactttccacttgtgaaacagttcagaagtgacatgctacagggggggtcagaatgtgcattgatatccagctgagttgtcaactggcactgagccaggcacgcaaagccttgccatgtgaagcggcatgtggagcatatgccatttgtaaaagaaaatcttgttcatgcatgatttaatggtttttttaaaaaggtagtatttagttttattatgccagaaatcattatttctatctttaatagaaaagtttgtgtggatggtactcaatttaaaatttttaatatatattttttgatttgaagtgatttggcatctttcaaaatgtgttttttttggacatttttctatttcaaatggattttaagaggatgtttagaaaacataagagaaatcaagatatgtttactataggaaaagagttttgtgagaacaaaaaggagaattttgtttaaagggactgattttatggagttaagagatgtctttactgttttcacatgtatgaagtcatccaaagattttacaaatctttttttctgtatgtaccatatttgctaagatgatgatgtaaaagtccttctagataatatatatttagtatttgtaaacaaggcaatttggcattggtgttttgtttttatggtacttacttttttctactctctagagtaagcgtgtggcctgagcattagagattctgtaaatagttaatgggtagaaattatgtggatgtgtagctgtaggagaatttttgactaaccacatgcctgattgcctttttttggtaaaccctttcttgtctcaacagacgattatattttctcaagctttattagtacttggaaaagccaataatatataataagctgttggtaatttaggtagagatttgttattcataatttttatactaagtgaaaagttgctaatttgcacatctcaatttctttacccttattgatttttcagcctgccttcatctcattgtaaattgttacgataggcctctaagggattctaagaacaagctcagtacccttttattaaatgatttctcagcttccagatttgcagaatgggtttgaataaagtccttaaatttttaattgggtcattttctgactctttaaggcttttttggatagaagtgataaacattttttttagtccttgttcatatttagaagaatgtattagtaaggaacatactaataattgattaggaccttgtttatcaactcacttctatgactgttttattctgcttattagtaaatgttaatttattttatttgaatggaaactagaaccacacagaaataaatcttaggtttagggggagggagagggacattaagacaatatttttagatccccctatttgtagagaaatctttcttgttaatcaatcagtggctttcttttttaatggaatgatcaataataatgctgatcatgaatttgtacatagttaagcttcacatctcagaagaaccagtaacaaaatcctctatcatctactctctgtttcaagctctattttaaaatttcttcatatagcaagttataccagttaccattaataaattaaaaattatttcacaaaaaaagctagactttcatgaatttatatataaaaagtactaaatgacagcttagtgggagataattttttagtctcatatttagcttctgggatatttcattaggagagtaattcatgttttgctactttctcacactgccaaataatttgatatttcacatatatgaagtatgccatattttatggcaattaaggctagtctgagcagtcagtcatttcagggctattttaattgttttctaatgatttccactttatcatcatcctcttctacaatctatctctcatagcaatgctaaattaattgtccttgaagatctctttgtgggtggatgtgtatgatcttacatgaaaactcttcctatttcctgtaagctgtagttcacattccttgacctgctatacagttagagagatctggattataatcccaaggtcaccacttaactagtctgtaattagttcatttattcattcaataaatatttacttatttacccaacttattatttacctggcattttttaagtattgaagatacagtgatgaacaggacagatgaggtcccaagcttatgttctagtagtatttactatcttggtagccctgttcttcccatgaacaccaccgaggattcagcaaccacctttaccatgcttgtttcctctcattaacagtactgccagcttcttgaaagcagaaactgcatattcttgtgtctctagttttgtggcatcatatgtaattggttttcagtaaattattgtgatcataatgggctagtcttgttatttttcactgttagaattatttgatttttaaaatttattgstgatattttaattattaggtaacaactagaaccatttcagaacaattaaaaagatgcgttgtcaattaaaagtagaataaaaaatttaaaatgtaaaaaaaaagttttaaaatttmcctaatagtttttttctactagaagtttttcaatttctttttttccaggcctcattgaatttgaagaatgtgacactgctagtgcagttgaaggtaagttgattagttataatatgttaatgcacatggcagctagctagtatcttctgttcattgaacaaataaggagggactgctatccctaggtgtcagcatacctatggaatggaatgctgtaaaaatctgaaattagtttgaaggcctgcagatgctacttgctgcttaataaataacagattttcccaaaataatattagtgtgttagattatatatttttaaagattgagtataacatgcatttgtttttaaatatacattgaaatagttttcttcattgacatccatgtttaagccttgttccatgtttaagccttgttaatccatgtttaagccatattcaggaatatgaaactcatctctgtaatgtgtagtgctaattgtacagtgggtaacatttcattaatttatgttaatattaccatcatttggctgggcacagtggctcatgcttgtaatctcagcactttgggaggctgaggcaggaggattacttgagtccaggagttcgagaccagcctgggaaacatgttgagaccccatctctacaaaaaaacttttaaaattagcaggtgtggtggtgtgcacctgtagtcccagctactgggaaggctgaggtagaaggattgctggagcctgggaggaggagtctgtggtgagctgtgattgtaccactgcactccagcctgggcgacagagtgagaccctgtctcaaaaacaacaacaaaaacccttcttgaatttcttcatctgtaagatgaggggctagcttaaacctaaggtctctactgctctcttctgtttttattttttgggagacagggtctcactttgtttcccaggctggaatacagtggtacgatctctgctcactgcagcctcgacctcccagatccaagcgatccttgcacctcagccccaaaattagctgggactacaggtatatgccatcatgcccagctaacttttgtattttttttagagaaagggtttcaccatgttggctaggctggtcttgaactcctgagctcaagtgatccatccaccttagcctccaaagtgctaggattacaggcgtgagccaccacacccagtctctactgctcaattctcaaagagtaaacacctaagttttaagtgctgaattcttttttntgagacggggtcttgctctgtcacccaggctggagtgcactggcgtgatcttggctcactgcatcctccgccttctggttcggatgattctcctcccttagcctcccaagtagccgggattacaggtgtgcgccactacgcccggctaattttttgtgtgtttttagtagaaacggggtttcaccatgttggccaggctggtctcaaactcctgaccttaggwgatccgcccacgtcggccttccaaagtgctgggattataggcgagatccaccacaccaggccttaagtgctgaattctatcaaaagttaatagcatgactggcctttaaaaataatttgtcatgaaagaagaggatgccttattaggaawatcaaagataatttttactcctcggttatggtagaatccatttatagcattgtttgtattagggacaacattatggacacaagaatgccatattgtaaacttacttcttttttgtttttttgtttttttctgtttctgtttttttctttttaatttttgaggtagggtctcactctgtcactcagggtggagtgcagtggtgtgatcacagctcactgcagcctccatctcctggactcaagcaatcctctcaccccagcctcccgagtagctaggaccacaggcgcgcaccaccacacccagctaatcttttgtatttttttgtagagacagggtttcaccatgttgcctaggctggtcttgaacttctgagttcaagtgatctgtccgctttggccttccaaagtgctgggattataggcatgcatcactgcacctggccccatattatacttctaatgggtctgctgtatcatctttttatctaaaacaataaaattatattttgtggccctctaaaaagcaaacatgatttgacctttataacattatttgacgtttataacaaaatttagtataatgaataatgtactttctttgaagttttaagatatctccatatgcttattatgtgtaaggtgacttaagggaggcttaggaaaagaaaagaaaattttatctataaagtaaatgttctatgatcttttgataaacaatagactatgttttattaacataagaaaagtctaaccaatagggttgagtggttgctaactttatttctgtcatccacatttagcatcagcagttatgagcaaattatgtgtgaggatgcaagatgtatccataagtttaatatgtttatcaggaatgtttatgtttctgtaacaatatatatttattttaaaggtataaaaccaaggaaaagaaagacctttgctttgccaggaatcattaaaaaggaaaaagatgcagaatctgtgtaagtattttaaatatcgtcaaaatcctttttgtttttataagtgattaagaataagacttttgaatttggaaagaaaaaagtattttggaaataactcaaaagtrtatgtgtaaggtgtgaaaaacaagcctttctaaatattaataaatacatttgccaattcctctggttttagatcaaagtattattaattatttgaaaatgttaagacattatagacaaaagctttaatgtctagaaatggaaagttttgaaatatccttatttttgtaaaatgataaatgcatattttaaaaaattaaaagtgcaaagaaaactaaaaattcatcaaagtcttaatgcctaagagaaaatctctggtcaactatttgatgaaaatccttctagacaattctgagtgtacaggcacatggtgatacctatacatacattgatggaaaatgttaaataggggagagaaaagccctaacattttaccatttatactaggtcatcatttttagatggaatatttggtccacttataagtctgatttaccttctttttttttttttgagatggagtttcactgttgttgcccaggttggaatgcaatggcgcgatcttggcttactgcattctccacctcccaggttcaagcgattctcctcctacctcagcctcccaagtagctggaattacggcgcccaccaccacatctggctaattttttgtatttttagtagagacagggtttcaccatattggccaggctggtcgcgaactcctgacctcaggtgaaccacccgcctcagcttcccaaagtgctgggattacaggcctgagccacgcgcccggcctgatttaccttcttttaaaaataaaaaattaatatacaaagaatatgtaataaacatgtaagaaattgagtttagattagctaactaaagtttttgtttgtttgtttgttttttactttggctacacattagaactacctgggaaattaaaataaatacacctatgccaggtcccacctcagatcaattaaatcagattctctaagcatgaaacctcaacataggttttgctcttttttgttttaagcagcccctttgattcctaatgtatacctggggttaagaatctttgagccgtgattattcagagacaaactagaattaaaagaatctttctttcaatgattactcagtccatttagattgaagagacaccgatcaaaagtcttgagtcaaaacaacaaaaaaatttgttgacccaccaacattgactgaaaattagtttaaaaacccagcttccctagcataatcaaaggaattctcatgagatttaatatttgatgggcactcatatttttaacataagagaacagtttgtgctttgggtattcttgctttctacctagttatatttctatttgagtttcctagaatttctttcattttaaatgactctcttcccctctcccaagtagtatttggttaacaaatcaagaccaattgcaaagtcatctatatctatagttatcaaatcttctgcaaatgtctttcttgagcatttatgaagggtatatttttaagggggtgaaacctaatctattttataatattagcaatacatattgaaatctgatcaattgattagtaagtaaatgtttaaaatatatctagttcatctgttagtggctatattgtaaagaatcatggccttaaattatttttataatgtataggtttcattactgttcatgtagggagcttatagtattttttaaccaggtttttaaaacagttttccttatcaataatttcccaatatgatattaagccacttagggtggttttttgtttttgttttttaaccaatggcaatagtagagcagaaagccactgcttaaaccactgtaccatcatcaccttctttcaaacttcttggcaggaaaaaatgttagaattcactttgcctgaaatgccagaggctcttggcatgcctcttcatagcctgaaggcttttgagatgctagtaattgtgggagacaggcccttttcagagcttcctcttcctggagcttcatctgcaggtgtcatacagcccactgtgagggcaaacagataagtactttaccccaatgactggagtgttttggcctaaagccagagaataaactctttggaactttaacacttccttttatgttcaaactgcatcttttttaaaaaaagaagaaagtagaaatgttctaacatcttgattaatttgattctctagaaggattgggttattattattatgccttttctggaacatttcttcagattatgcataagtttagaaaaatataatgtttctcatctaccagtaaggaagctgtatttcaaaatgtgcaattttaaatgacttttaagtggatagaaagtcacctggggggccaggcccggtggctcatgcctgtaaacccagcattttgggaggccgaggagggtggattacttgaggtcaggagttcaagaccagcctggccaacattgtgaaaccctatctctactaaaaatacaaaaattagccaggtgtggtggtacacacctgtaatcccggctacttgagaggctgaggctggagaattgcttgaacctggaaggccgaagttgcagtgagccgagaygatgccactgaactccatctagcctgggtgacagagtaagactctgtgtcagagaaaaaaagaaaaaaaaaaaaagaagaagaaagaaagtcacctggggtttgcatttaccctgtctctttggtacttcgttttggattaagagcaatgtagtcatcttcctcctttttaattttttcagtctgttttatcctattttcctttaagaaaattcttcaattttgtagattcttctggtgtttgcttagtatttggataaatggcgtttatctgtttgtataagattttgacacacattgcgtatcctttgaaatgcttgagaccagaagtgttttggatttcagatttttttggattttgaaatatttgcagaatacatccagttgagtattcctaaaccgaaaatcccaaagccagaatgttccaatgaacattttgtttgagcatcctgttagtgttcaaaaactctcagatttwggagcactttggatttcagatttttggattagggatgctcagcctgctttgtgtgcattaactgtcacaagtcagaggtccaaaaaccttttaagtctgcgctcttaatttttgtttgtgaatttattttagagtgcatacatggaaattcttctaacctcatttttaatgacctcactgtccttagttgtacatatttaggtcttctttataaacataaacatagttttacattttaaataatacttttcactagtgtatatgcaaattcaatacttgtttatcagttaaatgatagaatttcagttctcaactacatattacattacataagaaagttatccaactggaagtctactcagtatatttggaaaaaactagctttaacttttgtatctactaagttatggaaagtacttcagatgaaactgaagtgtttaaaaattgtattttttccagtagttttgggttttcagactacttgctacttaatactgacttttttttaaagtcaagctttcttctttaaggacatttttttaacttgctttacttgaatgaaaagccattagaaagccttgtaggactgacagctttcttgatgtgtgagtatattcatggaaaagaattatttttcaawataggtttttgaatatttataagctctcaaagcataatgtaagctgttagaaaaaaaggaatacttgtaagctgtttgttttttattttgtcaggtggtatgggtataagaatgccttttttgaattttaaaataatttggtatgttttaatcttcatggtttgatttctctgaatattttttgtagagtttaaataaaagctatatttaagtaccaaagtaaatactttaaacaagcataattagcagacaattctaattattgagtatttctgatattttgttttaatagggaatgtcctgatgcagattcattggtaagtagatttaactttgatataaacaatttaaattagttattttcattaggacaaacctaacacatttgagttgagttgttaccagtctttcaaagaaaaataccatcatattgtaaattcactattaaaattattttacagatgcatttttggatttacattgccagatgctttcctattaaatagaaagtatttctaaccacctttgaagagtggacattttacttttaaaattggagtggtgccatatcattctgtttttttcttgggaaacatgccagaaatcaaatctgtatactttattttaaaatgtggtgttcttactaatttattcttagctctattaaaatacaacattgtgcgtgcatttgagttcatttaagagcttgtcattttagaaataacagcaacaagaaccatggtcagtacttttctgtgctttttgttttattttaaagaagggttgcttatatttcttgattaaatgtatttctttatgtgtaattaaagaagacatcaaatggagctccctttggttacagtgagagagtagatttaccaaatgctgttaagtaatgtgtagacagacatatttttcaaaactgttcattagataccgttcatgttgataagtataggggtttcaaacaatctctgtcctttgcttattgttcttacctgcgtaactattgtttcctttgatcccaaaacattttgatcttttacagcatcatagtgtaacaaaataactaaaaatattttgtgaaacactgtgttttatgttacttaactaagataaaattagtattttgttttatattttggccttaaaatacaattatgatttgttaacaaatttatatgaaaaataagaaatagacttataatgagttacggggttaaaaccatcagtgtatttttggagttacaatgtttaccttaccacttggttactctgtttgatacccttggttaactaattaatgaaaagcagcagatgtgtttggcattaactttagtactcattttatttctgcattatttttatgcattttatttctgaattatttgtagcattaaattgatgatgtaaaattaaatacaactttaatacttcatgttttagtttacatatattccttttaaataaaacatttttaattcagtaactgatactattttataatgatcaatattatccaattttgaactttacttagtacttatccagaatacaaaagaatacagaattctaatactgaataagaagtgattgatgaatttgactgtgtagaaatgaaaaatatataaaactagaaaaaatacgttataaaaggatttgaattatcagagactggcagagcatctttgcaagacgtgacaggggttaattgctttcatttataaagtttatatgcaaatcaatacagaaaataagtgggtgcctagtaggaaaagggcataggataaaaatggtcaattttcataaaaagaaataaaagtgataaccataataaatattgctcaaaatagtggtgttcttctggtggaaattagaatgaatttagtctagtgtctaatcatattggcaaatttcttttcaatttaattttttgttttttaatttggaaacaaggtctcactctgttgctcaggcttgagtgccgttgtgtgatcatagctcactgtaaccatgaactcctgggctcaagcaatcatcttgcctcagcctcccatgtagctgggactacaggcacatgtcaccatgcccagctgatttcttaaaccttttttttttggtagagttggggttgtgttgcccaggctggtcttgamctcctggcttcaagccattttcctgcttcagtctcccagagtgctgggattacaggtgtgaaccactgttcctggccaacaaaggttttgatatgctcatactgttggtaggaatgtaaattgatacygtctgtcttgtggatagtttggcagtattgccccaaaaaagaaatgtgagttcatttttgaccatgccatctccctgctaggaatttactgttacagttatagtaacaaaactttacacacacacatacacacacacacacacattgtattagtgtgtatatgtgtgtgtatacatatacacacatatataaagtatatatgtttgtacacatgcagacacacttgatcaagattcatgcatatatagaaagtgataaatagatatttatttcaacattgtttatattagcaaaaaactggaaacatcaaagcatccatcaaaatgggaactggttaaataaattggtggggtaatagatgttataaaggattaagttgatctgtgtctgctgatatggaaagaacttaataaaagcaagtatgatattttaagtgattgctgttttaaaaataagataaatatgtggatatatgtattatatttattttagaagaatgagttacaaggtactttacttgtggatacctttggggccaagaattacagtgatcagtagagaaaggagacttgtttttacttattttattttgagatggggtcttgctctgtggctgatgtgacttggatttgtgtctctgcccaaatctgttgtcaaattgtaatccccagtgttggaggaagggattggtgggaggcaattgggtcaggggatagatctccccctcgctgttctcgtgatagtaagtgagttctcacttgttgtttgaaagtgtgtagcatctcccccttcactctcttcctcttactctggccatgtaagatatgcttccttcctctttgccttccgccatgattgtaagtttcctgaggcctccctagccatgcttcctgtacagcctgtagaactgtgaaccgattaaacttcttttctttataaattacccagtctcagatagttcttgatagcgatgtgagaacagacgaatacagtcacccaggctggagtgcagtggcaacgatcatagctcacttcagcctcgacctcccaggctcagccattcctcccattccagcctcctgagtagctgggaacacaggcatatgccaccatgcctggctatgttttttcatttttagtagaggcaatgtctcactatgttatccaggcttgttattttcttttatttgtagcctataaataataacttacggcctattcatggcttcctcttactaattattttttaaaacatcaataggctatcatggtagggaaattattgttcatttcttattcctttctttaaaggtctatgtaatttaaaaaattatttttagcaactgcatcttttgaaagttggccaaggaagtgtaattgctctttttttcttttttctttttctttttctttctttttttttggttttggcctatgtccacattccaaacagaaattaagaaacatttcattgactcttgagctccattctggtatatattttttaaattgccaccactactttagccagagtaaacaactgcctttaagattgatgggtgaagttgcctgttctattcttgttcatactgcttttgacctagggcttcactccagctgtatgggccctaatatagaaatcatggattgaatgggtaaagatgaacacaggtaatgggtacgtttttattaatatcaggtttctgtgcatagttctagcagtaaaaagatagtacactgagaatcactgcttttaagaaaaactttttattttgaaataaagatgcatagaaggttgcaaagatggtgtatgtaacagtactgtgtacttgttaccccttcttcctgacactaacattttacaaaactgtcatgtaatatcacaactgaaatattgacactaattcaatcaaaataggacattttcattagcacaacaatctctcatgttggttgcccttttacagccacttttccttacgccttccttaacttctggcaaccactaaccttttcttcattcctataattttgtcaattcaaggttgttctgtaagtgaaatcatacaatatgtatgcttttgagattggcttttttccactcagcacagttctttggagatgtatccaggttgtggtacatatgaatagtttattttttattgctgagtagtagtccctgttttggatgtactaaagtttgtttaaccactcacccattgtaggacattttggttgtttttcaatttttggctattagaaataaagttactatgaacaattgtgtacaggtttttgtgtggacataatgttcctctctgaccctgataatgttctttatgaaatctactttatctaacataaagacagcctcttttcccctttgttattattcatgtttgcctagtataattgtttccatcctttttctttcaacctaactatattgttatatttgaagtgagtttcttatagacagcagatagtttgattatgtttttaaaaatccattctgccaatctctgccttttaattgatatatttggaccatttatatgtaatgatattgtcagattttaagattgccatttcttgttttgtttgttcctctgtttttgtttcattttgcttttttcttgcctttctgtaggttatttgaatccttttttagaattacattgtgactttatagagtttttcagtgaatcacttcgtagagtgattttagttggtgctctaggtcattttccattacctccagctggttgtttatggtggtttttttgttttgtttttaatagagctaggttcttgatctgtggcccaggctggagtgcggtagcacaatcctagcttaccacagccttgaactccttggctcaagtgatccttcctgcctgagccttccaagtagctaggactacaggcatgtgccaccatacccagctaatttttttatttttgagtagagacaaggtcttgctatattgagcaggttggtcttgaactctcggcctcaagtgatcctcctgtttgacccccccaaaatgctgggattataggcctgagccaccgtgcctggcctgttgatgttttgatcagaatttatcgttgtagtctacaggaggttggtccaaaagctgcttactcagccatatagaaaacagcttggtattattaaattattacattgtgcatttagtgtattctctaaacaaatggtgtattctaaacaaatttaaagtagtccattgttaaatttgagatagaacctctgggagactaaatacctggtgtgtttttagggtacttggaatggggacyaagtattttgaaaaaaacctttcattctgatttctaaaagattcacaattagcaaagtttccttatttttaaagtattttaaagtgatatttgcatattagcaagcagtagaaagaaagggctctaccttcagtgttaaaaatatggcctttgtcatctttttatccgtggaatctgctcttcaccctacattaggttttttatttctagtttttaattccatctgttaactcactgctagctacattagactgtttatttagtctggaagtgatagtcacataaatgctgccctcagttctccctaaccttgtgttgtgcctgccttcacagttcttcatatctttcttgctgagctttagaaagtgattagaagaacagaataccttaccagtaaaaggatttttgctgcaattccttggcagccttttctttccattaaaatttttttgaaatttggaaatcatttctaacttacaaaattgcaagaatgaaataatacgaagaacacttgtatgccctttatttttgtcacatttgcattctctctctgtttgtgcatgtgtttatatgtgtataatattttttctgatccatttgagcacaaattaaatatattctggccctttgtctctaaatacttaagtatatgttgtcccaaaatttcaaatattccattatctaaccacaaaaacacattcagagaagtgttcgtctttcctgtgtccttctaccccattgcccttccttgtaggtaaccaactttattgtgttctaattatcctttctgtagtttttttttttaaacaaagataagcagatgtatgtttgtgttcttatttgcccttcttacttaaaagttataatactatatatgttctttactacttggctttttaaaaattagcagtatttcctggcaatcactccatattagttcatagaaacttttttccttttttttttttttaacagctacatagtataatcgttcctcagtgtccttgcaggattggttctagaaccccctgaggataccagaatcactgaatgctcaagtcccttacataaactgtcatagtgtttatatataacccacacatatcctttaagtcatactttaagtcatctctagactacttataatacctaatacaatgtaaatggatattgtaaatagttgttttactgtgttttttaaagattcatgttttgtgtatttttattttttatttatttatttatttcgagacagagtcttgctctgttgcctaggctggagtgcactggcaccatctgggctcactgcaacctctacctcccaggcttaagcgatcctcccacctcagctccctagtagctgggctgcaggtgcatgcctccatgctcagctgatgttttaattttttgtagagatgagatatgactatattgccagctctactgctggtctcgaactcctgggctcaagcaatcttcctgccctcagcctcctgaagaactggggttacagtcatgagctaccacaatcagcttattttttattttttttaaatatttttgccgggcacagtgggtcatgcctgtaatcccaacactttggggggccgaggtgagcagatcaactgaggccaggagttcgagaccagcctggccaatatagggacaccctgtgtctattaaaaatacaaaaattttctgggtgtggtggtaggcgcctgtaatcccagctgttagggaggctgaggaaggagaatcactgcaggaggtggaggttgcagtaaattgagattgggccactgcactccagcctgggtgacagagtgagtctccatctcaaaaaactaaataaataaaataaaaatattttcaatctgcggttggttgaatacatgcaaatactgaaaccgaacctgcagatatggaggaatggctttacccattttgtgtatgtaccatagtttattcagctgtgcttggacatttaggtaatttctaataattacaggttataaataatcttcgatgaataaccttgtgcatatatatttttaaatagttggagctgtgtcttcacggtaaatttctagaaatgggattcctgggtaaaagagtgaatatatatgtagttttgttacacattgctgagtttttctctgtaggggttgtgccaattattgtattaatacccacaaagtatgaatatgcctttcccctgcagcttcactaacagagtatattttcaagcttatgaatttgctatcttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctgaatttgctatcttaatgtagttttaattttcttggtagtcttttatttctcattttgtttgttttttgcttatggtttatatttacactctcagtccttttgcttcaccacaccacaccccaagatacacgtagccttaaccttttatttctttactttgaggatttgaatgaaaaatttatggtccacaaagctgctggcattcctacccaaatacctgttttcttccttttattttttcctagtccttgaggaacagggaggggcctttttgtcttatcctgttttttcttgactcttagagtaccttgttctcattttatctcacatatttgtgatatctgtagtatttattggctcctcttctgcttttaggcatgcccagttttctttaacttgaaaaaaacctttttctgaacacctgaactgaatgtttgtttatctttctttgactttgtgtatgttatttctccttgtttgcagtgttctttcaacttatgggaattttatgatgtgaccagaaaaccccttcttgaagctgttaaaatgcattaaaactaatttctgagttataatatttaggcaacttctgctgtttttaatactcccagctagattatttttatctttttattttgaagaattctaaacaaattgtgtgtgtgtgtgtctgtgtgtatacacacatatacatatatatacacatagatatatacatacatatacatatacatataaataccatcatggtctctcattttggggtctcatcagtcagccccagcagcttgccccagccaatcctgcccatccatttcctctgcccaaattctagaatattataatttcatctgaatttacattatatatatctttacacttgatcttagccaaaaggccaagaagcgatacatcatatatatctttaaaacataatcacaatatcatcacatctagaaataatttattactccttagtattttgaaataaccattcagtatttatcatctttgatgtccattttattatgctttgtttgaatttgttgatatgtcttaagtctctcttgatctacaggttccccttccctccctccctctctgtttagctttctgctatttatttatttatttatttatttatttatttatttatttattttgacagagctcgctcttttgccaggctggagtgcagtggcgtgatctcggctgactgcaacctctgcctcctgggttcaagcaattctccagcctcagcctccagagtaactgggattacaagcatgcaccaccatgcccagctaatttttgtatttttagtagagatggagtttcaccattttggccaggatgatcttgatctcttgacctcatgatccacccgcttcagcctccaaaagtgctggaactacaggcgtgagccactgcaccgggcccgctttctgtgtttttattggcaagactaagtggtttgttttatagtttcctttagtctggattttgccgattatattgccatactgtattatgttttacttctttatattatttaaattggcatttggatctagaggcttgatcagatccaggttcaagttttttttggtcttgttttattttgtcagggctgcctctctcatgacacacatggtgtctggttgtcactctttatggcatgttggcagacattgatggtttgtcttagatagttttactagttcacccagacttaaactgcataaggaggtgctagatcttatatttccatacagcttatagcaataagaatatttagcttgataatagctttcaaatcacatgtactttttaaactaacttattcttcctcatttataacagaaactgtagattttgagcaatctgaattggtccccacctcagtgatttcttgccctgaaattatgagttgtgtttctcctgtttcattttgcaggtctttcctctttcaggtagccagagcatggagtgtgatttgaagctaattaactaaaaaggtgtaatttttcttcggtgttcatcatttcattaacctgttgatatctgagaagcggtttggttcctwagtaatacctgaggctactttgataatctctaataattttgtacattggagttgtcattataatttttttttctttttcccttagaacattcctgatgtagatgaagaaggctacagtattaaaccagaaacraatcagaatgatatcctttcatcatctagtattcttaaggattatgttggcatataagtaggcagttataagaaaatcatgtattaaagcctcttccaattttttattaattataaaatatggttccttgtttgtcatttgacatgttttttgttgttgttgttttttgttttttttgggttttttttgagacagagtctcgctctcttgcccgggcaggagtgcagtggcacaatctcagctcactgcagcctctgcctcccgggtttcagcgattcttctgcctcagtcccccaagtagctkggattacaggcatgcgcaccatgcctggctaatttttgtatttttagtagagacagggtttcattatgttggccagccaggctggtgaagaactcctgacctcaagtgaaccacctgcgttggcctcccaaagtgctgggattacaggtgtgagctaacccgactggccttgacatatttttattaataaaagttagtagtcttatttctgttaaggtctgtttttctctttggtttttttgagatgaagtctcactctgtcacgcaggctggagtgcagtggtgcgatctcggctcactgcagcctcctactcctgggtgaaagtgattctcatgcctcagcctcccgattgtctgggaccacaggtgcatgccaccatgccgagctaattttttgtatttttagtagagacaaagtttcaccgtgttagccaggatggtcttgatctcctgacctcgtgatccacctgccttagcctcccaaagtcctgggattacaggcgtgagccgtcgcacccggcccaaagtctgtgtaactcttaaaggtttcattccttttttaaaataaatgtgtgaaaaactggttatacgtctaaggtaatttaaaaacaattctttaactgaaactcacataccaaagagaaccatttctactcatctagtgattctgactccgaagatgaagaaccaaagaagtatcggatagaaattaagcctatgcatccaaataactcacatcacacartggcttctttggatgaattaaaagtatctatagggaatataacactctccccagcaatatctgtaagtacaaacacgtttgtactctttatataaaagtctttatttttcttacctacctgtgtctggtcaaacattacttagcaattgttaagcatgttgactgaggaaatacttagtttataatttttatacagggaaataaacttgtgaatttggcttaattttgcttttgaaagtagaaagtgaaaatgtcaaaaatttactatttctgccatttgttgcatttcataaacagtgctgtgtgtctctggcagaattctttgaattggcagtattaatttttgcctcatctaattttgaagtgtttcttctatgttttgtgagccttatgtaggagggaattttataaaaatgaatttaaagattaaattatatatttgcattttttttagtctgtcactgtaacatttattttcccatacttttcatacaaggaaaggcacagataagagttcttagtggtaatagttaattcctcaattctaaaataccgtatttaataggatttgagggagaaataaaacattntcccagtaaattttttcctcattgatgtcaattttaaacttaaaaatgttacactatgtgaaaaaagcaattcttaggataagttaagtatatctatatgtgatcatcatgattgacattaagtctgttcttcttgataatgaagaataaaggttctcaccgtttcatattgttgtctaattacatattttatgtagttacatgtatttgtttggaaaaaaaggtggttttctcccagtcatgtacttcagaatttagtttcagaactattttcttcctaccaaaaatatttctgaaatgaggttttattgtaccattactatttaacgttaagattaatgttgaagtacagagttgcttaaaagttggtgaatatagggccgggcatggtggctcacgcctgtaatcccagcactttgggaggccgaggcgggtggatcacaaggtcaggagatggagaccatcctggctaacacagtgaaaccccgtctcttgaaaaaatacaaaaaattagccggtcgtggtggcatgcgcctttggtcctagctactcaggaggctgaggcaggagaattgcttgaaaaccatgaggcggaggttgaagtgagccgagattgcaccactgcactccagcctgggtgacagagcgagacttcgtctcaaaaaaaaaaaaaaaaggtggtgaatatatacgaagtatgaggttgtaaaccattaaaaatgtgtgttatgtaagagcataactaatataaaatatgtatgttaaatatataaaacaaaagcctagaggaatatatgggtagtgagattgtgaatagttttaaattttctcttttgtactcttctcttttcagtttgtttttaaaaaacaatgaacatgtattaatttcatactatgaaaataataatcagaacaattttatagttaatattggataagaaaagattatatctgaatatattttgctgcctcatttgcttaactttttcccacctgacagtgtatgtgttttaaggtgtatatagtttagatatgattgaatagggaatgataaattattacagcacaaaaatacagtattcagaattctaacctaattttctttttcttccatgtactactagagacacagtccagtaagtacaagattttatatttttgcccattgacttttaaaatcattgtaattttggaagattgactttcaaaatatttgtattaaatttttagattagcaagttttagtgttttgttgtagatgttgctttaatattttaaaaacattagntgttaaaactacatgtattattttttgctgtaaaacaaaaactactgttttttctctatatcttttatgtaaatacactttacaattgagcagatatactaaaaacaacataaaattaggttcccagtattaacattttaccaaatatttaattatcaaattcatttgttttatggtacctattttgcatctctgttttaggtacagatgaatcggaatttgtctagtaagtttgacatttgaattgtttattttatgtctattaaaatttataaggcaatttgttagtcttttacctttagctgtagaaataaatgatcttttctcatcatgagccctactgcgtggctagaaggataattattttaaatagaaaacagcgtatctatattatttcctgtagagctgagagacatgctttaaacttcaatacatggctacaacatttttcagaaatcaccaaagccaaaaagtaacttctgattcagaatgttaaacggtttcactggcattctctgtcttattaaccagaaagcgtttataagatgagtaatattgaattttacctatttttaagttgtgtcacaattacaaattctattataatttaattatactaaaaattatactaaaaacttttctaaggtgctaataccttttgcagaatcatgcattaaaaataacaagggttgtgggaaaaacagttgaagcagcccactcaaaagctatgtaattttgttaacagaagacttaacagaaactttaacatcagttttattaaaaattctaacagagtttaagagacctagtaaatgaataataaataccaaaataaaagtaaggattttatctttaaagaaatgttgattgtagcttaatgatagggggtgtgaggaaaatgaggataaatgsagggtgctgagttgtggagatgagagcaaaatgcagaaatattgaagaatagcacaataaacactgaggcaaaacaaccaaccaaactgagccaagtgaagaatgtagagtgaatggttatcatgtactgtgatactcctccatagtttgtggaagttactcatattgatgtactttgcattcatcaggtattgcttggtgatgcaaagaaaacatgaaggtgcagcaaaaattgcttatgcaccaacatgagtttttcattaatgatgctattcccctgtttaccacttgcttgtgaaatgaggcacattacaaatccaaaaggtagcaaaacaaactatcttataaagagacttgctccaggttgctgtaagattcttaatttttcaaaatatgacatcctcaagagttaataactactttttgtcaatacaataatcactaataatattcttagaacttgaaaaatgcattcatgattcatcagttaaaattcttaactagaatttatgtatttaaacatttttctaatttttaaagttgcaacccatagtttctcttttctaaacagcaattttaatgaatatcatagtttaattgacttaagtcatttcttactaaagatattagaaggaaccagggtttwgtaatttcagttattttaatgtacacaatagaaaacttgttaaaatattgtttgtatttacattatcaattccaaaatttttaattgttatagtgttgagatatgtgtatagagtttctgtttttcattaaaatattttatttctcagattatgaagttttcatattttaattttttaattagatgaggagttaacaaaatcaaagccatctgctccacccaatgagtaagtttccatgtttaattttgttaaaaaatagactttattttttagagcagtgtttgatttatggcaaaattgaatggaaagcacagagatttccctttatgctccctgccccttcatatgcccagtctctctcacagtcaaattctctcaccagagtggtacatttgttagaatcagtgaacctgcattgacacatcataatcacctaaagtccacagtttacattagggttcattcttggtgttggacaaatgtgtaaggacatgtattcgtcattatagtatcatacagagtatttttgctgccctgaaaatcttctgtgctccaccttctcatcccttcttccacacacttacattttaagtatccttttgtcnttttttctagagttttattagctctatagttttaattccagtaaagttctgttaatcatcctgttttctgagctgtcaaatgcaatgttggagtttttagaagtttaaaattatttctcgcttggtaatatgtccttttacaataaaaaaaatctatttaaccacagttggccttggtagcctcactacttctaaataaatgatgaaaccctaaattcatacatatctgtatttcagctggttattctcatgggaattttctcatttcttccttcagttttgactgtgacgttataaaataatatacttcgtaagcttcaaaaaaagaagtgtgtcaagttggaaagggagagagaggctagaaggcatgttgccagctcttcttaaaaaaaaaaatgttaagccaatgtttcatgggtctctttttacttctgtgtctatcagttaagaatactctctttgagttaatggttttttgcttgtctgttttgagacagggtcttactctgtctctcaggctggagtgcagtggcgtgatcatggctctctgcagcctcaacgtcccaggctcaaatgatcctcccgcccctgtctcccagctaatttttttcaaaattttttttttttggtagatactgggtcttgctatatttcccaggctggtctcgaactcctggactcagactcctgagcctctcaaagtactgtgattacaggcatgagccatcaagcctggccagagttaatgtaaaatacaagtaaaagtaggcttagttaaataggtagtttacaattatttgatacttttgaggtactaattgagcatagtggtggtatttattggatgtatcatttttttaaagataagttgttgagtgttttaaaactgtttttaggagtcatacagttgcaatgctaggctttatcatacgaggtatagtgtgctttcatgtaggtgcatgttgagatgctggatatgtactcttatgtaattacagcactttcattatagagggcctgtttttttgtgtgtgtaagatttcctaaaattttttaaaataatggcagtttgatgcattaaaatatgtaagccacctttctgtacttaagggcttaaaaaaatcactttaccctttttcttcatctttgaaaataagtatggccttataaaattttaacccaattttataccacttaaattttcttttcaggattgggtgctatgtgtgaaccagcagatgtgagcctgttttagaatcaagtagctgtatgtctttgggcagttcatttagacgtgtgctgctcttttttatttgtaaagctgaaattattattcccattatgatagcccccaaggtggttgaatctaacaaggcatgatgaatgggaattaatcttccccattctcctctgctaacttcacatgttatcttaggttacgcttctaacaaatattggctgttaaatctgttaattaatttctacacatatactactgatagagtatccaacttttaaattaaaaaaaattattttttttacggacggggtcttgctctgttacccaggctggagtacagtggtgcaatcatagctcactgcagcacagaactcctgggctcaagtgatcttccttagcctcctggatagctaggactacaggcatgcaccaccaagccaggctaatttaaaaaaatttttttgtgtatattgggtcttgctatgttgcctaggcttgatcttgaactcctagtctcaagtgatcctcctgcctgagcctccagaagtgttgggattacaggtgtgagccatggtgcctggccctaactttttaattatgtatattgagctgttagaattctatgaaataaaaataagtgactagaaattttatactaataaaatattctcgttaaaatttttgcttttaaaaatattatggtagaaaaggaaccagtgatttacttgcttgggaccccctatttggaccatctcttgattcatcttcttcatcttcactaacttcatcatcatcaggtaaatatatatatgtatatatgtatttttttaaataaagaatactttagttgctttttctcattcactttttgtgcattgtacttaatgatcaaaatttctaaaaatttgtcctctgtattgccaaataaaagtgattttattctggttttgttctcttagatactctatgacttaaacaataaaaattggtaaaatactaagtggttttttaaattggcatgttatttctaggcatttcatatcattatscaaataataattcttagtgtttatagataattcaaatacaaaatatatatcaatgtaaccagttctttcttgttggaagtttaagttgcatctaattttctagtattatgaacatccatagaaataacaaattttgtgcatatgtctcataatatgcttgtartaatttatcaatttaaaatttatggcttacaagatgatgtccatgatacttattgccaaactgctttctagaaaggctttaacacttcccaagcagtttacaaaagaagttgataaatgttttttagttgktttggcaataatatatgaagtttctcttttcattagtcaaaaagcaggcaccaaaaatgtatgtttaataaaaccactgcttgttcaaaacaagaaaataaaatcaattttagttgatcttctaccctcttctctgggacttcagaattgccatccagtatttggggttaaggaagcgctggaatcatgcgggaagaacttaaatctgtctagttcatgctaggtaactttgttaggagtgccacacattctatttaatttcaccacattaacagcagcatgaagttgtttttattgtccctgttttatagatgaaaaaagtaaagctcagagataataagtaacttctccaagattatatagctagtaaatgatgaagacaggtttcaaacctggctcttacttattctaaagccattgttctatctgtcacactttggcagattaacagcaacaacaaaaaagccatgttgaaatatcttactattaaaaattaaatattggtttttaaaattagaccgtttagcaacaaaatatttttaaaagatactataagtggattataagaaaccttaaccctaaacactaaacgctatttgaccttttgaagggaaggtaatctgtacttaatacttgtaaaacagcaagaaacwktcaatagatagtkgaacataatctgaagtggctttatagcctttctcattgagcatttgttactatttagtattataaaattaaccatatatatattatatgaagaaagtaattgtacaggaaaatctgatgttgttgccagatctctcttttgtttagtaaaaatgtcagaatggcattttgtatttagaatgaggagttctcagcagtattttcgaattttgttaatatccccttatgaattattaaagtctttaataaaagttttcaaattggtatcacagaggttttatttatatagaaatttctttataattctgctcattgtttcttgatattttctctagtacagtctctttcattttataaaagtactctttcttccttttgctccctgtctaaagagtgtttggctcatatcaccatcacttcaggtaaaaaatggttcgttttcatttagtggtcattgatgtttggccattaggaaatgatacaatatttattaacttcttgctggttttaaaattcacttcagtatgcatttttaaatcttcctatatagtatgaaaagtaatgttataaattttgcctttcaaaaaaaaagttaatgatgctcaaaagagatagttatcttgttatatagtagttactattaagtcttcacttgaacagaatataattgatcaaactaattaattcataattgcgattctcctgttttacagaactggccctaagtgaagttacgaaataggcattttatcttaaatttttatttcacttatttttattgttttcttggtactcgctagttacaaccagtcttaaactttgtcccccattctttgcaatgcacttctctcccatcttaacatcctctacccaggtacccattttaacattttagcaaggtccaggttgtgagatcattcagtgctctcctgtgtgtctttcataatcttaattcatcactgacctcatcttaaagcaggctaaaaaataatttcaatcaatcagttaataactgatagttaagaatcccagtgttgttacatgttttaaaatgttgattagggcttggctgaaaagtagtttcagttgcatcttataccatgtagactataaataagcattcatgtttatgtcagatatgaatatatataaacatcgatatgtgtatttttaaaaatttaacataaatatcttacgcctacctcccctttgttaagtgccaatgtagattactttctctgcctatgaattaattgaactcttgtgctcacaaaaaaaaaaaaaaccgcttaaaatgattttttgaaaaatattgggctgtttttaaatattaactcgaacmctgatgtagtccgatgtacttcctgggggcagttttatcactggacaatgatgaactttgttgagtaccacacatacacagcattgttgctttgccaccttgtcgaatctttttagatcttgtactgactataaatagttacctttgctcctctgggaaaacaggaataactctgactttgtataattttggaccttcagtttttcatatgcattttaagtttctaatgtacatacttcttcagttaatatagtttgaacttatgctcttcttccgtgtattgttattaaattttctagtttcaaataattaaaacaaggtaactatttggttatatggatttatgtttaattctagaattttccttttgcttgtagttttttattttcttcttcttcatctgaacttgtagagcagagtaggaacttcagttcctttctcactgatttgcctgggtgtgtgataattgaaaatttacttgaaacccagtcagattctgagtctagaaagtccatcaccagacttgtcccccaaatctctactttattctgctgtaacagcaccactcgagagcacagataaagttccttttgcttcatggctacaaagtcagtggattttctttactgatgaacttgttacaattaatagctccagtgttgctcagaaggcattccagagattgcattgtaaagctgaaaatacttttaggtttcctaatgctttggatgggatttcttccgacagctgcatctctgaggatcacagtgacctttgcctaatattagatgttttgaaaatgtacctgcagaagcagctaacagtgctgctgctatttcttctacatcatcattattgcttctagattctagattagtttccacttttgttcagataaagaatggtatgacaagcatgctttgtctatttgctttagttaatgtctgagggcagatatagagtagcccttatcgcctatgtttttttatacttcacaggtcaatttatatttcttgaaacactgcttctaatagaaatttgtagcactgatctccaccccaccaccagcaaaaaataaaacacaggacactgaagaaagtaaacaattgcagttatctccttcagaagcttctagaagcagtgcctaattgacctatgcagatataatatagattcatttataaacagtggtgttaataagtattgttactagcttttctcgaaaagcaaattttgaactgaacttaatacttctaccaggcttggtttgagtcaatctaaatgccatttggacagaccacttgatcagtaataaatgcctctgctgtgtaaactctctcacaagtttraaataacataggctagtgctagtttcattgatgatgaacatatctttaaagtagatatgtaatacacagggaagtgttatgggcttcagattttggtgcacatttcttccagggtacagcttcaagtgtgagtgcagcatgaaagaactggtactgactggaaaaagacagtggcctcagaatctaagcttgatttactagcttttttgttttccttaagcaacctgaacagcgtttgcatcttttatctcttattatggtatgctttctaagtgattccctacgtcccatgcatgtacaactttcaatccgtgtgactacctttttctttaggtctcttcctactacctctatgcaccttcctttcatgcctccttgattcctccattgatgattaaaggcctttagctttgcagtttatttccccgtgtgtatacttaggcccacttatatatttttaattttgtacatctctaaactttgaaaacatgctgaatatgtttcttcccacccattatatttttcagtctctgaattatagcctgtattttagtgtgagccaaagggctttgaaaatcatttaagttaatttattaatgattattaaacatgattttaaagagggtttaaacctatttacttccattttttttactccttctttgattatgctaatacatttgtgacttttgatgatgtatacatgacatttatccagtaatttacattgtgatgagattaagaatactgatatttctgatttgtaaaattagcaaatggcattgaaaaactcaacactaaatttatataggacttaggaacaagttaagatattattttgaacacttaccaaagttaattgtaatgatttggggaattttttttagtaaactaatagaatatctgattatctcaaataatgtaccccccaaaatgttacaatgtggttcaacttaaaaggcaaatttaacaattttaattaaggtaagtattttatttagagtttacaatattattctggaggtacagcttcaaaggcttggtctcgaattactatctgtaaaatagatgtattggcaataaacaaatgacctttggccttaaattgatttgttctcatcagctaatgtatcagatttaatttttatatgtatagataatgaaacaggaataaaatttatatgtgtcagttattgaaaggttaactttttttcaggaatattactggtcacttcaaaataaagcatatttgatagattcccaatatttcaacatctataattacatctaaaaaaagagcctcctgaaaaatgagctttgattaccaaaagtttctttataatagaatgtctttatgtaaggattgctacatactaatgattttcttcaaattctcttttccccctcaaccagccaggcccacaactcctctttctgtaggcaccattgtcccacctccgaggcctgcttccagaccaaagcttacttcaggcaaactcagtgggattaatgaaatagtatgtactcaggttttttaaaaattatttaactgttttgatttaagatgcaaatgctatttttctrtatgcccttttacagttaattgcttgaagttttctacccatgtcctcacagtatagaaaaattttcccagctagtgcttcctttactcttccttgttaccacagtgatcatacctgtgagacacgacattgtccaggaggaaagagatttcctgagaaagttggcacattataaaaataccattcagtatccattgtctcacaataaagaagcggttttcatataattctacttaaagtcaaatgttaaggaaataaatggtggcttgttcttagaccttaaaagtatactgcaaggaggattatggaaggcatctagctcagcatttaaaattttacacataaggaaactggagtccacatcatccagttgacttataaaagtacatgcatgggtgggaaaagcattggtttttaaaagtcatcagatagagaaaatctatagactctatgcagtgaggctctcccagtctatttgcctttgatctggtttgttttgcttcatcttctacactaattgccagtttaattaccagaattaaatttctaagtccagtttaatcttttttcccttgatacacatttccagtggtttctcagtctgtgtggttgactgttttagctgaatgtacaagagtctttataaagctgcctcaacaacctacattaccagactaactgtccatctttctccccttttcaacctaggttccagccacttgaaacttttcagggttccttaaacacatcatggtcttttacatgtccatgtcttcttcctgtgctgtatctcaaatgcccctcagttttctatgtcacaaattgacttctttctttaagacctagctaaacatcaccacctaggcaaaaccctctttgatcattccttcacttatcttccttatacccagatactttgcttatatttttgttagttcatatatcaccttgtatgtactttttttgtgtgtgttacctttactgggctattccttcgtcagtctcatatcctcagtactttgcatgatgcctgttgggtggtacacagttatgaaatcttcagtgaatatattgaaaagcttcggcaccaagtattgaaatggtgatatctttcttttccgaatgaacagacttagtggaagtaaaataaaagactaggtacaagctgccaaggagaaggttattatttaagtaatatagaaattactacattttaaaatacttcattctcttttttaaatcgttatgactagaactttgagtacattctaataaattgatttttttttcctgattgtaaaaacagtaaatgatcgtgttataaaatttggaaaacagagaaagcagagaaggaaaattataaatttcctctgtatttcaccacccaaagataaccactgttaacattttttggaatgcataagtgtttatccagaggcagtaaaatatagttaaaagtacaagcttattagccacgtattagctgagcaacattaaacrgttatttaatcagagtttagttgcctcatggataaaatatgtgtaatgatattaggttgtgagacttaaatgagttaatacatgtaaaacagaatattgttgaatgcaaatagttgctcaaaaattattaattgtataggcatatttttaaataaaaagtcatactttacatatttctaatttgttttctacttgcaaatatctttctatatcatgaattattctttgattataattttatttatagaattaggggatacaagtgcagatttcttacatgtatatattgcatacyggcagaatctgggcttttggtgtacccattaactgagtagtgaatattgtacccaacaggtaatttttctacccttacccttttcccatcctcccaccttttgtagtcttcactctctgttattccactgtatatgtccatgtgtaacctttgtttagctcccacttataagtgagaacatgaggtatttgactttctgtttctgagttatttcactcaggataatggcctccagttctatccatgttgctgaatgaattattcttatttcatagtcttcaagcttctttaaagtgatagaatcttttgccaaataactttaaattgtaagtattaatatattaaaataaagtgggactcatagttgaatccttcacatcatccccatatcaccatacactaccctctccccatccttgagagccttctagaaaccaccctctgagcttcagggagcactattttaagtggctacagagtatttcaatatgagtgctctgtcttctacaccgttgtcrgaattaaatttctaaatgttttcagaaatttatttgacatttagttccatgtttttgttattataaacaatgtcttaatgactgtccttatggtttcttagcattcttttttaataaaaaattttaaaagtgcaatttatgaactaaactgtatgtacatttttaagactcttgatgattatttctgtatcacccaccagagagagtatgttgatttaaattttctccagctgtacattggagtgccttttcttttttttttttttttttgcatgctcatatgtgcatttttctggagagagctcatagctttcaccagatgctcaaaggagtctataaccacatcctccctacccactgaaagaaccactcattgttctagagcaggggcacccaacgtgcagtaccagatcagtagcattagcatcaccagggaatttggtagaaatagtttctctggcttcaccccaggcaaattggaaattcaggggaggggccaagcaactgtgtattattaacaagccctccatgcgattctgatgcctgctaatgtttcagaaacattgttttaaagcaatgccgtccaatagaaatataatataagcaacatataatttaaagttttctagtagccacatagaaaaacaatggaattcattgtaatatattttatctgctatataaaaatattattttaacacattcaatatgaaaattaatgagattttacattccttttgtgtgtatgctgtgtcttcaaaatttgctctgtatgttgtagcacatctcaatttggactagtcacatttcacgtgctattggccactgtagtagatagcataattctaaaattagagaaaaccacttgagaaaagagctgtttttgccttttcctaaaaaaaattaaaaaggcagtcacattatgttggcctagaggttatgttgccataggagaaatgtcccacagtagttgatctcaagactttttccaagcttgtaagtttcagactagctgttgatcagtatctgttcaccccaatgtcctgcaccaccttggtctgcgtatatacacagctgcatttttagcatcctgctgagttttttcaacctattgtccatcataatgagtcatcaaaaagctgtactctggaaaaaatagttaaatgggtagggggttacaaattgtaaaacactttttgcagtaaaatgacagttttattaaaatgtgtatctctaagtttatattcatgcaatgaagaattgactagtgtatgaatgcaagtagggttttgtttttgcctttttttcatgttcctcaaataactgaggacagttatctttcttgttcacagctttgtatctagtacctaatccagggtcagacacatagtagacactaaataaatatatatttgcctaatacttttataagcaggaaaaggtttttgtttttttttaaatgaagacaaatacgcctattttttaagaaagcaaaacacctcaggaagtgttgctactgaattattggtacagttaggaatttggaaggaaaagaatctgttcaccaaagtaaaagataaatgaattggagttatattttttatatttgttttatgtttaattagaaaattgggaagacaacagaattgagtcgctcaaacctttgtatggagtgagttttctgagtgaggaagcattacaaggaattactgaggaaaatgtgaacagatttgtaaacaccaaaagtgtaaaggacaagcaatatttaaggaggaaaatatttgcaagaaaataaggcaaaggcttagtgaaagctcagataatactaaaacctccccaaattacatcaacccattcataaaagtgaaggttttattattttctaaattagctagaaaaaatttttaatccctttttcttcttctgtgactcatccatttgtttctggcaagggtgtagagaaataattttcttatatttatagtcaggtaaagtgaataacccttttgggaagcagtttgggaagaacgtttatactgtttaaactaatttaacttctgagaatctgtcttaaacatacttttttaaatacagaaaaatttttatgcacaaagaccttttttacagcattatttcaaaataatcttttcaggctttagtatgttcttaaaaatgatatgatatatggcatctctgatactaagttacaagaaactcacacagtaaatttggtttggtatgttaaatttacctcatacttaaaaatcttctctaacaagagaggtattgttttagcattttgataaataactttttgtttttaagcccaggccattcagcccacctgtaacttccaacaccagcccacctcctgctgcaccattagcccgggcagaaagwtcttcttctatctcatcatctgcttcattgagtgctgccaatactccaacagtaggtaagtgattatcatcaattacatgtgaaatgtagtgtacaaagtatatgtatgstaaatatgtatntatttttaaatgggctaatgaagaatttaacattataaattttgtttttctggaaacacacctggaatttattaaactgtccatgctttgcttttctgtttcacagtctatgttatctggatagaagaattttaactgtggttagcaccgttaagaatgagttaaatttataaattgctgatcaatataaatagttgaaggcaaaacaaaatgcagttcttccttctgtgaactgatagttgcgtttctaagaaagtttatgttttaaaaacaatagtgttttgaaaatgattgaatgaaagaaaacaatttgtgcttgcagtgaattatatttttccacaagaatttcaagacttaaaaatagctcttagggaagtggtccccaacctttggcaccagggactggttttgtggaagacaatttttccatggactggggtcaagaggatggtttcaggatgattcaagtgcattacatttattgtgcactttatttctattattattacattgtaatatataatgaaataattatataactcaccatagtgtagaatcagtgtgagccctgagctttttgtcttgcaactagtcagtcccatctgggggtgatgggagacaatggcagatcatcaggcattagattctcataagagtgygcaacctagatccctcacatgcacagttcacaatagggttctcgctcctatgagagtctaatgccgctgctgatctgactggaggcagagctcaggctgtaatttgagtgatggggtggggggcggtttactttaaatacagatgacattcacattcacattctcctccttctgtgcagctgggtactagactgtggcctgggggttgaggatccatgaagcatagctatatgaacctaaacctcaccaaacaaattcagtattttactacatctagactttgctcaagagtttttttgtcatcatttctactcagttttttctacaaattcttactacctttttcacccattgttaggataataaagcacaaagccacttagacaaagcagctgtgttgcaggacatacaacttctcataaaaattataactgtacgtattgctgctggtttaagtagtgatgggtttattcttgataatgcaaatcactgattttcactaaccgagcactaattcagtagtngtcaaagtgtggtccttggacctgcagcatctgcataacctgggtacttcttagaaatgcagacttttaaaatcagaaaccctgggagtggaactagcagtcgtttaataggcattccaggtgattctgatgcatgctaagtttgataaccacagccctaattaagctgatttaattccagttgatttgtcaaggctcacataggagaaatgcaactagtgtgtggccattgtaaaaagacgataagtaatataggctagaatgaaatataaaatggcttgatttctaaatgtctaaacatgatgtcaccatcttattacctttgtgaacacagcatttttcccatcttttaattttatataaactgaatatgtctaataagtttgccctttggtttaatgaatacttcatttttattttttgtttgtgtggttttaattttttcccacagaatctatattttagtcctaaaaaacctaactgggacctactagaaagcaggcaggtggtctgggtaaccttattttcgctttaggttttttttttttttttccagttatctttagattattcaggaggttttgtgtttgtgatggaaactttaatttctattgaattggtacatattagtttatggtttgagacattgctggcaataggacaaccaaaagcaggtgacagtgataatacaggcaaggcaggttgtatgtgaattttatacaacaaagatttttaaaatctacctaaaaagttctctttctttgccatgatttttcaacgctgtgtggatttaagtttctgattctccttgtttcttgaaaatattttctttttctgcattattttatttaaatacaatagaagatgataatttgattgggacacacactgaaattgaaaagcactgtgagacgtcaccaggtattgtatcagaagcaaatgtatgtgttgactaatggtccttaagtgtatctaaaatatttcgttatccaacttttccttttccagaattgtatgatgtctcagaaatcaagaattatgctaagattaactatttcagttttgtgctaattccatcaaattgctgtacaggatccattatatcaaatccccaacttgctgaataggatccattatatcaaatccccaactataaaaacacgatatttttgcattttcttctctgctttcctcaactcagctttaagaaatgtcaataaatcttaattctaaagctatccaaatcaggtaagaagtcatccaaaaagaattaaaaggaatatgtcagttaaaaaaaaaacctctaatacctaaattagtagggcaaaggctgtcatatacgaaaaccatacagatgaagttagaagcatggagatgataggagatagtagggagtgggtgtctgtgttttatttctgagcggaaaggaattctacataaatatccattgattgttataagaaggtaccctatacctgttacrtacctcaagtttataagctctctacattttcaaaacaaaattatctaaatatgtaacaaaccaaaattagaaaccacaatctacccttattaagagaataaatttttatttctaagaaattatttatttggaataatacagtatagttttagactttttaaaagactatttaagtacatatttcctattcattttttgaagtatccatgtgcaatacgatcttgaaagaaaaacaaaaatagaaaatacgaaagggaatatgccaactgttaagtggsttttgagtttttcttcaactttccaatacttttctctgcttgccaatgtttcagtaatggcataatttacagggaagctaggcataataatttacagagtcgtgttatgtgcccagattagattgttgaaaagaatatttatgcaggtttcttttaatttttagtgtcaaagcagtagtagacattaatgttaccattgactttatataaatattcatttgtgtgagttactcaagagacattttttttttttaatgagacagggtctcactccattgtccagactgaaattcagggatatgatcatagctcactataagctcaaattcctgggttcaagcagtcctcccacctcagcctcccaaagtactggaattacaggcatgagccagtacacctggtcagggaatatattaatttcatatttaagagagtataattttaataaaatagtattacaataacaaatgttggtgaggatgtggagaaactggaaggcttgtgcactgttggtgagaatgtaaaatggtacagctgctgtggaaaacagtatgattgttcctcggaaaatgaaaaatggaatttacatatgatccagcaattttacttctgggtatatacccaaaagaattgaaagcaggacctcaaagagatagttgtttactcctgttcgtagcagcactattcacagcagccaaaaggtagaagcaagccatgtccattgttggatgaatggatgagcaaaatgtggtatatgcatacaatagaatattattcagccttaaaagggaaagaaattctaacatgctatgataacatggatgaaccttgaagacattgtgctaagttaaatactgtatgcttccacttatatgaggtacttaaagagtagtcaaactcatagagacagcaagtagaatggtggttgccaggggctggggaaactggtgggagttgttgtttcatgggtatagggtttccgttttataagacgaacagagttatggagatggatgatagtgattgttgcacagcgttatgaatataattcataccggtgaactgtatgcttaagaatgattaagatggtaaattttatgttaagtttattttactacagttacaaaattggagagaaaagattattacagcctttgtctttttcagaaaatatgttttcctgaatttctgatgaccctcttgtttagaacaatatattagggaaaaaagtggattgaactaagttagatttacagtgaagttttccagtgtacaaacatatatttttatatttataatcagtaaatgtatacttaatcagctttttttcacttgatattttcttgcatcccaaaactaatgacacttgatcaggccactagctttcacctaactgctctcacctgatccaaacttgattccctgccaacagtcatttttcccttcaatctaggatttactctgtgttcagagagatcttactacataaaagcctaataatgtttctctcaaacattatcagtggtttctagtgacaaaaggataaaattaaaggtctttcataccctaatctggatcatgagcacttttccagcctcatctttgtgtctttttgtcactccagcctctccctcacattttttgttttgcttctgctttgcaaaactagtacttgtgcttcaaaaaggcaccattttttttaaatgtccccctagcaaagtgcctggcacatggtggttaatacatagtagctgttgtgatttcatgaataactttttaactgtgaagaagcttctaaatacaaattccttcaaaatctagaataccaagctaacagagtatcttttttcactatttatagcatctcagatttagttgtgaggcagaaaaagccagtactgatttttatcagaattaatatttacggtatctcagaggtaattcattgtttcactacaggagtcgcatctgaaataaaaatgtctgatggctgttaatgttgtgtaacatataaggaaagcatatattcaaatttcagagataagtgttgacctagattatttatttttttcactaaggatgaataattataacaaactctcatatatttttataaaattgcattttatttattaaatgaaatgctcccactttggaaaatcagtagcagtagcagtaaggcacgcagtggtaagaagagtgcgtttgtgaagaaaaacaaaggcaatgcactattttgaggggatacttcacttaggttacatttaaaacaataaacagaaacctgaacacttgcataaatttgtttacattttaattttgctctgtagacactgatctttctctgatttgactctaaaaggtgtcttatctgagtgaactttggccagggttttttttttttaaataatgttattagtcaagtatttattagtcaaatattgaggcaaagtaatgtgggaatacaatacaagcatcagacaaagaggaggttaaagagaattataataataatgagtagtgtatgaaacattactacttggatagaaaaacttaaatacaaaaatcctaaattggccttaaataatgccctgaagtatatgattgatagaacctggaggaatttggtatttgaatgtttttgaagccaatatttttgaaattttagctgtttagtcaagggcttttttattctgacattccttaaccattctgtctttccatttaaaagaaatgtctgtgtgacatgtcttcctggtttttttttgtcctttgtattaatgctccagtttgttttatactatatttcttagcccccagatttatcatgggacatcactgaaaccagtggtagggtcgtttgtgacagcctaacaatgtgaatctaactatcttgatatttaatttatgtmtttctgaaggatttaacaagttaattgtgtatattctaggtgtgtcacggggtcccagccctgtcagccttggaaatcaggataccttacctgtggcagttgcccttacagaatctgttaatgcctactttaaaggagcagatcccaccaagttagtttttaaaatatatgcatgtatgtgtatgtatgtgtgttgggtggaggaggtggtggggcttggtggtaaattttaagaattacattttgattctgtgtagattacagttttctgttgtttatttacctgcttttttgctatctaaggtagtcatttgatgattgcattcaatgtacattcattcatcaaatacttgagcacctattatttctaagactctgttacatgtgcactgaggatactttagtaaacaaaagagttctctcctgagcttgcattatagtgagggaaaactaaatatcaaagaaacagctgtatgtattggatattgatacacgctatgaagaaaaataaaccagggttagaggctagagaataacattagatagagggctactattttagatagaatgatcagggtaaacttttttgaggttaatttaagcaggtagttgaaagacatggaggagcaagccatgcagatatctgaggaaagtattccaggaagagggaaccagtgagtgtaagataccaaggtaaaagcatatttggtatattcaagaaacagcaagcaaaaccatgtcactgagtaggagtaaacaggagagtacttgaagatgagtccggagaggtatgagaccaggttaggcattgtaggccatgataaagaatttggaatttattttgagtaacatggaaagccagtggaggctttgagcagaggaatgatgaaattacatgtgttttcagaggagcgctggttgctgtatggagaataaactgggggcagagggtgcggtgggcagtcagaattgatgcagagagaaagttagaaaattaattacagaagtccaggtgagagataatggtggcttgtataagggtattagcagagcaggtgatgagtagtaatgagattctgaatatattttgagaacagaattgtcaagatttgttggaggcaaaatgctaagtttgaagtttaagacatcttagtggaaatgttgaattgatacttggatacatgattctggagttcaaggggtaagtctaggctagagataaaatacttggtagtgtaattagtttgtagataatactcaaaattagtggccttaaggaatagatggaaaagagatctgaaaactaagtcttgattccctccagtgtttagaaaacaggaagatgagaatgatttaacaaaggaatttgagagagcaagcagcaagagaggtgaggagagaaccaatagacccgtgtctagaaactaagtgaataaatcatttcttgaaggcaggtgtgaacctgtatctgatgctgcttgacaggtcaagaaaaattgaccattgacaataattggtgacattcacaagaaggattttagtggcatagtggagatgaaagtatgctttgagagtgttcaggagccgaaggtgatgcagtctagacaactatatttggaaagaacaaatgcagttatttcaggatgttttggtctaagtgggagcagagaaatggaatggtagcaggagtgaggtggtggaatcaaaggagggttttatttattttcatttttgtgttttttaaaagatgatatatatttcagcatgtctgcctgctgatgggaaagatccattatttatggaaaaacaggacttgcagaaaaaagagggaacaatcacatgaatgaagtccttcagtatataagagcagatgagttccagtgcagaattgctgggattggcctgaggtgcagaaattgattatctgttgaaacagtatggactgcagaatatatggataaaaagttaggtagatttactagtgagagtatgaggaagttatttttttatttcctcagtgaaatgaagagcacagtcatcagctaagagttgggggaaggactattgcaggttagagataaaaggggaagctaggaaaagaccaaaagaagaataaatagacttgggaaatgtgataggattaccaaaggggtccagttgagagttttggctatgtagttatatgtttcaaaggaagaaagaatagagggttggaagaagcaatgaggagcaagggcctccttgctaccatcaccatcaccaggcccagtgctttttggggtttgggagggaaaaatagccacaactaggtatagcgttatgaggaaagcaatatccttccagggagggaatggttatcacaaaaaagtgaaggaatattatcagtgtgcttgcatttgtgtttagagtttaattccaggaaaagatgatgctagatgagtatactatttcatgtatataatttttaaaaattaaattgaaaaaataatctatagttatgataaasgatatagatatacacacatataggtgcgtgtgtgtgtgcgcacgtgcacgcgtgtgcctttttaaaccaaatactttaaatagagattagagcattttatttaaacacttttcaaaatccctgttttaggtgtattgtgaagatcactggtgatatgacaatgtcatttccaagtggaattattaaagtcttcaccagcaatccaactccagctgtgttgtgcttcagggtgaaaaatatcagcagactagagcagattcttccaaatgcacagcttgtgttcaggtttgtgtactttttgttttgaaggttgaaatttcgttttaagattttctttcctgctgtgcacagtggctcacgcctgtaatcccagcagtttgggaggctgaggcaggtggattgcttgagcccagttgttcaaaaccagcctgagcaatgtggcaaaaccccatctctaccaaaaaaacaaaaaacaaaaaacaagaacaaaaattagctgggcatgatggtgcgttcctgtagtcccagctactcaggaggctgaggtgggagaatcgcttgagcctaggaggcagaggttgcagtgagccaagatcgtgtcactgcactccagccttggtgacagagctagaccctgtctcaaaaaaaaatgttttcccccttcttctttgaaataataatattcaatttgaaaaccataccaaaattattcttactaaacacctttctgctgtctttttattttgttttcagtggtgctaatagttattttaagattcttttctctctctccatcttatctttcaagcaagcttctcctgtgttccattcttcatcccctgatctaattttccttcatcccacctcttggtttatttctactagtttttcctgtgtcaccaaattactacacagaggcaaaacataaagataagtcaataaaataacaaatatattttttatatatgtagtgatccatcacaatgtgattccaacacaaaagatttttggatgaacatgcaagctgttacagtctacctcaagaagctgtcagagcaaaatccagctgcttcttattataatgtagatgtattaaagtatcaggtgagtgtcacgacattgcaaaaattctaaattaaaatattaaaaaatggaatctagcatataaatgaataagtatgtcatagccaagtgagttttttcccagaaattcaaggatgttttgaaattagaaaatctgtttataagccagtggagattttgaccagtttggtaaaattcaccatttattcatgattaaaatactgagtaaatttaaatgcataaatttgtccttaagctgaaaagactagcagtatcagtcttaacaatgaaactcccaaagtaatcaattaaagttaggaatggcaaagatgcccattagtagatcctgttagtatataagagttttctggatgtgttagccagtacagtcaggtaagagaacaaaataagcattaataaatactgggaaagaggaatcaaaattattattgcttacaggtgatatattcctctcacgagaaccaattgaagaactatttgacataaggacatttaatataggtggtcagtttagtaattaataccaaaattaataactttcaaaaccaattacaaaaactagtggagaaaaatattcacaaagaacaattaggaagaaacacaacacaatctctagtgacttgaatatggaaagattcatgctgtagaagtttagctgtttctcagttaacttatacatctaatataatactgatcagaaacccagtagagttacgtctttgtgtttggaggcttgacaatcattttcacgtttctctagaagaataaagcttacaagaataagtcaagaattttttattttaaagagatggagtcccattctcttgctcagaatggagtagagtagcatgatcacatttcactgcagcctcaaactcctgggctcaagcagtcttccagccttagcctcccgagtgactgggactaaaggcacaaaccaccgctcctggcaagaaatgttttaaacagtaaagtggagtaatgttttagctttaatgggaaagcttagtatagacagtatttaaaatagtttggaactaacgcagcagtagatggccagatgaaggaatagattagagtatccagaaatagatctaagaataaatggaaaattgtttatacgacatagtagcatttcaaggcaatgtggacgtgatgaatttttcaaaaaatgatgttgaggatagcaagctagacacttgagaaaaaaattaaggtgaatccctgttagacttttagccaaagtaaaatccatgtgtatcaaaggtttaataataataataaaagataccataccataaaggtactaaaataaaggcatgggtgaagatacagttgacccttaaacaaaaaggatctataaactatgcaggtccacttatacgaggattctttttaaccaaacaccaattgaaaatgcaatgattgtggatgcaaaactcatgtataaacagagggccaactttttctatatgtgggtcccacagggccaactatgtttcttgagtatgcacagattagtatatacacaggggtcctggaacccaccctcccaagtatgctgaggaacaactgtatatgtatttctctgtgtgtgtatatatgtaatacatatttattacatattttaatcttgaagtacagaagacctaagtatgatatgaaacccagaagccatgtaagaagagaatgagatatttgataaataaatgtgtgtgtttataaaatattttgttaaacctttaaacacaatcagtatttaatctgtgggaaaagtatttacgacacataagatgaaccacagggcttaccccaaagagcccttgtaaatttgtaagcaacatgtgaataactcaatagacaaataacctatggaaagatgcttcatgtcagtagtaatgagagcagtcaatactaagataacaatgaggtgtcagttttagcccatcagatttacaaaaatgaaagttcgctttatccagtattaagaaggttatgatcacttgttaataggatgcaagtaaaacctcttagaaggcaattctgttagattgttgaaagatgtaacctttaattcaacaattccacttccagaaatcatcagaaatacacagttggatgaagataaggcataaaggatattcgctgtagcattgtttagaaagcacctaagtacatacacatcagcagaggaggaaattaattactatagccattaaaaagaatgacatggatctatgtttgcatatgcctgaagagtctggaaggatatatgccaggattccaagggataaatttcctactttatatttctctatttttttagtttttaatagggtaattttattaaaatggcttgtttctagaaaaatacttaaagaacaaaaaagtgctgccacttaaattgacttaaagtttcttacaggtgttcatttattcaacagatgtgtattattcagtgcatgtaattgctgggagtaggacagggagacagtaaagatcagtaatattctatgggctggactttgttgctctggtctataatcccagtactttgagaggctgaggcgagaagattgcttgagcccaggagttcaagaccagtctgggcaataaaaagaaaccccatctctacaaaaaatgtaaaattctctgggtgtgatggcacaagcctgtagtcctagctagtacagaggctgaggagggaggattgctcgagcccaggaggttgaggctgcagtgagccatgagcatgccactacactccagcctgggcaacagagtgagaccctgcctcaaaataataatcataatattctatgttagaaaatgagtggtatggaaaaaagaaaaagtatagactaaggtaaggaagattgaaaatacagttttcagtgtaaatttaaacagagcagtcagagtaggtctccttaaaaaggagccattggacaaggagcttaagaatttgaaggaattataacatttactgtgagtcatgtgattaaacatttgaagttggaagyattctaattccaacttgtggtactacgtggtgaccttttttctcgtgttctaaatctgaattcttataatgtatgaagaatctttgaattctgtgttgaatgttggaagattcgcaaactttacaygcataattaagaattccttcataaaatgctgatttctgggccctgtccctaagctgttgaatcagattttctgcagttggagctaagggaatgtgtgttataaacaagcaccacagcaattttgatgtaagtagtagtaggtccccacattgagaatgatccttactcctttgagataggtctgcttcactctgccaacagatagtcccctcattagatatttttgattttgtggacttacatgttcaagtgtccatgtcattaacatgacttcttaacttttcaggccaaaaacaattgtttgttcttttctctttaaaggtatcatcaaatggtattcagtccactcctctgaatcttgcaacatactggaaatgtagtgctagcaccacagatcttagagtggattataaatacaatccagaagctatggtggcacctagtgtgctttccaacatacaggtggtggtaccagtggatggaggagtaacgaacatgcagtcccttccccctgcaatatggtaaattaaacatacgtttctgaattcccactaaatttttgttgcaatccccaacttctagaacccargttctgtaagttttcttagaagtttgaaaaatttttgtgcctttttccatagaaaccacgctgtaaaagatgcagttcattttactagtcaaaccatagtaaccttaatcaaaaataaacaaaactagttttgctctmagtaccacccagacttcaatgattccatactaactttaccattaggcagagtgcttgacctctctaaacttcttttttttttttttttcatttaaaaaatacaaatattttatggattaaatatagcatctggcaagtctataggaacaggaacacctatctaattagtgtttaatagtattagttactgccatctcttagcaacttctcctgtcccctctgttagtattagtatagactctaaccgctctttatagttacttcatcatttaataacatgtgtcttccttgactaatgaaggtactgatccctatacacattccattttactttctctgaccaataggaatgagaagaattacataatttggtaaacttccattaattgaaaaagatacagcattatgtttatactatatcataaacacattttcaccagttaatactacttaaacttagcaatatatttgttgtagtgaaaatatttaaaatacacttatttattgaggtcccattcatgtatcaggtactatactagacacaaaacctgaagatatctgttcttattgcaggaatgcagaacaaatgaaagccttttggaaattgtctagtatttcagaaaaatcagaaaatggaggtaagtgtgtgtgtccttttttatttataaaatgatgtcactgaaaattgattttttttttttttttaaaacagagtctagctttgttgccaggctggagtgcagtaacacaatctcagctcactgcaacctccgcctgctgggttcaagcgattctcctgcctcagactcctgagtagctgggattacaggcacgtgccaccacacccaactaatttttgtttgtttgtttttttttttagtagaaacagggtttcactatgttacccaggatggtctcgatctcctgacctcgtgatctgcccacctcggcctcccaaagtgctgggattacaggcgtgagccactgcgcctggccatgggtgcaccgttcctggaagcactgcaataccttttttaagggaaagtttatgtaaagtttcctcctggaatttcatgccctcagttctagaaatgaccactaggtggaagttaatacctttagaatggaccagctgagattcagaacacatttgttcatctagattgagtatgtgttctctataagaaaaaatttattttgccataactttataaatattatgtaaatacttcttatatttacatgctaacattaagaaactatacctagtaaatttaaagaaatagaactctatgttccatgtaggtaacctgataactaattgaaactgatttaacacagtttagttcattctgttaacgggattctcctgacctcccagaaatcatgtagacgcttccaggctttaaaaagccccttgccgtcccggcacagtggctcacgcttgtaatcccagcactttggtaggccgaggtgggtggatcacttgaagtcaggagttcaagaccagcctggccaacatggtgaaaccccatctgttttaaaaatacaaaaattagctgggcgtcatggtgcacgcctgtaattccagctattcaggggacttaagcatgagaatcacttgaacccaaggaggcggaggttgcagtgagctgagatggtgcccctgctctccagcctgggtgacagagtgagactctgtctcaaaaaaaaaaaaaaaaaaaagcccccttgccttctgcagttctctaaaagaacctttttcctgtccatttccccctattaaagctaactatcagcagcattcaattttctgatgattattttaaggagaagcaagttatgcttctctcactaagtacatctgtttgtgttcataatgccaaggaaaaggctgtcctagctgatcacttctataactcaacttacaataaggatgtaattcttgggacagccaagtctttaacatagtcttattttctcttaatcaaaagagaattcttctgccttcttttgaatgcataattttagtctacaataacttttctgcttgtttttttagggtttggttttgttttgttttgttttgtttttttgagacagagccttgctctgttgcccactctggagtgcagcggcatgatcttggctcactgcaacctctgcctcccaggttcaagcaattctcctgcctcagcctcccgagtagctgggattacaggcrcctaccaccacatccagctaatttttgtatttttagtagagacagggtttcgccatgttggccaggctggtcttgaactcctgacctcagttgatctgccagcctcagcctcccaaagtgctgggattacaggcatgagccaccatgctcagcctagtctccaataactcctctatttgataggttttttggcttttcaaatgttgctgagctttttctttttgaatattttgagcataatataaaacatatcagtagcttttctcatagatatttctgtagaaaggaccgtaaatatgtctgtgttgtttattcatttacacctgccatgcagaataagacttttactggagagccatacattgggtgaaataaccaagcaaatcttcagtttcttttttgctgtttggtacttataggttgcccactttcagctggccaactgcattgactttaaccctagctattaatatatagctttttgtgagccaagctgaaattcctagtttaaattgaagtaaaccagcaatcctgtttgcattaagggcttataaccagtttagaaggacaaaaggatctttttccccaatataatgaaactatactattgtaaataattaacaagaaagaaatttgttctctcaaaaataagacacaggctgggtgcagtggctcatgcctgtaatcccagcactttgggaggccaaggcaggtagatcgtgaggtcaagagatcgagaccatcctggccaacatggtgaaaccctgtctctactaaaaatacaaaaattagctggatgtagtggcacgtgcctgtagtgtcagctactcgggaggctgaggcaggagaattgtttgaacacgggaggtggaggttgcagtgagccaacatcgcaccactgccctccagcctggcgcagagactccgtctcaaaaaataaaaaaatgagatacaaattttctaaccagattttaagtttccctctgctattcaggtatcaggtgtttctgtgaggaaatggaaaaatcttataaatgtggtttttgatgtggttagtcaagcctttgaaaagaatatccaaggccaggcatggtggctcattcctgcaatcccagcactttgggaggctgaggcaggtggatcacttgaggccaggagttggagaccagcctagacaatgtggcaaaaccctgcctctactaaaaatacaaaaattaaccaagtgtggtggcacgtgcctgtagtcccagttactcaggaggctgaggcacgagtctagcttgaacctgggaggcagaggtttcagtgagccaagattgcaccactgtattccagcttgggccttagagggagactctgtctcaaaaaataaataaataaataaataaataaataaataaataaataaataagaatgctgtaaaataggctgggcacggtggctcacacctgaaatcccagcactttgggaggctgaggcgggtggatcatgaggtcaggaattcaagaccagcctggccaatatggtgaaaccctgtctctactaaaaatacagaattagccaggcatggtggtgtgcgcctgtaatcccagatactcaggaggctgaggcaggagaatcgcttgaacccaggaggcggaggttgcagtgagccaagatcgtgccactgcactccagcctaggcaacagagtgagagactctgtctcaaaaaaaaaaaacacaaaaaattctgtaaaatagaaatctgttttctgttgctgactgtgtactcagaagagggacaggaaatatttctaaggtgattgtcaaggttgttgctcttggtctatggtagaacttttgcacaaccaaattggttatcaagaattgtaaaagtttgagggcctggatagtaattaagaataaggcagcagttcatctccactactgatctatgcctccaggcataataatacaagttggatcaatgttgtgacatcctattctccatttctctgtgtagtgttaagcttctgtgcaggggatcacaggatcttactgctagtacctagcatttctgtccatttgctctatccagaaacctgggaaccctcctagactcctcctttctcatttcttgattccaactcctaaatatctttcaaataactttcttaatatctttcctttttattagccctagttcagatccccctttcctatcatctagagtcctaaactgttttgacttgcagttggtctcccaaccttgcatcttgtgcttctcttcccttttgagacactaatctgaaatgttcttgtcttccttatctttggtgacttcccatggttacatcatgaatttcttaccatggcctggcccatgctaccactctagtctcatctgccactcccctctacctgtatcctgttctcctgctaatctgatatagatgctatttcgttaaatgcatcatgctctgtctctgtatctttggtaacttctgcctaaaatacacaccatcatccccaccaccatttataattttcagctgagataggtgcttttgtgcctgtagctcctcagagctcctttacagcatttataatattcattataattattggtttactgttcctgccattccattagactgaagtatactgaataaatggtgatgatactagaaacaaaacacctcagaaatacctacttggcattatgttagaccagtaaaactttaaaaagaaaagtgaatagaaaatagcaatgttatacaactcttcccaaccgtagttacctttccatctttacttcttctactactcagtagtcatttcttttttaactttatgccacctatatccctcctagggtttttctctgggctgtcctcagttacttccttcttctcttttgactcgcctcaacatgcatatagcataggagtccagtagttaacatctctgaagattagtattgagtcaaagaaaagcatgggttatttacttaatgaaaattgatattcactaaaaaatatgagatttggaaacaggataatagtttgtttactgtgcacatctaatgaatgtagcacaggactgatgtagtttagcttacttgctcatttgattctattttgtttgaaatgtattttaccctgtgtaagtgctttattcttttctttgtaggttctgggtccctccgagcaaaatttgatctttcagaaggacctagtaaacccacgacacttgcagtacaattcctcagcgagggaagtaccctttcaggagtagatttcgaacttgtgggcactggctataggctttccttaataaagaagcggtttgctactggtaagttaggagatttcaaactttttaatgtacatgggaaacatttgtattctaacagttattaaaaaactgtcaagcaatttataatctaaagacatggaaattttttctttaacccttggtacaaggtgccaggtagagacacacctgggagagagttcttacggtcagtatagctgaacacctgttatctgattctaatgtactgtaaatagcagatgggaactagagttttgtattggtaaccacagtggaaaatgtccttagagtgcatttgaaattgtaattgcaaaggtctgcttggcgtttttcaggacgatacctggcggattgttgatggacctgggaaagtgatgtggcttcagggattacaaacctgccattctgcattatctgttctttccaaacactattttaacttgtatgatgtctttcaaacttagacatatttgagagctgactacaaacattaaatcgcacttttaaagtgagtcattgaaataaatagtactgaaatgattctctatgttgtaaatgatcaactacaatattcaggaagcacatttattcagattctcagtaaaaatgaagtttttgtaggattaatttttaaattatttccagtgtctatgttgaaaaaaagggttatagtgtaatatcaggcctaaagtttcagaagagyaagcacaaagtaatttagctttccatacatttttagagtcagagataactttgaaatttcataagtttgatattcagtggatacaaatagaacatgaattctaagttttgggtaatgttaactcagaacacttaatcaaattgagctatgtgccataaggtaatcagaccagagtccaagttgtatgcaaaaaatctataatttgattctcataaacatattaataaagtataagtgatgttttatatgatttttaaaaaaaattctcaagtgcaatgtgttttaaaataagcttgcaaatgacagcagagacatttacttctgcagttagttaactttataggagttgtgatttttttgatgaattaatgctgtagatttaatttatttttatatggaattgcataatgtgtgccttttaaaacaataacaaaaaccagagatgtgcctatacaatttgtgttcattaatgtgcctcactttttttctcagtctgaatcttctgttcagaatcttacagtgatcaagcatttttataagatatttgcaatttttgtaaatatttttggcctgcaactgggaaggggattcagagtcataaagcctaacttaagaatcctggctcacttctttggtgatacactgtagccactagaaagagaaataaacccaatggcatgtgtttacaggaagaaagattaccttcagatacttgacattaacctcatcaaaagtgtgtgaattttaaaacaaattctaaaaaaactatagtgctaaattggtaactggtattttractctcaatttagcattttccttgatactttatcattgaaaatttatgcatttatttactgattgtgttgtgaacatgagttttatggtattttgtgagggatgcattttttaaaagattaattttggaaacagaaggagaagcactgccatttgtttttatttcaacaattggaaaaattaccaatttgtacattttaattattcaatttctactttgtaaaaatagggaaattatttgaagtgatatatttggttaaacatttctaaaaataaactaccaatactaaatagtaagaaacctaactttagtagcaaatcttgattaattgaagaaataaaatatttcggataaggtttcataatttacaaatgggaatttcatttataataataaatatgagtgtcctttatttgcctagtagaagtgataaattgtgttatatatgataatttatataaaaccactaattgttccgttaagcttcacagaaaataaaacctctattactagacatttatgtaacatcttgctgtactaaatacagcagaaaatctactctttagcaatatataacacagtatatgcttttttatatattcaatgttagcccaagtctgaatttacatttgactaaagcagcacataagataatttgctaaaatgctaatctttactaaatagtgagctaaattagaatttctaactcttatattgtgctcttttaaatgccaattacagtcccttactggaattctaactgtaatttgctttgcaatcaaactgcttttagggcagccaatattttattattggaattcagacactgttcttaccgtgtttgtttttaatcaaatattacctaaaaatgtacaaattagtgaaatggttaaacttctgcactttcttagttaccacagtcttcataccaagtattgggtacaggttacaattttgaagccatatgagtttatattgattttttttttccatttaaaaatccactaatggtgtaaaagagaccagtagattttcaatgggaaatgtacctagcaagctggttcttgcttatatatagtgataaactttgtagctgcctctttaaccaagaatttgtaaacacaactctaataaatgtgagttttaaaggattgttatttactactttggattgtaattagaacaatgcacatctgtcttccaagattttgtaaatatttttgatttttttcattaaatgtaaattttacataaaagttgtgctcttaataaacatgtaatatataatttatcaattggtttatgtgtctttgtacttgatagtaatagctatatcataatgttaggacaaggcaagctggccaagtaattggtttttaactttgtactactgtttgaacaggcgtacagatcgaactgttatttattggttatatagaaagcttcatttggagtatatcccaaagtgtcaaaattgtttaacaagggattatttttaatatattttaagatatatttaaattgatgttaaatttttgcagactttcttcctaaccagttgctcaggaacacagtctcagacagttcaaaaatcataatgttccaaagaattagttaagacaatcaagcctcccaaaatggtaaatttaggaaggagcaaaagaaggaaattagaaaagaaagaatttatcctaactattgaaaattttgggctgggtgcagtggcgcattactgtaatcccagcactttggaaggtcgaggtgggcagaccacatgaggtcaggagttcgagatcagcctggccaacatggtgaaaccccaactctaccaaaaaatataaaaattagctgggcatggtgacgtatgcctgtagtcccagctactcgggatgctgaggtaggagaagtgcttgaacacgggaggtggaggttgccgtgagccaagattgtgccagagcactccagcctgggtgaccaagtgagaccctgtctgaaaaaaagaaaaaatgttgccaatctgtgttaaaaaaggaacagcttaatttatctaggtaggccagggcagaggaacctgtggaaagatctgatagcactcaccattcataccatatgcccatcgttttcttcctttttcctcttcatcccattcccacctctgttagactaaatgatgctagctgctgcaatagctaagcacaatacttactacattgctcttatcacagtcataagtaggtttgaggaggagttctgctccatatagtaattcaggggcccaggctcttcccattctgtgattctgcttaaaatcttcatttggccggcagatgaagaaaaagcaaagattagatgggagtttttatgggccaggcccagaagaattggcatcatcacttctgaccatattccatgagccaggatttgatcttgtggctccaaccaactgcaaaaaaagatgggaaatgtagtttggttatgtgcccaggaagaaaacggggttttgataaacacagagtaaacctctgccatgtaccccacccctgctccattttgttattttctttgttcctttttcctaatgtgcatttaatggtttcagtggctctcagtattaaaggttttttccatgatttcttactgtatgtagctattttatccatatttttaaatatatataattatttccatacgcctcctaatgatcgtttctgaatgaacatttgtgataactcagaaaccactgcttatctttttagcatgagtgttttatctgtcagtaatgtttttagcctcaagtaacagaaacagaactaagaatggtttaaaccagcagtaccaacctttttggcaccagggaccagttttgtggaagacaatttttccatggatgaagcggtgtggggagatagtttcaggatgaaactgttccactcagatcatcagtcattagttagattctcataaggagcgtacaacttagatccctcacatgcgcaattcaccataggacttccgttcctgtgagaatctaatgctgccgccgatctgacaggaggcagagctcaggcagtaatgcttgctcacctgctgctcacctcctgctgtgcaacgtggttcctaacaggccacagatcactaccagtctgtggtctggggttggggtcccctggtttaaacatttttttcatatcacagctcaagttacctcttgttggcattggtcagaacaagtcattcgccctttctttacggttggagtatggcagccatagctccagactgtatgtgtttacatccacagctaggagggacagttccagtatgtctgtcttttttttgtacgaagagtaaaagtttttccagaagctcccagctcgtatctgtttacgttctgttggcctgaattatgtaagacaggcagagaaaacaagtagccttcataatgaaggtgggtaaaggagaagggcctaggaatggctggaagtaagctggccagcaatcagacacagaatttctgctggtacaggcatgtttccatatagcatattgccaagcaagtctgcacctatcccaatcaactttttaacccattttttaaatagtgtgaactcagcaatgagcaggatgaacttaattaagtattcaactttttaggaacagtaaactggtataatctttctgacgatttgaatccaaaggctttaaaatttttttttaatctatgtatcatgtaaactagtcattcacttgggaatttgtcctaagaaaataatgagacataagcaaaattatgtatgcaaagatgtttattgcaacattgtttatagtatgcaaaattgagagggttggctgagttgataactcccatatagtgatacactatgcggcttttaaaaataattgtgaagatccacagtcactgatattgagatattaccacaatattattaaatggtaaaaggtaatatgccatttttgtttttaaaagtgcatacatcaggccagacgcagtggctcacgcctgtaatcccagcactttgggaggccgaggcgggcaggtcatttgaggtcacaagttcaagaccagcctggccaacatggtgaaaccccatctctaccaaaaatacaaaaattagccaggcatggtggcgcatgcctataatcccagttacttgggaggctgaggtgaggcaggagaatcacttgaacccacgagatggaggctgcagtgagccgagatcgcaccactgcattccagcctgggtgacagagtgaggaaaaaaaaaaaaaaaagcatacatctagagcaaaactttttgcaaaagcattcaccaagccgttataatctataggtggtgggatttttatttttaacaatatgttaggtgttatctaaatttttttataattagtacatattacatctacaattataaactaactatgttttggaaaatagttgcatagagtgcaagttgaactttctgttgatgcacaaagatctcttcacataaggatcttcctattttgattattgccttgccttacgtggtcctaccaatatagccaggttttttgtttgttttgttttgttttgtttgttaacgtatgaagtagattgctgatctaatttttattctttttggtctcaaagccaaatgtcatattttgttttccctaagtggatacaggatcagtttgttttttttttctgggaatatattttgcccaaattactctcttaagaaaagtgtcggccgggtgcggtagctcacgcctgtaattctagcactctgggaagctgaggtgggcggattgccggagctcaggagttcaaaaccagcctcgccaacatggagaaaccctttctctactaaaaatacaaaaaactag

SEQ ID NO: 10593 - DNA, 13769 bp, Homo sapiens
gcacacagttattaatgtgtttattcttgcttttttttttttctgagagagtcttgctctgtcgcccaggctggagtgcagtgcatgatctcggctcactgcaacctttgcctcctgtgttcaagcgattctcctgcctcagcctcctgagtagctggggttacaggcgcacaccaccacacctggctaatttttgtatttttagtaaagacagggtttcaccatgttggctaggctggtcttgaactcctgacctcaagtgatccacccgtcttggcctcccaaagcgctcagattacaggcgtgagctactgtgcccagccagttattgatgtttattaactaatgcaagacaggggataccaaaccgtaacaggaatgtgtgatttgttcctatgccaccagtctggaactctctgtacttatcctcaaggagagtgagatatgtggttggtacttgggggacagagtaaagaattgatacaatccctgtcccttatagggagctcccagcatccttgaggagcaaagacaagcataaaagaaatcattgggaagtgatataaatgaccaagcttcatgatgaccagaagttgaaagtagggattaggttgggagaagtgcattcaggtcccgctggagctcttcttgcactgtgtgaccctcagtttatcctatccctattttatagctgtggaactttggggaggagggggaaccttttgccttcaggaccactgaataccaggaccaatattgctttcttttctccttccttctaggatgtcaaaagtaccctggaaaagtaagtgattgttgtatctctctgagtgagttaggtcttggcttagagaggaggggtacagtcaggagtttgggttgggggtgaggttgggaaagtcatgtagtgtgtctgggcagggtatgggagaatgttcattgtgcccatgaagccagttagagaacaaattattgggaataataatcccttttcccctttgaacatcaggacttcttgagaaggagaatgataaggtagaatcagattctacttgtgccagtgggtggaattgtgtccaaacaagatggcaggaggaaggggttgggagagcagggagggcaatcatccatttgcatgaaatacaggaatattcctagaaagttcggaggctcactctcaacgatctgtccacgggatcataaggctctccttggattagtaaaagaaatcaacaggtgagcttttcagggaggaggaagaaagtgggaagatggagaattttaatttctccctaaaaatgttaacatctgaatagtcacttggctggagcttctccctaaccctgccctttcttcccctatctccctatccctcctagatgtgaaaaggtgaagaccatggaggtgacttcagtatccatagagctggaaaagaacttcagcaattttccccgacagtactttgccctaaggaaaatccttaaacagctaattggtgagttgttcccaaaaggaaactagaagaaaccactagagagaagaaagtttttaggtcctaccttatatgggtttcagttatcctatgtctcacttttcttactcccacacacacctacccctttatctggcttttagtctcaccctgagtcacagaacttggagtgagaggaagccttaagcgttatctactcttaggtccattcttttctaaatagagacccagaaaggttaaataatttgccaaagtcatcgggtagagtggttatataatttaccatgtaaacttgcataaccttcaaaggccgggtgcggtggctcacatctgtaatcctagcactttgggaggccaaggctggtggatcacttgaggtcaggagttcgacatcagcctggccaacacggtgaaaccccatctctactaaaaatataaaaattagccagatgtggtgttgggcgcctgtaatcccagctcctctggaggctgaggcaggagaactgcttgaacctgggaagcggaggttgcagtgagctgagatcacaccactgcactccagcctgagggacagagtgagattccatctcaaaaaaaaaaaaaaagaaagaaactgaaagggagtgtcattatattaatgtgaatatgcagggaaaatagtcataaaccaggccagttcctggaaaacacacatggtcaccctatccctagaccatatgctgtcttgctcggcatccttcttaacactttccgtttttttctgcccctcagactacaccttgtacttctctacatagtgagataaatgataatgtcagagggagatgaagagaggaccaggcgggaacctagattaccagccactgcagactcaagagattattatctgtttactttagggtcagggtgagaagtgagccattgctttctccccttccttaggtgacaccatggattgagaaagttaaccaaaccaggttgttctggggacctttaagggaccaggctctgtaaaggcaggctggaagagtgaggcaggggcatttagctattcccatcctcatctagctccccactctggcttctcccgccagcggatgtgaccctggacccygagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaaygacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtraaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtgatctctgtgttgtgtggtaatttggtgacagccttgtactgatgtgtaagaatcactgggtgttagacatgcatgttcctgggtctcacccttagtggttagtcaaggtctggggtgggccggacatctacattttatttatgagacagagtctcgttctgtcgcccaggctggagtacagtggtgatctcagctcactgcaacctccgcctcccaggttcaagcaattctcctgcctcagcctccagagtagctgggattactatggactatagccatgcaccaccacacccggctaattttagtggagacagggttttgccatgttggacaggctggtctcgaactcctgaactcaagtaatctacctgcctcagccactcaaagtgctaggattacaggtgtgagccaccgtgcccagcctacatctacattttaaacacaccactctcatttgagtccgaaaacccttgtgaaactagttccagaggaggtttcagccatgtccttcctcccagctggagccctgcttgtctgtccccgcctggcactgggtctgaaattggagagaagtcatcctctcctgacttatgctgccctccccatctcagggttcattgatcttctacccctccaattcatgtccctctgcttctgacttcagtaactgatagtcactatgagtcacaggacaccagacagaagaactggaagatagaagaggtcagagggaggggtgtgaggtgaatgtcagtgtggggagtggggtgaagtttcaggggcaggggatgctgttgacagatttctgtgctgtacctaagcctaggagttagaaaccattcactcagaaagtgaggatcacctactgtgtgtccagcactgcataacaggaagtgtgtttctttggtaggtggaatagtaggagtaaactgtgctttctgaggaccgggagtccttttccctccctccagcaccctcatgatccttcccactttcacccccactggcaccagtgcttttttttaatgtattacctctgtgccttccgtctgtagatcttacaggcatctgcctcggacctcaggagagtagggcagaagctctagctgggtataaattgcacataaccatctccccaacgtagctacataaagagaccagccttctgtcctgaaaatggccgatttaagatcctcacctgctccactaggtctctaggtgatataattggtcatgagcttgaggaagacaaaagcactgaaaattcataaagggaccctgggcatggattgctggggttgtgtttagaaaccgatgagtttgtgaggcctccgggaggctcccgagggcgcggggactacgtttcccaggaggcytcgcgcggacgcccgggcggggctgtgcgaggggtggggctgcgggaggccctggagcgcggcggtgatggcggggccggtgaaggaccgcgaggccttccagaggctcaacttcctgtaccaggtgagtctgcgacaagggccccayggggacggtgctcggcgtcccagagtgactgctcccctcccgcaggccgcccattgtgtccttgcccaggaccccgagaaccaggcgctggcgaggttttactgctacactgagaggaccattgcgaagcggctcgtcttgcggcggtgagacagccacggggcgggcggcgggcgggacgcgggaggaacgcgagarggagcgcgggcgccagaccactatcctcctccgcccccagrgatccctcggtgaagaggactctctgtcgaggctgctcttccctcctcgtcccgggcctcacctgcacccascgccagagacgtgagtgctccaacggaggtggaagactgcggagcattgggggcgcggaggggggcggggtggggggcgggcactggaggccaacagcgcctttctcactgtagatggatgttgggtgtgggattcgcaggagtcttccttcttcgggtttggattaagttcctaacgccacttgcacaaactagggtttgggctcggctgttttttttttttttcttccagtgtgggcaataaataataacttttaagaggcaaccccacccatgcacaataatagatgttgttcggctttgtggaggacgattcccatcaccattcatttattaagcaaatacttattttctaaaatgtgtcaggtactgtgctagattcattattctcattgaaattacggtctgatgggacagactaagaaacaaaatggtgtagaaaaagattaactgggggagtagaatgctcacttactcatgccagtggtggcgaagtttatgataagcaaagggagtgagagatggaaattctaggcatgtgtgcagactctgagacaagagagcttgtggtgctgtcaaagaaatgagagttcaggaggctggagtttgaggtaggagggcaaaacatgagactggagggggaaacaggccagttcttgaagtcttgttagggagtttgaactttatcttaaagagttccaggaaatcratggagcttatgccgaggcctgacaccatcaaatgtgcattcaaattgggggtgtggtgggggagcrgggatacctactgaaaaacactggaggcaaaactggcagcaagagaccgttacttctaaacgtggacagtytttttcccatgttcaccctaggctgcaggggacagcgctggaccgtacagacctgcctaacatgccagcgcagccaacgcttcctcaatgatcccgggcatttactctggggagacaggcctgaggcccagctygggagccmagcaggtgagaggtgagggagaaaatggaggacaccccagaggatagggrcaatggagaacgtagagtgaagaggacacatggacaggttctgggttggtgtgagaagtaccacagtcagaaaactaattctgtttctctgattctgctcatttactcagattccaaaccactacaacccttgccaaacacagcccactccatttcagaccgccttcctgaggagaaaatgcagackmagggttccagtaaccagtgatggattcaccycatctcccraataaagtttacttgttttacattccatgattctgttctgtgggtatttcaactcttaattccattttcttctgtttctgtctgtgtttcttggtcacctttgtaatcccaccatgcagggagatcgtgatttccatagaccacttggcctcactcagcagcttgcatttccaaggccatggccccagttccctatcaatgtcctgagccaccttagggcattccatgtttgggcagccataattgctgactgaagagctggagagaatgatgccactgctgctgtttttaaacaaggggagaaatatggggcagcggagagtgtttgtatcctctaggcccactcatagtcagaaaagactcaggtcttttcccagtctcaaagttgtctttaataaaattctgataaaggaaatggcgcaaacctgaactaacaaagtcaaagatgctaacaaaggacaccgacagacattttgcaattatgtcccataggtaaactctcagagttttcttaagaataaacaactaaaatgttttcttcgatatccctagaaagcctactgaagtacagaattcttagactgacctttttgctaaatgccagctaataaggttataccaaaagcatacaaacaaaatttactacttccagaatgcagttttcttttatttctcttataaaccctgtgtttgcttatcgatagctgtataaaaaaatcacttcatcatgttggagcttaaaacataatgatttattatttcctctggttctgtgaactaggaattctgaaagactttggctgggtggttctcctgttacatatgaaatcagcttaaatagctgcatttagctgctatctcgtaggtggtctggaagacccaagaaatttcactcacgtgtttagcacctcattgcttctccaagtagccttgctccctcgctagctttgatgttcccacagcatggctgactcagggtagttgtatttcttacatcccctctggcttctacaaaagcatcccaatatgtaagtgtttggctggatgctgtggctcacacctgtgatcccagcactttgtgaggccgaggcaggtggatcacttgagttcaggagtttgagaccagcccggacaacatggtggaaccctgtctgtacttaaaatacaaaaaaattagcagggcgtggtagcaggcacctgtaattccagctactcgggaggctgaggcaggagaatcacctgaacccaggaggcagagttgcagtgggccaagatcgcgccactgcattccagcctgtgtgacagagtgagactgtctcaaaaaaaaaaagtgtttatcgagcctctgttggggtcacacttgctaatgttcccttggccaaagcaaggcacagtgccaatgccagattcaatgtggaaggggctacactggagtttgaacgctgggaggttcattagttccctggggatcaccagtgtaacaatctaccacaggggtccccaacccccaggccctgtggactggtactgggctgtgtcctgttaggaaccaggctgcctagtaggaggtgagcagtggtggaagggagggatgggccagcattactgcctgagtaatcagtggcagcattagattcacataggagcatgaaccctactgtgaactgcgcatgcaagggatctgggttgcatgctccttatcataatctaattgctgatgatctggggtgaaatagtttcatcccagaaccatacccttcctgctccatggaaaaattgcctttcacaaaaccagtccctggttaacctgtccctagtgccaaaaaggttggggatcactcatctaccacattcttgttttgcctttgtccctgacttggtctctccactgcctccttcacatgtcagtaaattatttgcgtagaaaatactaaacagtgtacatgtaagtaaatgtttctgagtcatcctttgacattttatttctggaaatagtgcctacctgggtcaactttcagtccaacaaaaatgtgtagcctgaaagtaacacctcgtgcatacctgggtcctttgcatcctcagctcaccttccatggctcctccagtaagtttaatttgggatgactgagctcgactcttgcacacttaatctgatctttggctaagtttgtcttgagtgtgttatgattgcatgtgactgaacatgtctacagtgggatagcagtggggaaactgagtttcgatttcatggctcagtcactaagtgattcctctcatgtgggagatcatgggaatcaggtcccagtcaggatgagcggcagacaaaacagtatctggaatctggttcacttgtgagtctttgtggtttctttmtttgttgtgggtttctatcaatatataactctaaagatcacagccctcttcctctttccacagccctcttcctctttcctttttcatgtttaattataaatatatgattacatatataacatttatattctatacattgatacatgattctatgtattaatacagatacatcataaagatatataatgtgatagtggcatattatatgcaaaaatggatttcctagatgaaagatgaaaataaactgaatccctggaatgcagtagctttctcaagtgtttctagaagttcaataactcaaaatttatgcccttttaggactctaaataaaattaaaggagagagaagaaacttaggttattcaaatcgaatcaagaaatgaggtcttccagtaaccatagaaactatgccttagtcactccctgaacattaagttcatttagcactttcaaaactagtgaaaaccagtatcgttattgtcaggaggcaaaagagagaaggattgagagactgttattttgaattcaagtagcaaaaacgttagaaaagacaggtcttgaacattgaggaatctgagttattgtcaccataataaatcagtgtgtatctctaatttaaaacaattatatcactatgaagatagtgcctatgcttagtaactgcttaataaattttcaaaactattttgaaatatagattcactggaagctgcaaagagcatactgaaatgtcccctacatcctcacccagtgccccccagtggttcctctttttattgtggtaaaatatacttaacttaaaatgtatcattttagccattttaaagtgtacaattcagtggcattaagtacatttgcaatattatacaatcaccaccactatttagttccagatctttttcatcatcccaaacagaaacctgtttccattaaacagtcacttccaatttttccctattccagcccttagcaaccactaatctgtttctgcctttacggatttgtctattctgtatatttcatataaatggaatcatacaatttgtagcttattgtgtctgatttctttcacttagcataatgttttcagggttcatccgtgctgtagcaaatgtcagtatttcattcctttctatggctgaatagtagccgattatatggatataccacattttgtttatccattcagccatcaatggacacttccgttatttctgctttttggctattgtgaacagtgctgctatgaacatttgtgtacaaggttctgtttcagtatctgtttttagtttttttgttggaggatataggtgcggttcgtttgatagttttatattttaactttttgaggaactaccaaactgctcttcatggctgctgcaccattttgcactcccaccagcaatgcacatggttctaatttctctccatcctaatctacacttactttcagtttgttttgttgtttattatagccatcctataataacattctagtgggtataaaaccgctagaagtcaatccaaaacactagacaaaaaccacaaaacctctttgtggttttgatatacagttctctaatgagtaatgatgttgagcatcttatgtgtttgttggctatttgtatattttctttggaaaaaggtcctttcaagacctttgcccatttaaaaaaaataggttgcctttatgttttgagttttaggaattctttatatattctgaatactagacccttatcagatatatgatttgcaaacattttctttcattccgtggattgtcttttcactctcttgatagtatattttgatgtataaaagcttttaattttcatgatcttgcagctacttcctcaagaaccaaactgtctctctcagaccttatcttctgcctccatcctgattctttttggagcttgttctaaccctggccctgcccactgtgaccttgacactacttaattaggaccccctcacctcctttcagacctggtgcctccaactatatcctgcctcactctgctttgaaacaggaaagtgttccccctggactcttagagtagatgtgggtatctgagtttctcttcctaaaatcctttccttcttagagcgatcaatgagccctgttgaatggcctatggaagggaaatgaatgttctaaatttcctctgacccttttcttcggacccccaaaggcattccccaccagcacccactatgaccccatctctgactgtaataccaccctgaggtgctgggccctgggcttccaccctgaagagatcacattgatctggcagcaggatggggaggactatacctaggacatggagcttgcagagaccattttatctttttgacaacttttttttttttttttttttttgagacagagtctcactcttgcccaagctggagtgcagtggcgcgatcttggctcactgcaagctccgcctcccaggttgatgccattctcctgcctcagcctcctgaatagctgggactacaggcacccgccaccatgcccggctaattttttgtatttttagtagagacggggtttcaccgtgttaaccaggatgggctcgatctcctgacctcgtgatccacccgcctcggcctcccaaagtgctgggattacaggcgtgagccaccgcacccggctgacaacgttttttaagctctctgtactgtatatacatctaattcagtgttttggactgccatagattatgcttttaaaacattttgtttatcccttttcttatggatagtcaactagtttgcttccaactatatgttaccatatatatctctgtagtagaattctagaccatggacctatgagagtgggcctctggagtacttagccacaattacaaattggattctaggtttgtgtgtatggaaattacctgaggaaagtcaaattttccttcagcttccacagtctatactccctagcaatataccaagttcatctttctttacatgctcagttgattttaactgacttcttaatctttgtcacaatctaatcagtatcaactctttccctttcttgttgtaacttgagtttctcttattgccagtgatactgtgtagcttcaaataagtcatcatcattcatttttctctttctttgaactgcctattcaaatgtttccccctatttttccactagatttcatggtgttcttttctttttgctttgaagggtgttatgggctaaatgtttgtgttcccccaaaattcatatgttgaagccctaacccccagtgtggtggtatctggaggtgggaccctggggaggtaattaagtttagatgaggtcaggaggggggggcctccgtgatgggattagtgctcttttaagaagagggagattggagctctctttccctaccttgtgaggacaccgaaagaaggcagtcatctgtatgccaggaagaggatcctcactggaactgaatctgctgtcacctccaaaactgtgagagataaatgtctgttgtataagccacccagtctgtggtatttgttatagcagccatggctgactaagacctaaggttttggttgttttgtttgtttgtttgtttgttttcttgtaatggaaaagaattcttttagagttttacctggtacatttgtgcctttaatacattttgagttgatttctacagatt

SEQ ID NO: 10594 - DNA, 37255 bp, Homo sapiens
  misc_feature (1)...(37255): n = A,T,C or G, or insertion/deletion polymorphism (see Tables 1-2)
accctccactgttaaagtccatcttccctgagccatcagcaccaagcatcagatgaacttcactgccctggctcagtgttgcctgtgtgtgagcctcagctccccatcctctctgggcctcagtgtcttccctgtgcagtatgccccgcagtgcccacccaatggggttgttgtgaggatttgctggaagggtgtgtgtgcaagccccttgtccaggacctggcctatatgtaaatataataaaagttcgttgttatttctgttaattgcatattgtacttgaatactccctggacagataatgagaaaaatgaggtttgagtcaccacccctgtcacttgtaaccctgtgtgacttgcttaatccctctaaatctcagttcctccatctgtaaaaatctttttttttttttgagacggagtctcgctctgtcacccaggctggagtgcagtggcgcgatctcggctcactacaacctccaactcccgggttcaagcgattctccagcctcagcctcctaagtagctggcattacaggcaccatgcctggctaatttttgtgtttttagtagagatgaggtttcaccatgttccccatgttggactaggctgtctcgaactcctcaggtgatccgcctgcctcgttctcccaaagtgctgggattacaggtgtgagccaccgtgcctggccgcaaaaatcttataatgccttcctcacagagaataatgaaggttaaatgatgaaacgcacagagcattttaatgctgagaagggcttcatgaggttgttgaaaaatgtcagtgaggctctgggagggctacagccggagtgtagattagactctgggtgtagccgcatggctcaggaattgagtggaagaagagagatgatgagagagggggagggacagagagagaggatcagccattccttcgtgcctgctgagtgcctgccctggtccagaccctgttctttgtgctgggggtgcagcagtgaactaaagagacaaagcccctgtcctcgtggtgcttatgctctagtgagtctgtggaacagagcaggggactgttgacaccaaatttaaatgtgcgaataggaatgactatgcagaagaggccaccaggaagagggacagagagaaatgagactccaggcttgatagaatgaccttgggctggtggaagaggcaggtgctgaaaacaggcatggaaccccttgccctagggcagggagaaaccaagagagtccaagctgggaaaagaatcaggtgaggaggttgaggtgttgacgaagggagtgtgcttggtgatgggaaaggtgggctctgaggaaggtgttccaggaaggacttctcagtgtaggatggagccttatggcagacgctgggaccgggcatcttctccagaaatgcccatctgccactcaggcaggcaggcaggcagctccctaccccttgagttctggtgtttttcctactcctttctcccctcccacaagctgcccaactcccagggacctgactggatggagagtacatacacctggaccactgcaggcatggcacagggaagagagaatccagacccaaatcacctccaacccacacctgctgattcttccgtgcttttgtagcctgacccttcgctgccgtcactccaactcctgtgtgaggatgttgagctcctgggaaaaccgaagggagggcaggagagacaatactgtgaccaaaggctgagactgtgtcatcacttgggaatgaaagcatcaaatgccaccccaggtgggattgttggcttcaaggtttttttctccctttcctttctcccttttctcttttcctttatcgaggtctgctatttactcagcaactcttcaaagtctgtggttctgtgggacacaatgtgctaaatgatgcctgtaagggaggaggtcgatgtacctccacttccaagaagcttgactttccggggaagaaaagacaagtgaagcgtagacattgcgacttttggcttcctgtttctgtgagttgcaaggaatcctgtccacctggccctggagccgccttctgggacctcatccttgccccctgctgcaggtgccatctcaattagtcctgctgtccctcctccccctttcagattccagcacaattctggaacagctctcccacctggccggggtgagactgaggctccaccctcaagcacttgggcactgatcctttgtgaaggatggggatagcaagacagcgtctgcaggggcccctagagggccgtggggatggctagaaaacaggaatgaacagactcacttcagcttatgcccagactcacttcagcttatgcccagaaacaaagaaaccaaggagaagcaaattccataagtgcttttattttattggagatgagcaggggaggcactgaaaagtggggatagtgctggaaacatgctgacagggcctggattgagcccacacagcaaggggcgggagcaggactctaactcccaatgttgggtttccctctatcgtgctctagccccactgcaacctagggcttggaggattagggaagccagctgggatgttccaagaagagccaggagggcggagractccaggaggaaatgggttattgatacctgggtatagatgaatattcccccagctgcctcctggataccgattaatattcccccagctgcctcctggataccgattaatatttccccagctgcctcctggataccgattaatatttccccagctggtacctgggggttgattattgataccccagattccctcagggtgtggcatgggcctcgttccccaaccagtcccagggcctccacctccccaggacacactgggattcagggtaccccaggggtgatcaggcagaaccctgtggatgagagaccagggagggcgttgggaaaggatttttcccccggctcccagtgaattagaacggggcagtcgtctggactccgagtcctggtggaggagtgaagccttgggtgagaggcctgtggcatcgggagaagactccccaggcaaagggccactgcccggagcgagggccgcagcactggagaggtaagagagttcttcaggcagcgcttcccccaggcggtcctcagccgcagcagccatcatctgccaaggatcctcagggggccaggaatccatggcaggcagcccccacgatggaggccacctctgcactgcagaacctcctgcaggtgggaagccatctgatgcaggcacgctgagcttcagaggaacccttgccaagtcattagacctagggtccagagcgggctgcggatgttcagagttagaggggccagtggaggaaggttgtccgagctgaggcaagttggtccccaagttttgggaaactttctcctccacaacaccgatgctccgggcaaagaggcctgagggaaagggaagataaagcaaccagtggtctccagtccccgagtccccagttccctttgcttcccctatgcctattcttccttttccctcagggacctaaatgtgtaccctcctgcctttacccctttccttaattcctgtttcctgggggacctccagtccctcctgcccaagggcatcacggcctccatacctgggagatgaagacagaccaggagcaggcccagaggagcgcagctccctgccaygcggccctgcatcctgctcagcacccgatctccctcagccccaagacagccagccctttatcctggtagtggggtgggggacagcagaaacaggctgggctagtggttgtgaagacaataaacctccacattccaccctcattcctaatgtggtctgtggcaacaggtgtcacttgaatgaatgtcccagaggaagctgggtgtctcccgccctggctcctttccttgacctccctgccccttcttggcccaggtgtcctggctcacagctcatccctggttgccagcctccccagccctgcttctctatacacaaggacctccaccctggggtcccactctcttaattgcctctctcagcaacagaaacacttgtttctttttgggagctggattgtttcctcccagcacccctttctcatgcatcctcatatctccttcaccttggccccaacctgcaggaggttctggggtgcagaagtggccccatctgaggagctgctcctacatgagaccctggatctagctagggaaatggacctggatgccatccttatgagatactgactaattcctgctgctgcagtgacaaattaccatgaaccgaatggcttacaacaacatggatttattactttacagttttggagatcagaagtctaaaacaggtctcagtggattaaaataaaggtgtcagcagggctgtgattctttctgggggcctcaggggaraatccctttccccgctttttcaccttctagaggcatcctgtgttctttggctcatggtccccttcctccatctccaaagccaaaatcagccatttcttacactgtatcactcagacttcctcttctgcctcccatgtccacattaagggacctggtgactacactggacccacctgaataatccatgataatctctgtraagtcagccgaatagcaaccttaatcccatctggaaccttaatttccctttgccatgtaacctaattcctacgttccagggattaggatgtggacatctttgatggtgttggggttgaagacatcattctgcctgctactggtggtcagatgtgccatagagtataagaaaccttgggagaaagtggctatttccaagtaacagtagaggagagcctttaaatgctgctgtcaaatggccaggacttgatccttgttgaagctgggcgatgagaatgtagagattcattaacagtttgttggcttttaaatatgtttgcaaattttattataaaaatgcaatggctttgttctctccatggcttccgggaggccccaggagtaggcttccctggctgcccaaggtctaaacatgagctgttggctgattctactgctgtgtcctccccacctgcccctgctggcttaaccactggaggagtgaagagctcctctccagaactggcagtggatggagcccagaggcctttttggatgacatgcatgagttttacacaagcttttaatttggagcacagcaggagactcgaggaaacaccacatcagagagccttctctccctgcaattcccattcatgaagcatctgaggacctcgattcctgccattggctgcagatcaggggccagatgctggaccaagggtgattcaatccctttctggtcaatgtaatacatttttgctgattccagacttggagtttcaacagttctaaattcaggaccagacagcaccaccctgataggagggaatgggttaagtgctacagtaggggtgaattcctttgcagccaagcagaggctctgagaggtggcctggggtggggggtggggctcctacagggacaagcacaatccactctgccctccttgggatgcgggaacttcgtccgcctcagcctctccctgcctgtctcaggacttaagtcgcatggaccccaccacacactccactttctctctcttctccagtggaagcgactcctctttcccactggggcactctgccttctcagccctcacctgagagccatgttgctcacactctcactctggaccccagcagagcagggagtgtgaagatggagagaccacyggcagctctgttctgccacaggctgggcctcttgatctaggccagtgagtcaccctgcttggctgcactccctgccccgctcccatcctctcagtcctttactctctccacccccagctccaggaacaacgcccaactggcctcctactcagctgacaggaatctggttggagttgttgtgtcccagccttcccaagcttccaggtgtcccagaaacccaggaaatcgagactcatgactcccagagaggatggcatctagaaggtgaggaatgctaatggtggaagaaaaggagtttgggtggggaggggwggggaggggagggagagraaacactgagggccctaaataaggggaagggggaccccacggtgaatgaggaatgggaagagaatggatttcctggagcaatgagagaggagggaaatggcggaaggatctgggaggccaggcaatctctgctttcagttcaacaaatatttattgtcttcctcctctgtgggagsagctggaaggtagaagagaaayacagcccgcttttgaaggaaaatgaggracacagagacctctagaggcgtaggargagcaccayccagactctcagaggagacccaggaytccaagaaggcaaaaagtctgcacctagtccccacagtttactgagccatctktccaggatccagggacagcagggagcctgctycaacctctgagggtgccccagtgtctccctcacccagggaatcatctgrgcactgagggaartggccacaggaaggggctgagataagggccttragaggcaatgggtgtgttggggacggtgatctaggagggcgtggtgagctctgtaatggagggtggggtggaattgggagcgaaagcccagtggcatattgggtgggttgactagatgtcgaagagaggtcagtgaaaagtggccactgtttccagatgatggtttgactttgctttatttggtaaaggggaagaggaaggtataacttcttcaggcgtcagaggtgctctgagagcatttcaggggtttcccagttgagaagstgatgggggtgttactcaatggaccatttcaacacagtagagggaattgtaaggggtggtgatctggctgaggggcactgtggtggaatgggaatttaaacagtaggagagaatcaagagaggagctttgaatctaccattttgagaagaggaaggaggaaggggtgataagagagagtctgcaaccttagggtagtagagaaagcagaaccactcttttgggaaggagggaaactgagctaaccctatgcctgggcactggccttctcccatatgggatatagtgtatgtgcttgtttgtgcccaaggyatgcacacacacaacagttgacttatggactgtygagtaactctccttggggtaggaaaacttcagggtcagctagctggggccccagaggcttcacttgggctaggatatcccggatggagcggcaggggatctttccagcactgctggagccacagggcttggcaccagcggagggatcaggatggggagagccatcggggcccccagtcagtgtcaaggaggagacagacatgcaagggtgaccagaagagctggacttgctgccrcaaggctgaaggatgattttgccactsgattgggaactggagctgctgctgaaggagccggtgcctggtggggagcaggggctctgggaagcactgccgcagggatggtagggtraamcggmgctgctggaaatgctagaacngctggggactcgagaactggagggagagcagggtcccttggagcccgtggagccgcctccacagagctggaccccaccagtccccactggctggaaygcaatggccgaggaagctgccgactggctggggatgatggggttrctggagaagtatttgccctcagagatggggggcccagctgcaaaggaagggacccctggagagcctttcacagggttctctttggtgaagtagcccacaggrtagattttacccttactgtaggtcatgcctggaaccagataactgtcagaggagccacccaccacctcgtagccaccataggatttgtctacagaggtgattgggggacagggcttgcctggaaggccaccattgctacaggggggaccttgaaccactccaggggcaccagaaccgtgctggtccaccaccaccaccacaggyctctgaccccctgacacagagtgggagctggggatgtaggggccrgagtgcgagacgatgggccctccactgcagggagagtcggggatgtccgaactacagggacgctggttggagctgacgctttggccactgctggataccccaraggtytgggaagaggaagagctttgtccaggctgggaagggtttagtattccgcggtaagagttgtcattggttggcagagcagagccattccctacttggaagctgctgctgctgaactgaaagctgctgctgctgctcgaatgagagctgctgctkcccgagtgagagccgctgyttcccgagtgagagctgctgctccccagctgggaggaaccggatgcaccttgtagactagagccagatccggaggagtagctgacctgggaataccccgttcctggcttaaaagatcctgcagaaccaccctgggcaatgctggatccgctggagctaccactggagccaccaccagagcttctggcactggaaatggagctgccagaactgctggagccactgtagctactgaarccgctggagtcacccttcccagtgargcaggggtcgttaggggaggtgatacgcgtggggtccttacargggtctgagaaggtgccaatgctcttagccaaggtccctgtggaggaaagcagtggttagtaagggccaargaggcttggcttcctycctcacctttctgccttatctcagtmatcggcctctcgggtttctcccaagcagagcgcagggagagtttagggatggagaaaggaggaagaactggctattgtctctaaaggatattgaggtggccgaataaaggcatttctttgtttgggaagggtgggcaaacaccaaccagaaaaatagaaaattasgtgccaaagtgagtgacctcaaaggaatacattgaatataagagggggctgggcacagtggctcacgccggtaatcccagcactttgggaggctgaggtgggaggattgcatgcgccccagagttcaagaccagcctgggcaacatagaccccatctgtattttgttttttaattaaaattttttttaaaaagaagagggaatggagaaggggcaggaacaaataggtctaaaagaaaggaccctgaagagacagagaattggggaaactgaggctmtgaggagtccaggcgtaaattcttaggggaaaaatcctgggccagacagtgggaccagagggaagaagacaaaaggcaaaacaatggagggctgagaagtggagacacatatagaaggagacactggaaaaagacaaagctgggggcagaggggctgaaataaaggaaagggcactcgaggactaagatttggtcaccagcttcttcgtgagagcccaggctggggtcaggaatggaaaccctatttcctatctcagcactggccatgccagtaaagctgggtgggggccaggatgtggggtcactacctgttgcttcagaacctgctggtaccagtgtgtcaggacaccgcaccctgagccagccctgctctcgctggcccagcccagggaaccaggacgaaaccccacgaacctccgaggctcctggccacaatcagcttccctctctgagcacacctgcctctgtccagcccctcatctgacttctgctgccttgacttccctcagggatgtggagccacatctttccttatctttcctttcctttgctcaaaaccccaggcccaacttaccccatggttcctccatgactctttcacctgcgttccttctgccttccctagcccctccaggtcccacgtgttacaaacagagccacatactagcaagttactgaacctctctgagctttagtttatacattcagaggggccaaattttccctgccttcccacagcattactatgaagaaaactaaatgagatcatccacctggaagttttttcttcttttttttttttttttttttttttgtgagatggagtttcttgttgcccaggctaaagtgcaataacacggtctcagctcactgtaacctctgcctccttggtgcaagcgattctcctgcctcagcctcccaagtagctgggaccacaggtgcccgccaccacacccagctaattttttgtatttttagtagagagggggtttcaccatcttggccaggctggtcttgaactcctgacctcaggcgattcacctgccttggcctcctgaagtgttgggattacaggcacaagctatcatgtgcggccagatgttttagaaagtgtaaagcattatatattatgaattattactgccactcatcctgatccctccaccaacaaccagactgccatcctctgtgatgtccctgttctctcctcagaaagaaattctctgcatgcacctccacgccgaaccccagctgtgccaattcccttcagtcctctgcacgaatccaccatgcattgcctctctctttcgctattccctcagacaccaaccacccactagaccatgggaaggtcgcagaaattcctcaagggctataagtacccggtggtcaacaacacaggtccaggggttgcctggcctggggttgaaatcttggctttgctgccttctaatgcatgattttgagctagtttcctaacctctccgagcctcagtgtcctcatctgtagagtggaaatagcaaatctcttttcataccgttcttgtaatgatcaaaagtgctaatataggccgggtgtggtggctcatgcctgtaatcccagcaccttgggaggccgaggcgagcggatcacttgagtcaggagttcaagaccagcttgaccaaaatggtaaaaccctgtttctactaaaaatacaaaaaaaagaaaattagccaggtgtggtgatgggcacctgttgtcccagctactctagaggctgaggcatgagagtcgcttgaacctgagaggtggaagttgcagtgagccgagattacgccactgcactccagccttggagacagagtgggactccatctcacaaaaaaaataaaaataaaagttctaatatataatccaaatgtgcttaaaacagagtctagcatataaaaaggctctaaaaatgatattattactattaaatgtccaatcattatcttgtagtgctcccataataaaaatcaccaccaccatttatataaacctctagaatttccaaagtacatatcacatacattatttaatttgagacacacagactagaggtaggtgtcattaaccccacttcagaatttcagaaactggggctcaggaagtttaagaaacttacctgaggcgaccatacagtgaggagcaacccccagactcaaaaggcagattccagagcccctgcccgtccccttcgctgggtcctctcccggagtctccctcccgcctccctcctgttcccagggcccccagcctcctacctggcaggaggagaccagccagcagcagtgccawcatcccgtgcccacccacacgccccatccagggtgcccgagacgagcccatctcggrctgcacggcctcctgactgatggcagctcraggacaccygggtcctttatgccagagctggacattccctgggcaggagtcactgtggggagaggaggagaggtggagggggtgggtgccccrggggaagttggtgtggccgggaggagcgtggtaatcagcccggtgcatctgcctactcagcagcagcagtggctgcagtgtggggtacccatggccacggggctctaacgatcctgccacctgacaggcctggccccggctcctcattgcctaacccggaaccaggcgctctgccccacggccacccactctggggcggccactcttgccacgggacccagctgcctggctccttaactctcctgcctaccgtggcttggcctgtctctccatctgccctccactcgcagtcgtgggtgtttcagctttttcttccacacttgggtgcccgctccagccccacccacccaaccccaatgaggtcccattcacagcccctgatctgctccttccttaggaccccatcactccacctccactttcctccttcaaatatgagttctgcccccatcccccaggctccccctcccaccactccccaagtaccaggccagccacatacctattacgtgttccatcacctggggaaccttctccttctcagaaatggggcaccacattcccaaaaccaactccctgacctgtcgcttctgggggcctctggggacggcatggtggcgggggtgggggggggtgctgggagccagggctcagccaggggaggggcctgggctgatgacctctgtcaaagctgggccttggttactcacaggscactcacagcccctccccatggctggtaacccagacctcaagggtgagcaagaggctaagaaggctaattgggaaggtggtggccccgtagcccatctgctggccctgggctggatgagcgagcaggaagcagcagccagctctgggcaggtcgaggagggccaggcaggctcccgggtcctcaaaggatgaaaggaggccaggagaaccggagccctgccatctgctgagagggtggtggcttctcctccattgcgttggcctccctcctgctctggcccctgccccgccccagccaattaattgctcactagtattgcgggagtatcagtatcggagggaggtgcctgsragtccagcaagctgccctctcctcccccaggcctcagacacccctgctcccctcacccaaactcacttcccaaacytcatctcctcacaaaggcagctctgtccctgggccccttgggctggtctctcccattccctctacctcctgaccgccctttaagttcagaccagcaggaggatggaaatgtttcctgtctgtgctgtccsatacggtagccactggccacatggrgcaagtttaaycaccaaagatttggagctttaattttaattaattgtaatgatgtggttggccacgtgcagctagtggctgccatctrgtcttgctcttgacttgctagtgacactcagaatgggagtgggaggaaagaggggctgagggagctgtggagagaggaagggataggacagggtcccctgaagggggctaatgccttgggaaaaacaaacaaacaaaaaacactggcttcagaatgaagatgacgtgggttcaagtcccagctaacctcttggctttgggcggctcttcaaacctttctgaacttccatctcctcatctgtgaaatgggggtattttaaataacacttatttcgcaaggtttttgtgaacatcaaatgggaaattatcaaaaaggttaaatgggacaaggggtgcagtcccccagtaggaagcccagcaaatggagccckgcaggtgctcctgtcttcatccttccactgggggagacaaataggccagcttcacccccacagccccaggctccctttcctgagtctccagcccagccaatgctagcagagtgtcttctgctcccttcctgccttgtatagaggtgcaggcacaaatgtgagacagagataccatttaaagtgatgctgctcggctgggcacggtggctyaygcttgtaatcccagcactatgggaggcygatgcgggcggatcacttgaggccaggagttcgagatcagcctggccaacatggcgaaaccccgtctctaccaaaaatacaaaaaaattagccaggcgtggtggtgggcgcctgtaatccctgctactcgggaggctgaggcaggagaatcacttgaaccctggaggcagaggttgcagtgagccaagattgcaccattgcactccagcctgggtgacaaaagggaaactccatctcaaaaaataaagtgatgctgctctttccgaacatcatttcctcttgtgggcctccctagactctcaggcttggctccctggaggacctgggcaaggagggagggggcactggggtartgaggggagtggcagagggcagggaggagtggactagaaggtgctgggccgtcccagggtgtgaggggagaaggcagcggaacagtggaatctgtggcttcttcttttccaacacaaacttcccctgaccagccagaggtagcaaagtttgtcttgttttctttstcacaktcctcctggctgccatcagaacttggccaagacagccaggctggaggaggcacagtctctcctggcctcctgccaggtctccagccgcccacgtggactggtggtgcagccacgtccctcctcctggctactctctcctgtccactcctgtccaccccatcctgccaccctgggctgcccagttcctctactgtcctgcccacctgtgggyccttgagctctaatcygccrtgcttttggttttttactgaaaccctgccttctgtgctagattttactctggtgctcaccattaatctttctctcagtgcaggtggtgaagacctaaagctaatggggcttaggagggaagagaagggcatcagctgagtgcccacacaggccagggtcaccttcagtgaagctgccagtttggtgacgtccacagtactgcaggcagctctgctgtgttctacagcaacagattctggccctgcccctgcccgtgcccgtgcattggaccgggtgagaaagtgtgggtggcgtagacactctacacccgagaaaatcaagctcaaagcacatggcttccataggcaaaaggtggggctcccagccatgtattatgaagcaggcaggtcactgtcccctccggtcccctccacccctccagcagccctgtgctgctgtgtttgctgtgccagcctttgcccccagtgcacgctcctctgctgtgttttggaagttgcactgagaaagaagagaaattgttccttgccctgaggagctgccatccagctggggacacacagcgtaagagagcagcctagagtggagaagcgggtaggcacttggcttcagggaggtggcaggactttccccgggccttgaggaatgatgagagaagcacagagcaggcagccagacgtggggccttgtggtgcttcaggtgtatttagaaccagcggatggcgtgggttggtgtgggacatgcatgtggaggacagtggtgtgggagaagggacaggctgcttggatcgggattgtagatgacctacaacaccaggttaaaagaatttggattctataggaattgcagtaaatgtgagagggtgcagggaamcaaacggctttgaatgatcacaaagggggctgaagcatggcgtgctgtagtcccagctacccaggaggtggaggtgggaggaatccgaggccagctggggcaasttgagggactccataaagaggaggcttggggcacgagatccaccatgtactgactgcctgctgcaggcggacacggtgcctgggtatttaacatgagttgtcttgttcaatcttcacaacagccctacagggtaagtgctttttccccctgtttcacagatgagaaaamtaagttgaaattatttgtccaaaccagctgctaacaagcaaaaatgtttgaaaaagattcaaacccaggcctgttggacttccaggcccacatagatcctattactctgcagctgacaccatgctataaatgaatggcagaggttcatggacaggcttaagaggctccctaaaccctgtaaggatgtgtgcaaaattccttatgtatatgaatatttctagagagaagatttctgctgtcaaagctggccaggtatggtggctcacgcctgtaatcccagcactctgggaggccaaggcaggtggatcacttgagctcaggagtttgagaccagcctggccaacatggcaaaaccatctctactaaaaatacaaaaattagccgggtgcgggggcaggcacctgtaatcccagctactcaggaggctgaggcaggagaatcatttgaaccagcgaggcggaggctgcagtgagccgatttcatgccactgcactccagcctgggtgacagagtgagactccgtctcaaaaaaaaaaaagtgaagagttcctaagtgaaggttactggctcatgaggtccctcctccacagctttcctcctctgggggcctgagagtcaggacagaagttctagcacaagtgtttcacataggggtccttggtagaccagggcttaggcttggaagaaggaaaatggagtgagcacgaggaagagaaaaagcctggaaaagcagcttattttgtgctgaggagagaaggaaaggggccacccagagctgctctggggctccagggcctgtgggctcctcccctcctttgttcctctctgcttggctccagcgagaggccrtttcctctcctctctctttctccatgacacccacgcttccctgtggactcacctctgcagccacarcaacaccctcctctccttggcgtggaagccagcgctcctggcccactcccagtagggratgtcctctgagttgtttttcctgtgcggggaggggtggactgagtcatccacactcttcacctggttcctctggtgaccaagaacatagaaggagagggcacatccccaatcaggtgttccgaacatctctgcggggactgaccctcctcagcccaggtgctcccatgggactggctacacttcttgactcagttttaatctctccttctctgccttcctgttgggaataccccctcacttctgtggcttctttcctgtagtagacgatcaagggtggaatctacagtccrtgrgccctgacttcttgccttcgtctcaaatagactctgcagccagccatctatgcagcgccccagtggctttgaaatgcaacagaaaccatcacccccggaccrtgggctccatgccagtgggcaaagcacaggtgcgttcactgagttcccagcacatagctgtggcaggcacttggtgatattttgaaataaaagaatggaagaatgtgtccargctgtgcttcccctttctaccttactcagggacatggtgccctcctctctggtttcctgccctgtgcccaccccccrccccctgcaagcacagctcttatgtgcaaagcccctgtaggtgctggagggattcactgatggccttggcggaggtggcagtgggcatgtgcacttggctctgacacagccactcatgcaacaccctgtgcaatctcggcctgggcctgtgtgtcctgccctcattcctcgcgggtgactgtctcccctgagccactcttctctctattggattagctccttttatttccccctagggatgcaacacatttttatgaacaaacagcagtgttcacatggctgtgatgaggacgtactggggtttcccctggacatggcattcatctgatgccagtggtgggcaggaccgtgctgtatactttaaaaaaaccctagggggttctgttaggtgcccccactgcagcataacgagttgcccctagctgagaagccctgtcctggggcctgtccacaccatcctcttcctgagattattcctggtgtgggcggtgctcggctctacctttccttccttcttccctgcttggctcctggtccaatggctctctcctctatggaatggcctcctggagcttggctgggtcagcccccactttccactcttcccatgcctgtcctcaccctcccagcagccctgccagcctccgacgggcccagggcactgcagccggcacttgggagtgaagactggggccagagccaggckcacctttggccactgaatcctgaaagaggaggaatttggcaagtggggttctgcccaccaagctttcttccccccgctcccctgagtcttttcccttcacccccacttcccaaaagcagcagggagtcagctgtagggcagtcgctccctggccgaagccttcctggctgtttccgtcacaccctgaggccacccctcttatcttgcgaggagggaggcacacagaggctgtgattagctgtcacagtagcaagactgttcccctctctgtcctgcggagtgagtgtgagggaaaagagctctccttgtctgctcattatgtgcacctgttaaatagtcattctttccactagggctattagtggtttttattgttactggtcacccagaattagagtcacagcttcctcgacagggtgaaagagagcgccagggtgcagtctgaacgtgctctcgggagaggagaggccggaaagacttgtaccaggagggacttctaggctgggctggcccttggagcgcctaggaatgggactgtggtggcccatcttccctcctgtgttctgggctgtctgagtgcctctgggtgagagtcctcacaggagggagcttctcctactgcccagtgtctccctggcacctgaggcatcacccagcacacagaggtgaccaggaaacacagactcctgttagagaggcatctcgtgtcccgctctgttctcttgggccctgggactagaacatcttcaccagagaccggcgccgactccttggcagtgtgtaacattcagctcggtgccgaggtctgcccgtgcaggactgatctccattctctcaatgaccctaggagacaggaattattattattattattattattattattattattattattattattattttgagatggagtttcgctcgtagcccagcctggccaacatgatgaaaccccatctctactaaaaatacaaaaattagccgggtgtggtggtgaacacttgtaatcccagctacccgggaggctgagacaggagaatcacttgaacccgggaggtagaggttgcagtgagctgagatcgcaccactgcactccagcctgggcgacaagagcgaaactctgtctcaaaaaaacacacayacacacacacgtttgggaccatccctatttcctcgctctgcctaagctgcgtcacaccattcatcactaggtgacatcctactacagataccttgtaagcatctgtgtatctctctcctccctcactggaaggcagctccctgagggcagggccctgatccctttgactggctgtggtatcctctcctgtagaccrctggctcatgaaatwatcagggagagaatgtgtaaatgatgatcgtgaggtccacttggacaagcagcctgtgcctgaattttcctgaggrcttcagagcctgtctcgcctcgcctcacatgcctggctcaccttagaacggtcaccttgacggctaaagggacacctgtgtgccttgatggtggacccagggagtggatgacattagtgagggaaagagcaaaggctctggaggaaaacacctgagaggagtctctaggctgccctctggtggcagttcttggaacaagacctgagagccgctaccttggctctcagcattgcacgggagtttagaggttattaaagaaatccccctaaagtcccatcccaaggtcacayagagaacgaatggctaagtagcgacaagaacccaagtcacagtctgttgatctcactaccatgctatcctgcctgcccccatcacaggagttgagattatactgcaaaaggaaaggtggggatggggtggggactggggaatttggggagggaattgattactgcctctgaggatattagggggraaaacccacaggaggtgcatttggcttaattcagcaagttttttgagttttgattcagtgccaggcacctggtgggcacttaattaaagattagcaggagaagaaaaatgtacagtaagagagcttaagtttataccaaagcgagtcttgggtctaataattttgaaacatgaaattggcagagaagttaggagtccctcctgggctcctacgtcagggtttgccccctctctaatttaactttttatcaaattttattgtcatgatgtatatgtttgtcctccctaaacacagagccccttgagggcagggaggactgaaactgcttcctgggactgtcaccatcacatagcaccccacagagcagatgctcaatgaatgttgattgtgtgggcaaatggatgaacaaatgaatggtttggagtttccctggccagagagcttcaaagcagggcagacaaccatctcttctgtctagtccaaagacatcattcgctgcccaaggctcagggctgtgcctggtgctttctcaaggtaacttagcttgtataattagattttaccrtgatactagttctaggttctttttttttcattggccaagcatttaataactatctgtcatgtccaaggttctgggctattgttctgtaaatctgtgatcctattctgttatttaattccrtgactctgtgttgacatagacgtgacggtgtccctggggcatttactcctaggtgagcttagccaaggcaggtagagaggaaccagcattgtctaatctgaatggataagccagcacaatgggtttccctstgcaaatacctccataccatccaggcccactcagtctcctccccagctaatgaagacagcctgtttgagtgccaaaatccactgcctattaataggtactaaaatctccaattgcctyatgcctcccccttctctttcccactcacctacctgccatgtcagcctgggaagaattggtttgcagccaggcagtcctccatccagtcttgactttggcacttgtgatatgacttgcacaggtgagttacctctctcagtgttggttcctcktctgtgaaatggggctaatcatttgctttawtgagtgccttctaggctgggtactaggagagaaggaagggatacaaagaaagacaaggcacagttgctgtcttcaagaagctcatactttccaaggaaataaaggcatggaaacccacatagtgctgtggaattaaagaaggcagcatgctgtaaagagccccagctttttccctagacaacatcaggggctcagttcctttccctcctttctctcttctttaagaatttctcttagctggacatggtggcacatgcctgtggtcccagctactcaggacgctgtggtaggaggatcccttgagcccaggaggtcaaggctgcagtgagytgtaaytgcacctctgcactgtccagcctgggcgacagagcaagamcctgtctcaaaaaataaaaaattaattaattaattaattttttttcctcctaactaaytccacgttattggcttgagggtcagtttgaggggtccagacctccttcttcctttctatccttagcttcctgccacagtatacccagagatgtatgtgtttctccccaccctaggcacaattttttttttttttctgagacagctctgtcatccaagctggagtgcagtggtgcaatcatatctcactccagcttcaacctctcatgctcaggtgatcttcctgctgagtagctgggactacaggcatgcactaccatggcctggctaattgttcgttttttttttgagatggagtctcactctgtcgtccaggctggagtgcagtggtgcgacctcggctcactgcaacgtccgcctcccgggttcacgccattctcctrcctcagcctcccgagtagctgggactacaggcgcccgccaccactcccggctaattttttttgtatttttagtagagacggggtttcacygtggtctcsatctcctgayctcgcgatccgcccacctcggcctcccaaagtgctgggattacaagcgtgagccactgcgcctggcaacctggccaaatgttaaacattttttttgtagaggtgaggtcacactatgttgcccacactggtatcaaactcctgagctcaagcgatcctcctgccttggcctcccaaagtgctaggattacaggtgtgagccactgtgcctggcccttttttaattttaattttttttttttttagagatggggtcttgctgtgttgcccaggctggctttgacctcctgagctcaagcaatcttccacctcagcctctggaatagctgggattacaggtgcgccctaccatgttcagctaacttattttgtttgttcagagacagggtcttgttatgttgcccaggcccaggcacagttctratagaggagagagactttcagatatgagctcctgcacttggcaccaagatcttccctaattttcccccgacctgtctctccaacatgtctctctcttcttcgggttattttactccaatcattcygatctactctttgttaattgggcccttcattaaataatttagcctttcacaaaacacacattaagtgtgcatgacggcccaggcactgtattctctgtcagggttacacagatgaataaagagctgggatgggccaggcgcggtggcttatgcttgtaatcccagcactttgggaagccaaggctggtggatcacgaggtcgggagttcaagaccagcctggccaacatggtgaaaccccgtgtctactaaaaaaaactacaaaaattagccaggtatggtggcgggtgcctgtaatcccagccatgtgggaggctgaggcaggagaattgctttaacccaggaggcggaggttgcagtgagccaagatcgtgccattgcactctagcctgggtgaaaagagcaagactccgtctcaaaaaaaaaaaaaaaaaaaaaaagagctgggatgatgtagtggttaaaatcagtgttgttagcatagcacagacctaaattgaaatcccagttctgccatttgtcccctgtgtgaccttgcatgggtcactgtacctctctaggcctgtttctgtcttctgtgaaatgatcatgatagcattgttatgcaaattaaacgagarcttaagctgtagagcatttaccaacagtgccctatggcacatgcgcagtagaaagtagttgcaatagtgtgtagcaaatactttgcatcctaggttggattccccagaagcaggccctgagacaaagattcaagtaaaagagatttatttaaaactaatgagaagttgggcagggtggctcacrcctataatcccaacactttgagaggcggaggcaggagggtttcttgagctcaggagtttgagaccaggttgggcaatatagtaagacccaatctctacaaaaaaaattagccagacgtggtggcatgcgcctgtgatccagctacttgggaggcttaggtgggaggatcgcttgggtccaggcttcagtgagctgtgatcgtgccactgtactccagcctgggcaacagagtgagaactgtctcaaaaataaataggccaggcacagtggctcatgcctgtaatctcracactttgggaggccaaggcgggcagatcacctgaggtcaggagtttgagaccagcctggccaacatggtgaaaccctgtttctactaaaaatacaaaaattagctgggcrtagtggcgcatgcctgtaatcccagctactcaggaagcagaggcaggagaatcgcttgaactcaggaggcggagattgcagtgggccgagatcacaccactgcattccagtctgsgcaacgagagggagactccgtctcaaaaattgaataaataaataaataaaagtaatgaggggactgggcatgatggctcacacctgtaatcccagtgctttgggaggccaaggcaggaggattgcttgagtccaggagttccagaccagcctgggcaacatggcaagacatcatttctgcaagaaattaaaaaattagcccagtgagtggagtgcatctatagtaccagctactcagaaggctgaggcaggaggaccacttgagcccaggaggttgagactgcaatgagttatgattgtgccactgcactttagcctgggtgacagagtgagaccctgtcttaaaaaaaaaaaaaagtaatgagggtggggaggagtggaaagggagtgggaaagtgggacccaagcacatgagtggaaccaagctaagtctcatggagggctggggtactgacaccttcatatttgtccaccgttggttaaggcctgggggcgggctgggggagtgggagggtggtggcatgtgaggatgtgggagagaaaaatttccaagtgcttccagctctctgcccctggaaaaggtcccagcagaggcataggcggggctgttgggagtgatttagcactctgggagtccgtakgcacaaaaatggtaaaggrgttcaagaagaaatgcgtagaacacagtccctgccycacaaggttcatggcctgggaarggaagacagacatgaataaatcattgccatagggtgactggggtgaagggcgttgggggtcgggtggggtgcgggaaggagtggtgtaggcagaggcatccctgaggagaaatgcagctggtttgggagaggacggccattccagacatagggaacagcacacacgaaggctgatgcacatacgcgcaagggctggtcccyagagctggtggttctggccacgagagctcatcacctgggggcagcttytgtacctgcaccctgtatgaggctccgggtctgcccttcctggtccatcctccagacacactgcctgttcttctctcaggtcccgctccgggccctcctcccagaagcctcccctgactagtccagctcaccgtgactcttctgaactcayggcgtttactgccaaggctattacrttggcgctcgctcatgtcattattaggaaatatgcatttttactgtctttgatgttatttaaacttgcctgtaaattctgtctctctcaattttaagttctgagtagaaactacatatttttattatttatattcttatattctcccatggcacccrgcattcgtggacacattgaggaagtaagataatgaatgaatgaatgggtgaatccagtccagcttggggcctatttaattctactaggctcaacctacaattcttatgtgttctcagattattcctaaaccctaagcttagttttgtttcattcggaccacatgtagtttttttttgttttttgttttctgagacggggtcttgctcwgtcgcccaggctgcagtgcagtggcacgatcttggctcaccgcaacctctgcctcccaggttcaatggattctcctgcctcagcctccygagaagctgggattacaggcgccygccaccatgcccagctaatttttttgtatttttagtagagacagggattcaccatgttggtgaggctggtctcgaactcctgacctcaggtaatccacccgcctcagcctcccaaagtgctaggattacaggtgtgagccaccacgcctgatctcatgtgtagttttttggttttttatttgtttgtttttttgagatggagtctcgctctgtcgcccaggctggagtgcagtggcacratctcggctcactgcaagctccacctcccaggttcacgccattctcctgtctcagcctcccgagtagctgggactacaggcgccggccaccatgcccagctaattttttttgtattttttagtagagactgggtttcaccatgttagccaggatggtctcgatctcctgacctcgtgattcgcccgccttggcctcccgaagtgctgggattacaggcgtgagccaccgcgcccggcctctcatatgtagtttttaatgagagttaccacataagcaaactgggttctaagtggtgaaatttaaggttatgcaacctcagtttcttttaacccctcttcatccctaaccctggtcggatacttgattgacagtagaccattgggatctctgagctcctgtccttctaacctgattgcctctttaaaggattttgaaaaactatgtcccttgcacatttgtattgttttgagacacggtctcactctgttgcccagactggagtgcagtggtgccatcttggctcactayagcctcaacctcccagggtcaagcaatcttcccacctcagcctcctgagtagctgggactacaggtgcgggccaccacatctggctaatttcttaaattttctgtagaracagttttgccatgttgcctaggctggtctcaaactcctggccacaagcaatccacccgattcggcctcccgaagtgctggtattacaggcatgagccacctygcccagccccttgcacatttttaagtcaacatttaacatttgtaataatttaatagcattccaaagggtakgcttttcarggaattgcaaatacatgttaaaaatcacatcactatttatgtatttatttatttatttattatttttgagatggagtctcactctgtctcccaggctggagtgcagtggtgcgatctcggctcactgcaacctctgcctcccaggttcaagcaatcctcatgccctagcttcccgagtagctgggatgcccagctaagttttttgtatttttagtagagacagagtttcaccattgtccaggctggtcttgaattgctgacctcaagtgatctgcctacctcagcctcccaaatgctgggattacagtcgtgagccaccatgcctggccatgtcagtttttaaaattaaaaacaatttgttgtgctcagtctgtcggagactgcacgtcactctaagtgtagcaaattgaatataatgccatagaactttcatatctgttagcatccttttaaaaaatacgtgaacaagcccttgaacaagtgttagaaacagttattctatttgtattgcaattattgcagttaaccaaaactaggaatattcacaaggattaaacataaaaagttggtcaggcgcggtggctcgtgcctgtaatctcagcactttgggaggccaagatgggcygatcacttgagctctggagtttgagacaagcccgggcaacacggtaaaaccccatctctaaaaacgaaacaaaactaaactaaacaaatacaaaaaattagtcaggggtggtgcacctgtagtctcagctacgccagaggctgagataggaggattgcttgagcccaggaggttgaagctatacgagccatgatcgtgccactgcactccagcctggatgacagatggagaccctgtctcaaacaaacacacaaaaagacatgaaaagtaacttattgaaaatgcatctcttggccaggcgtggtggtttacacctgtaatcctagcactttgggaggccaaggcaagcagatcccatgagatcaggaattcgagaccagcctggccaacatggcaaaatcccatctctactaaaaatagaaaacttatctgggtgtggtggcacacacctgtaatcccagctactcgggargttgaggcaggagaatcacttgaatccaggaggcgaagsttgcagtgagctgatatctgtcgtgccactgcactccagcctgggcgacagagagataatacgtctcaaaaaaaaaaaaaaagaaaagaaagaaaatgaatctcttaatgagatgggaaaggttgatttgtttcctattgacctttggcggctctgggaagggcactctggtcaggcccaggacaagcaggagattcattctagcggggggcacatattaatctggaaactgattcccttaaaactggtcctgccgacacacccctgggaaggtttgcatataccactaggggtatccaagccataggccattaaacagagatgaaacttgccttcccattctttaatatagtgttctcagaaagggagaaatgtgggcctgaatgttattgtgacttgcatagtgacatttccaaccctcctcctgctaagccccagagccttacatgctggacatgggcaagataggaactcaagttacttccaggtctcygtaagtttaggactgtgaagagggcatcctaatagtcaaaaacataagtgttggccgggcacggtggctcacgcctgtaatcccagccctttgggaggccgaggyggggagatcacgatgtcaggagttcgagaccagcctggccaacatggtgaaaccccatctctactaaaatacaaaaattagccgggcatggtggtgcgcacctgtaatcccagctactcagaaggctgaggcaggagaatggcttgaacccgggagccggaggttgcagtgagccgagatcgtgccattgcactccagcctgggcatagagtgagactccatctaaaaaaaaaagaaagaaaaagaagaaagaagccgggcgctgtggctcacgcgtgtaatcccagcactttgggaggcccaggcgggcagatcacgaggtcaggagatcgagaccactctggctaacacggtgaaaccccgcctctactaaaaaatacaaaaaattagcctggcgtggtggcgggcgcctgtagtcccagctactcgggaggctgaggcagaatagcgtgaacccgggaggcggagcttgcagtgagccgagatcgtgccactgtactccagcctgggcgacagagcgagacttcgtctcaaaaaaagaaaaaaacaaataaataaaaataaatraaaaagaccctaagtgttagttaaagcagcagcctagattcagarttaagaaaacatgatttttatttttccgtttcatggaagcagcagctgtctactgatagttcctgccgccggccaccaggtggcagaagggaacacagtaccrtagccctgccccagcgatcgcgcgggcaggaagaccgggtgggaggtaggtgsggccgaggcctggaggcgaggtaggagagtaggcttaggctgtcagaggaaaaaacgggcgatgtgaggactaagtatggatctcaggaggggacaggaaatattgagaacaccaccttacgggttcagaataaaaccgagggaatgaggaagaggtttaaggagataggctaaattgggaagaattcacggggaatcagagggtggagagggcgtgggtgcctggagatgcctgggaacagaacggctgaggggactccattatctgtactcttcccggggtgggtctaggtctggctcctcctgaggtcggttgtccacctcaggggcaggaggccaggggttttctgggggctggggtcctgccggccaagggtcgtcaggccggggaggttgaggaggatccgttctaggcggttcakggggccagactccagtttcaggcaggtctctccagggacgactggggcgggtaggcggaggatcttcaaagagagggggtgcccctggccaagggtcaccggggactggggggccctgaggcaatgttggggagcctgcctcctctcggtcctctgcgggtgggtgagaggggtggccctcgctgcctgagatgcctgtaaaggaggaaggagaaaggtaagaggtggtgagggcttctctccccagccccacccagccccagccccaggaggaggagcctgtctggatggacgcagcctgaactgacccacaaacagaccaaaaaagtcactctcaaagagctctcggtaggtttgtaaatacttaactgatggtaaartgtcatgaacccctacccccgatggatctgaaccgttcacttgacccactttaaactgaccagacttctccaaataagctccatccacccctggttggggtaccccactagctttgtcctcaggccaacctgcaacccaargtgggttacaccttggcccccaggcacacagaccccagctttacaaggaccccagctccttaacacagatcccagctccraggaaactcgtcccccccacgttaatcctgaccgactttgccacatggagccagcaaaccatttctggtgagagccaaatgcaccttctgcaccatgtcccccacccaatgtgtccwgaaagccatttctggtgagccagatgcaccttctgcrtcccctgaattcctgtccccaaccccatgcgtccagttcacctccgccatcttgagtatccctcatcaccccaaactgcagtccctgcctctgttcccacctcacctctggtgtgcaggcaaaggaccaggatccccaggagcttccagttgaggatcatggctatgtactggcccccaaagctggggtgggctgagtctgggtgcctgggaaccccaagaggctttataggggaggagtggaggagggrccagcccagtggcacaggaataccatcagaacagaactggtcaaacccgttgggaaggcctgggctgatgtgtcacccctgaaggtggcgtcccttattttagtcctccagcccaggacccagctgcctgctctcccyatcatgacccagagcctgcgtcaccccaccctggttttcacaccctccatccacaycctggagcagtcaatacccacttggcatctccgtaatcacagagatgtccaccttcatcccttgcaactattggaagccaaagaatgggagcaaaccacrcgaygggcgttgggaascaccrtaattacagggttgggaggcaggatgcctgcgctgrgggaggaggtgcytttcaaacctgggatgcagctgggacagtgtcagctactaccccagcctccccactcayccccgcactgaaagctccccctggggcttcgtgctttcctgggcacttcccttcccccatgggatccaggcatcctgctctccaccatgtccttcttcaggcatncaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaaygtttccctcaaggacctttctgcctggaagtctgttagcctttcagaagtaacatgtccaaaataaaatttgattcctcccaggttgttccctgcctggtccgctaccccacagtaaggaacaccttattatgcaatggcgtgatctcatctgttccctccagggctcacgcagaaaccttcgttacaytcctccaccatccacctgcaagcccctccacaccctgtccaaacccagcccatcatcctgagccaccatctcccctgagcctccccaacacccttctaattggcccccttgctcccactgtttatccctccccctcacacaaagcctgtcctccaccagcaaaagaggtcttaaaatatacatcacgcgggcctggtgtggtggctygcgcctgtaatcccagcactttgggaggccgaagcgggcggatcacctgaggtcgggagttcaagaccagcctgaccaacatggagaaaccccgtctctactaaaaatacaaaaatattagccggacatggtggcacatgcctcttggtaatcccagctactcaagaggctgaggcaggagaatcgcttgaacccaggaggcagaggttgtggtgagctgagatcacaccattgcactccagcctgggcaacgagtgaaattccgtctcaaaaaaaaaaaaaacatatatatatatatcaggccaggcgtagtggctcatgccagcactttgggaagctgacacaggaggaccacttgagctcaggagttgtgtgcgctgcttcacctgcagcaagactgtgggcaacacgtgggaggcctacctggggctgctgcagtccaagtacgctgatggggacgccctgggcctgaagcrccacagccgctgcctgccgcatgctgctggcccacgtggacctgatgcggaaactgctcaattatgccctcctggggaagtgacctggttagacccacccatctgctgcgctgggtgccgggagcaatcgctgaccacagtgcgtggatatgtgtacctcactctggaagggaccatccagtaagtccctcaggaaaaaaaatgtacaccaaatcatgttgcgtcttccctttgtttggggagtgaggacaggttctcgctctcttaggctggggtgcagtggtgcgatcacagctcattgcagcctcaacctcttgggctcaaacaatcctcccaactcagcctctggagtaactaggaccatgggtgcacgccaccatgccctccaatgttttttatttttattttttatatagatggagtctccctatgttggctggtctcaaactcctgggctcaagcgatccgctcacctcggcctcccaaaaaagtgctgggattcagctactccggaggctgaggcaggagaattgcttgaacctgggaggtggaggttgcagtgagctgagattgtgccactgcactccagcctggcaacaagagcaaaactgtctcaaaaaaaaaaaagtgctgggattacaggcgggagccacaacaccgggcccccttccctgttttttttttttttttttaattcttcttctttttttgaggctgagtctcgctctgtcacccaggctggagtgcagtggcatgatcacggctcactgcaacctccacctcccgtgtccaagcaattctcctgtgtcagcctcctgagtagctgggactacaggctcacaccaccacacctggctaattttttgtattttagtagagacgaagtttcaccatgttgcccaggctggtctcaaactcctgagctcaggtgatccgcgtgcctcagcctcccaaagtgtcaggattacaggcgtgagccaccacacctggctttcttccccgtttttaaagaagtactccaatggctttctattgacttacagtaaaatccaaacttggccacatctcggcctcgcagcagcatccttgagcattctctacagagacctcctggcctccacaggagcccacttcaggcaggcctctgcacaaggtcccctgctcagaggcctctccccagagtcagtttctatcatatcatcatactgtactttctcttcaagcacttatttgaaacgatctcgttcatctgtttaggtcccatctgctcgctctctctcccactaggatgtaggctctcagggtccaagtggcccccaggctaatacagtgcctggcattgacattcctgttgaacgagtgaatgtttcatcttccccactcctagcatttatcatcttccagaagaaaagagttttaaaacaaaagttgagaataaagaaaagcaggagcttcccaaacatttccaaagctgcctagaaaaaggatttgaaaaggtgccacccatagagagagctatgggtgggaccacttctcacaatctccaagagagatggctgcagggagaattcccacagattcccagaaataacatttccaaacaatggctccttctgtagtcgtctttatttagagcagaattcagactcagctggtatcccccagggcaaccccaggatggggaagggctggtctgtccccacccacttctccaggatcctcccagcccccaggctggctttccctccaactgtcagctgcttagctgctcatctggggattggagctggagcatctgtcaaggttgtctccttgacaaacagcttcctctttggaaatggcttcactcaggtcctgcaggtcatcgagcaggacagagagggaccctgggaaggaagacagcagatgagcaccagacaagggaaggtgctcgtggttacagaggaaacagggctggcacaggaaatgaggaatgggagagaggaggctctttggtccaagctgggcatcgctaaaagaggctaagggcctcgaaggaccgcagagaacaacactcatcatgcgagagtctgaagaggagattcctgaagtgcgcgcatttgtcccttgtccctttgtgcttggcccaagaccttttatggactccctggtgggcactgctgctgctacaggtgcagatgctgaacactctggaggcctggggctggacaccacagatttcttcttatccagtagggaaggaagaactgtcaacagtcgctgctgcttgtaacgggagaggagaccttcctgctgcaaggtggcctgggaaggagagggttaaacctagcccggatagagcctccctcaccatcctctttccacacctctagcccaggaaccagcccaggatgggccctagtgtctgcctgtctgccctcctgtctcctaccagcatgaggttcttatccctctctagctcctgcaagcgccgggccagtcgcwgcccctcctccttccgggcctcctcctgcagacrcctgagttcctggctccgctccttttcctgggcggctctgcgctgaatmtggcgyaaggagaccactacagagaggccaaggcacagaggaggcaggtgtgagtcaggccagaggcagccaggcaccatgaagacaggaacaaacgctgggtcaccaactctgtggcttggggaggctgttctgctctgtggatctgtctcttctgtacagttggaggggtgggctgatgctctaggagcctgggaatctgaacctaagtatcttcctcatccctgaaccatcctggagttcctcaggggaaatctgaacatgaactgggttagattttgtgcaattagtgttcactgtcttaaagtgtgatgattgcagctatataggagaatttactggctttgggagatgcggctgaacaacttatgtttacaacttacttaggcgtggtggctcacgcctataatcccagcactttgggatgccaaggcgggcggatcacgaggtcaggagctcgagaccatcctggccaacatggtgtaatcccgtctctactgaaaatacaaaaactagctgggcatggtggtgggcgcctgtaatcccagctacttgggaggctgagccaggagaatggcttgaacccgggaggcagaggtcacagtgagccaagatcatgccactgcactccagctggtgacagaggaagactctgtctcaaacaacaacaacaacaaaacattaaatgattacaacttaaagtgattcaaaagatgtacaaatatgtgtgtatatagataagagaccaaatgtggcaaatgttaactgctatatttagttagagaagatacattcattacacaattctttttttgacacatggtctttctctatcacccaggcttgagtgcagtggcacaatcttggctcactgcagcctcgacctcccgggttcatgtagtcttcccacatcagcctcacaagtaagcttggggtacaggtgcccaccaccaggcctagctaatttttgtatttttagtcgagacagggtttcgccatgttgtccaggctggcctcaaactcctgacctcaggtgatacacccacctcggcctcccaaagtgcttggattacaggcataagccaccgcgaccggccatatgctgtttcttaatctggtgctggctacatgggtgtgttcacgatgtgataattcatctgtgctactcctggataccttcattacttcctgtaatgaagctttgaacacactttgaggggaaaataataaccttatgtcttaacacttccttcttcctggaaggccctatccaccctggcaaggctcaccggccttggcatgctccctcygagcctcgttcagcctcctctctgtgtctgagagttgctcccgcagccgagtttccacttcagccaccttttcttgcagggctggggtgaaagtgcagacggggcatatcagcaggagctttgattcgcagttcccaccccaccctccaagggaagcacccatttccctctcgacaccttgcccgtagagttcctgctgctgggtcagctcctgccgcagactggcagcctcctctgtgctctcctgctggcmctggcgtgctacctccagctgcagccccaagctagccagggactcctgggtctgctgcagctcctgctccagctgctgggccaccytgctcagctgctgccgctctgcctcccctaaaaggagggggtgctgggtcaggcctctcccagcaccctagacactgggtttttcctcatcctctccaccctctggcaaccaggtgtaccttgctcccgagcccggcccacctcctgctggatgaggcgggcactcagctgcagttctgcatccaggcggttccgttcttcccgcarctgctgcaactcaaggctcacrtctgtgaccggtggtggtaggggacagctgagacggggaagagaaagagtcaggagaaatcacccagctgcctgatcccaaagcccccatcccacctcagtcctcatggttttgggggtcccagcagccaatgccctaaagccccatccacctcaaagtgcccaaacttcacctctcctggcgcagctgagcaagggcaagctttcgagcaatcaggcctgggagggaaaaagcagggagaaaaagagatgaagtttgcatgggagaaagtggggacagggagtaagggaaaaagagatgcaaggactggtgaaaggaggaaggtgaatggatgtgggatcagagagagctgggtcaggaagaagaaagtccgagctggtggggtgggggcaggacgtggctcgcagttgtcctacgcaccccgaatggtgtggaccttgcggacagcatagctgagtcggttgttgaggctgggaagctgggcggcagccccttccaccttagccatggtggtctcgagccagatctgagagctggagagggcacaagtcactgatcctccatgcctcccctcattcccaaaggacttgctgtgccttgtatagacaactccctctaatcctgtcccattatacaagtacagaacgcacagcttccgtcaattatctaaaggacccttgccccaagaatgcattaaatgactatctttttaagcaacctgttaagcttatttctcacaactgtgttttgctcactatcgtgtatcaaagagtaaagttatcctctctggtcaggggcagtggctcctgcctgtaatccc

SEQ ID NO: 10595 - DNA, 13289 bp, Homo sapiens
  misc_feature (1)...(13289): n = A,T,C or G, or insertion/deletion polymorphism (see Tables 1-2)
ggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgatagggtgatgggcgggcggcggggcggtcccggttgcctcgcgggccgcggcgcaagtgcgggcgttgaccccggccgcgggcgccccggccggggttactgccggtcatcgcagcgcatccccggttttcctcgcgggtgcggcggggaacccagacccgagacggacgtccacccacccgacggcccctccttagcagcttcccggggacccggacgaggcgcagggccgaacgggcgagcgcactccaggccgctggagctcggcggaggggaggggcgcggccacgtggcgagcggagtcggccgggacacccacctggtgtggtgcggacaaagggagccgctgccccacttcccagggcggaggctgcgagttttccaggcgcgcacccacgggcgggggctcagcccggccctcgcgcgctccctccctcccgagtgattcctcgaatcgtggccccttgggcggcctgagccctgaagcgcggcctcccttttctgaccgcttcgcgcttgcggggccaggcaccccatggggggcaagcgggccttgtgaggccacaggtgtctctggctgcgtgtcctactttgagggctcagcaagcccgggccgctgaaggggaaccggagactggggcccccggcccctctgcaggtgtcccgcttccttcctctcctgagagcaggcctgagggtcaggcggccactccgcgtcttttcccttctggggctgtggttgacgcacggtgggaccgagggtcaaggaaggacaagggaagacagggccggggctggccccgcactgctgtccccactgcgggggttcttctgattcagggtgaggccctgtgtcagcctcaggcgtgcgggcacgcagctccggctctccatgctccaaacctcccaggtggccctggctgccagtgctggtgatcagcggccagcggggccctgctctctgcagcctgtcgagggctgggccagctacaggggagccctggctggctcccaaggaggttggagactcgtccagcaccctgagggcttccacagaaagtgagcggcagcggccgggcttggtggctcacgcctgtaatcccagcactttgggaggccaaggcgggcaaatcacgaggtcaagagttgtagacaagcctgggaaacagggaaactccgtctctactaaaaatacaaacattagccgggtgtggtggcgcgtgcctctagtcccagctactcgggaggctgaggctggagaatagcttgaacccaggaggcagaggttgcagtgagccgagattgcaccactgcattccagcctgggcgacagagcaagactctgtctcaaaaaaagaaacaaacaaaaaaacctcacagggccgtgactcgattccaggggacatgtgtgggagaccacagagcactgagagcctccagcccatccccaactccgtctggattcccatggagcaagtgacggaggctaacctcaaacgcccctgccctggggccacagcctttgtctgtgtggtgtggtctctgcttgtcacggttatccggcccgcacacctgtgagctaggccagccgatggcactgtctatattttacactgggggtgcaaaccaaagctgcaaaggtcccacgatttgccaaggtggcacggcaggttagggctgggagcagcgttctcccatcgtgttcccagagaagctgtctgcccagttcagaaaggtggcccgagggtatatggcaaggcccgtcaattcacccagctgggtaccggctgcctccacccctgcactctgctgtgggcagagtgtgaccaggcctggggggtgcgggggacagagactgggctcctgaggagtgggggtgggatatgaaccccccccagtcaccatcctgccggtcgcagagcactgcgtccgtgtgatgaacccccaccccagtcaccgtcctgtcggttgcagagcactgcgtccgtgtgatgaaccacccccagtcaccctcctgccggtcgcagagcattgtgttcktgtggaggacacgcgaggactcttggaagtgctttttggcggggtagtgcagtgtgttccgrgcggacgggcgtcagtttacgtgtgcgtttctcatccttgcagatacctggccccgggcactcaggtggcagggacattttgctgttatccttcgtgggggtggacgtggaaggcccagcagtgaccgctgtccccggttggcccccaccctgycagcacctgacatgcacaycccaacctgcatgaggcccaggtgcccacctggcttccaggggtcaccttggcccggttcactgggatccaaggctctcactccttctgggagggcccctcccatggtactctcaggagacgcctgctttgtgggtgggctttctgatctgccccctacctgctaccaggctctgaggaaggccacactgtccccaacaccactggtgtgcagatggctgtgggtggtgacacgggcaggccaggctctggcacaggcacttgatactgcatttcccaagtaggacagataaacaacgctamggccaagcagacgccccagggaggaacctggttttaatgggccctgtgctcagggaggccttcagtcagcagggtcgcctcagcagcatttgggagcctgccctgcagctccctgcctccaccctgcacgctgtgcccacacccccccacaacaygtaggtgaaagcacaggcaccatgcggaggccccgagcaccccttagtggggcggggtggggggaggaagtcagtccataatgttgtagttacggatcttggggggccyctggcagcctttagcttttgcaggatgagaccgggaggctcctgtggtcttggcctttgcctgggctgctgtcttcatccctggggtggcaatrcctgcctgcatcttgacgggcctcctgtcggctgctggaggagctgggagctctgtcaggtaaagagraaaaaacagcatgcatcaggatggcagggggagcaggaggctgtgctcacaggcactgcacaggtgcagcacttccgtgttcccggccagcgggggccctgtgacccttggcctggctttcctccaggagtctgtgaaggccaaaggatcctggagtgaccagagagctgtggcctcgccttgctcagtgggtcctgcttggcagggactgggcctgcccctccactgggcacctggacatgtggctctgaaaatggtcctgttgtgaccatttcgtaatgggtcccaggagggggcaggggtgctgtgtggtaatgggtcccaggagggggcaggggtgctggggtaaatggttgactcaaagctcctccccccaggctgccccgggtgtccctaccatctgagacacattgcctgcccccgcctccccgatgggccagcagtgccaggcttttgaggccaaaggaaaggccgtgctggtgggcaccacgtggccaggcacaggccaagggcccaggagtgcgctacacacagaggctggggcctaaatgccagatagcccttcctaaacatcggctaaaaccatcttcgcagaggggtgttgtaggtgatcttctttatctggccagtttttctctatttttcattttttcaattaagaatgtgggggttttttttggtaaaacaacagcaaaatgttactaaaaatccatgcaagggctgggcttggtggctcacgtctgtaatcccagcactttgggaggccgaggtgggtggatcacctcatgtcaggagttcaagactagcctggccaacaatggtgaaacgccgtctctactaaaaatacaaaaaattagccgggcacggtggcgggcacctgtaatcccagctacttaggaggctgaggcagcggagtcgcttgaacccgggaggcagaggttgcagtgagccgagattgcgccactgcactccagcctgggcggacaagggcaaactctatctcaaaaaaaaaaaaacaaaaaaaaccccacagtaagatgtgagctcagcgtccactgcgtggccacaccgtggctggggtgaggtctagaggactccagcacgtggctgaatgtggcccagtgggcagtctggacaggctgacccaggcaggtcagcgggcggccaacgcctcctgctggagcccagcctgtgtggtctgcgtgcagcctgggtgactgggaagcgtctgtgctttggggacaccggcaatgacgcactctcagctgggctgcgcagtgcccatgggggcagccacacactcccagccnnnnnnnnnnnnnnnnnnnnnnnnnnnnnnnnnnnnnnnnnnnnnnnnnnnnnnnntgggcccctcttcccatctcagcttcttccactccgatccactcttggggtctcaagacacccggaaccagtcttccttttcctgcagccccgttggggtcacacagtcacacagtccctggccccctgctggggtcctggggggccctggacgctgcctgctccctttgtttccaacccccagaggaattcctcctcttcacacaaaggctaccaccctttatctctcaacaataagcctgcctgacctcctggtcccggccaacgcccccatccccactccctccccccaccccccacactggctggcagagggtggggtatcccgtggaaagggcttcctgcggggaagctggtcctctgaccaggccctagtgctccactgtgaccctgaggcatctcctcaaacccagaggccttggttgtccctctgtaatgctcagggattctgggggctttgcccggcttgatcctcctgagacaaagcctgcggggattttcagaaaaagtgagcggagggaggggggtgaagggcctgcccctttgcctgggaggcctgagctggccctgctgggaggaccctggctgtatcccggggcgaagcagggaggtgtgagtgggtcacagtccccggggcagggaggggcagggagggtgagctggccccctctccagggcaggccggcccctagctcagaatatccactttacaggctctggtttcttcactggtccttttcctgcggagccctcctcagtgatggtggcagggaactggccatgagcccaggaccccagggcagcggacagccccagcccagccagtcctaggtcagaggcacggagctggatgtgtcaaggcggctgccccaggcgtgactccctgtgaccccggattcttctacctgatgctaatctgaggtcaacccagtaactggtgtgtaaaaacgctcttggcctccaccactctctgccccgccttctcgcctgacctgttttgccgagcctggccgggatttctctttctgcgttgggctgactgggccgcagggaaaccatgtggacacacagtttgccgggcacagcgtgaggaacgcgcctcttgggtcctgcacccctcccccacgggctgcttgtgctctggccccgaactgagcttctggaaagttcctgaaacatccaaggccttgcagtgattaaccaggggagggggactggggcctgcttgcccctcccaggcttaacccctcccaggtcctggtgtgtgctgaggcagggccacccaggctgggctccgtcccctcaggcggctgcaccatacttggagggttttttaaatttttatttttatttttgagacggagtctcactctgtcgcccaggctggagtgcagtggcgtgatctcagctcactgcaagctccgcctcccgggttcacgccattctcctgcctcagcctcccgagtagatgggactacaggcgcccgccaccacgccccgctaagttttttgtatttttaatagagacggggtttcaccatgttaaccaggatggtctcgatctcctgacctcgtgatccacccacctcggcctcccaaagtgctgggattacaggtgtgggccaccaagcccggcttggaggtttgaagctggtggaatctcagggaggacatagcctgtcctattgcagggaaggtgcggccctcactcccgtctcagcctgggggcatgagaactctgagcacaaagaggacggagctggtccccagctttctggccaccctgtgagtttcttctcctgcacctgagcctcagctcagctcttgaccaagttggcctctggtggctcattctccaggctgctccgggctctctgggtgcccctgggcacacctacgtggcttcctagggctttgggaagggccagacggtgagcccacgccttccctggttctccagagcctgccttggggctggggagggcctggccctgatggcagctcaggcctcaagtccattctgtggcacagaggcccttccgtctccctgtggcctccgctgctctgtgtggttcacccctgctgtgtcaagggcccttgttctgctgaaccccctctggctgccacaggggtcctcacgcacccaagatcaacccttctcaaatgcatctagttatttccaagtctcttgggaacaaggcttttcccaccactgtcagcacggcacccaggcctttagtgcagacggtgacagtgaatgtgacttgactccccccaccccgaatctccagaagctgcgtgcacctttccagggtccccacgcctgggaggctcacaggccacgcccacccgtgtctccccagcctgcgtcaaccctcacctgctaaagtctcctaatggacacccccacccctgagctcctggagctcagccctggggggtcaccgtagccccggggctgcctttgtgggactgagtgtgacaacaggagagcaatggggtacagggggagggaggcccacgtgatctggttcccacggtccctccacagggggacactccgggcctgctatgtccagctgccttccccacctcactggcacatggagcctggagcccccactgggcagatgcacaagaggggagggtactggacattgcatgctccagggctctgggcagtcctgccacccatcactcagcctggtgaggcagggccagcaggaaaccccagatccttcaggccccgcctgctggcctttggagcagaggagaggtgggccctcgggggcctgggcgccgaccacaggctgaccccttgtttcatgccagcacctcctctgggcgcctgtggctactcccccaacggcactggcaggtcccctgctgctgctgagcctgcccaggcctgtctgctacagcctgtcagtgttgcccaatgtgggccccatcccagcccttgagaggagtcacctagtagtggggtgcaagctggagccccaaggaagggaattcaagggaaacacatcgtgggcataaggctttgagagacgtgggtctgtccctaccggaggctgcatcacggaaggcgggcacacaggcctcacttgggcgagaagagacccagagacgcatggccttcctcctgggccggctcccgaccagagcccatctgagctcagcccacaggaaggggaggtgccaagaaccccaagcacaggtggctgcaggctggtgggtgccgaggaggccactaggaggctgagacggtgagagccagggccaggcagtggcctgagagctggacagcctctgggtatctccacaccccacccttctcctgcctttcagaagagtaaacgcaggagaacgccctgaggccccggaaggaaagtgacaggcagcggctgagctggggcgacaggaagtggcagctgtctccgctgtttcggaggcatgggaactgtttcctggtcctaaagtgaggaatgctggcctcatgccccttgggccaggactctgcactgagtgctgagtgcctgggctggtgtttagacgactcgtggtctctgttggcactgtctggggacagcaaaaagcagcaggggccagtgtgcaggggagattctgggtaaaattcatgaaaagggaactttcaaaaggggcccatggggccttcccaggtctgccaggccagcttacagctccaggtgggcaccctagcatctcagggccatagaccagcaggtcaccgccatgtccccggggaacagcactgcctgccactcactttgcctgagacccgtgtctcagggctgctccctgcatgtcttggcaggagggcggacagctgggaaggaggccacacgctcctccagggagcctggctctgcaggagctacgccagccacacacttatcagctgcccgacctgctcaggacactgagggccacatgcctggccaaaggcctctccccactccctcttctcccctggagaccaggcccctggagttgctctccagagatctgggcaatgaccctctggatcccagggtttttggttcccctgggaaaagaggcaaaggcccacacacctgcagcaggttgggggtggggggatgcatggcacagtggcttggcacccgggtggggcacagatgccgcgggagtggggagtggggagtggctgcctcgaaccctgctgtgtggcttgtcaccctccatggcgtctctgcgcctccgtttgactccagctgcacggcacacggggcgaggttagcatcaggggccaaagcggacccccgccagaaaggaggaagaggcccccaggtaggtgcgtgcttctggacctggcgctcggcacactgtgaggatgggcggatggagttggtctgcaggttccagaatgaatggggccctgttgtgacaggagaaggagggcagcctgggttgaagaaacaccccctgctgtccaacagctgcactgcccgctcccctggcaacacctgccacgtggactggagaagacacattagcccttgggctggaagtcgtggaccggcgtccacctgagatgggactctgggagggaacagccgccggccctcctgcctcagctgctctcagcatcctacagtg

SEQ ID NO: 10596 - DNA, 44679 bp, Homo sapiens
  misc_feature (1)...(44679): n = A,T,C or G, or insertion/deletion polymorphism (see Tables 1-2)
ccgtctctactaagaatacaaaaaaattagctgggcgtggtggcgggcatctgtagtcccagctactcgggaggctgatggaggagaatggcgtgaactggggaggcggagcttgcagtgagccgagattgcgctgctgcactccagcctggacaacagagcgtgactctgtctcaaaaaaaacaaacaaaaaaaacaaggtatcacttacaaatgttctgttttgattcacaaaagcagagactacaaaatttgtgtggactgtacatagcttcagaggaaagaggaagagttctctatatatccagaaagtagaacattaaaaagacatcagccgtattcttaacaaaagctgtcatcctccaccatcggttcatcccctcctgtgaggtccgttcttgttccactccatcttggttcttggtctcaacaatccatctgcttctcgactagagactgagtcctgggatgggctcagtgtcatctaaatgccgccatcagaagcctgtgcccatggtgcctgcccagtccttttcccaggctctgagacagtccctgttcaagatgaagaagcactctgagctttctggggagcatcagagtaacacaaaaatcgtggatggggctgggcgtggtggcttacgcctgtaatcccagcactttgggagaatgagggaggtggatcacctgaggtcaggaattccagatcagcctggtcaacatggcaaagcaccatctctactaaaaacacaaaaattagctgggtgtggtggtgggcacctgtaatcccagctactcgaaaggctgaggcacgagaattgcttgaacccaggaggcggaggttgcagtgagccgagatcccaccactgcactccagcctgggtcaggagtcttctttgagacttcgtctcaaaaaataaaaataaaaaaactgtggatgacaaaagactgcacatggccatggtgaatttaccactgccacttttcaaagtgaaaggtctgttcatagcaagaataatgcaactgagaaggaacatttgcttgtcctgtagacatctggaaacagagtccaaaaaagagttctagacaaagttaatccaagacgttgacgctgttttcaaagatgccagaaacagaatatctgatttctaaaactggatgagcatgatttttacagaggaaattatttacagttaagtgtgaagctgactattccatgactataccaagaatatccagtggagaggcaaaaagtgtggggcaggcggtggccgtctgcctagtaacacagccccagagtgagtgacggtcgccctgctacaaactctgggcatcagagatgcacagctcacgttaaagtaaggtgacacctaagttaacgtaacggcagtgacggggtttatgcctgctagctctggactgctgccggctgacagcatctggcaaatggcttcgggactctaatgaagagaagcgccgtgggcacccgggacgtctccgtgcagcacagcacacagttcctcagtgcctcagacgaacgagttacctgacacacacagcccggggcaggccacgcgtctcttccgacccggggcaggccacgcgtctcttccgacccggggcaggccacgcgtctcttccgacccggggcaggccatgcgtctcttccgactcggcagtcttcccgtggcactcatcaatcctaacacatcaaagaaacctaatcatttccttaacatcttttttctttttacttttttttttcgatagagacctctgtcatgcaggctggagggcagtggtgtgatcacagctcactgcagccttgacctccttggctcaagagatcctcccgtctcagccaggtgcggtggctcatgcctgtaatcccagcactttgggaggctgaggcaggtagatcacgaggtcaggagatcgagaccatcctggctaacagggtgaaaccctgtctctactaaaaatacaaaaaattagccgggcgtggtggtgggcacctgtagtcccagctactcgggaggctgaggcaggagagtggcgtgaacccgggaggcggagcttgcagtgagccgagattgtaccactgnnnnnnnnnnnnnnnnnnnnnnnnnnnnnnnnnnnnnnnnnnnnnnnnnnnnnnnnnnnnnnnnnnnnnnnnnnnnnnncctcagcctcccaagtagctgggaccacaagcgcatgccaccacaccccaccttgtacctaattatttcaaatacctctctttttataagaaaaaaattttgtgattttccagggaacttctaggacatctcatagatcattttaaatataaaaggtctcctggggctgggcacagtggctcacacctgtaatcccagcactttgggaggccgaggcaggtggatcacgaggtcaagagatcaagaccatcctggccaacaaggtgaaaccccgcgtctactaaaaatacaaaaattagccaggcatggtggcgggtgcctgtaatcccagctacccgggaggctgaggaaggagaaccgcttgaaccaagaagtcagaggttgcagtgagccgagattgcgccactgcactccagcctggcgacacagcgagactccatctcaaaaaaaaaaaaaagaaaagtctcctgaaagctttattttatttgacatttagaattcaattttgagaaggaaaaaaaaatgtcaggagatttgaacattaagactcatgggtacctgagaaataatatttagctacccacgtgaaagtgacaaaaagcttaaacataggagagaacagttatagagaaacttagctctttcataagcatgggaagctttgttttctgaaaccatcaagacataataagtcaacaaaagcacggaaaattaccctggtaagacagcacctttgctgtctgaacagattacatagaaagtaaagaataacccttcatagtttaggggaagtcaataaatagtaaacgaaggaaggccgagtgcagtggctcacgccggtaatcccagcacttcgggaggccgaggtgggcggatcataggaggcttgcaggagttcaagaccagcctggccaacacggtgaaaccccttgtctactaaaaatacaaaaattagccgggcatggtggcaggtgcctgtaatccaagctactgaagaggctgaggcgggagaattgcttgaacctgggaagtggaggttgcagtgagccaacatcacaccactgcactccagcctggatgacagagcaagactctgtctcaaaaaaaaaaaaaaaaaaagtagtacaccaaggaaaaaaacccatcaaaattgggctaactttgctaagattttaacacatttcatggctttttaaaaaactagctttctttcaaccaagtaaggattgagaaaacaagacctagctttcagctgggtgcagtggctcatgcctctaatcccagccctttgggaagccaagggaggaggatcacttgaggctaggagtttgagactaacctgggcagaatagtgacaccctgtctctactaaaaaacaaaaaacttggctgggtgtggtcccagctacttgggaggctgaggtgggaggatcgcttgagcccaggaggtggaggctgcagtgagccgcgattgcaccactgcactccagcctgggtgacagagcaagactctgtctcaaaaaaactagttttctttttttttttttttttttggtactatacatataaaatgtactgttgaaagctcatgaagtatacaaagtatacagttcagtgcattaagcacgtcaagaatgttgtgcgagcatcatcatttgttccagaattcctttcacttcagaggaaaccccacactcattcgcagttgcttcctgtcccccgcccagcacccacattctgcctccatgcctttgcctgttctggacgtttcacttcagcaggatcccacaggatgtgtccctttgtgcctggcttctttccctctgtgtcctgtttgagggtccctcgtgctggggcgtctgcacttaattcctttccatgggaagagctctttgctgggggacaggccactgtaggcatttgtccatcagtttgatggacatttggatggtttccgcctttgggctattgtgaataatattgctgtgaacattcagttctcttggatgcctccctagaagtggccttgctgggtcatgtgggaattctgtgtctaacctggtaaggagccaccaaaccgcctcccatgcccaccagctgcgcacgaaggttctgatttctccacatctgcaccagcacttgctattttctgtcggggttttttttaattaagaatacttttattgcatatctttaaaaactttattttttttatatttaaaaaaatttcttttaaaaatagaggtgggatctcactgtgttgcccacgccagtatccaacacctgacatcaaggatccccccacccagcctcccagtgtgctggggttacaggtgtgagccaccgcacccggctgttttctatcctgttgatcccagccaacctagtgggtgtgaggcgggatcccatagtgggcttgattttacattctcctggtgaccaatggtgttgagtgtcttcaggaggtttttgcccacacgtgcatcttctgacttcatggcttttaaattcaggtgtttataaaccaagggaaacacgttcatttccaagtgtcatctttgggttcttttattgcctagaagaaactgatgctttacttgagggcccatctcgggatgtccacagggcagagctaatcctgcgatgctcctcagatgttgatcataagcaatatgttcatcatggctaacttcaagttaattgataaaaaagctttaaaatttttctgttttgaccaggcacatggctcacacctgtattcccagcactttgggaggccaaggcgggcagatcacctgaggtcgggaattcgagaccagcctgaccaacatggagaaaccccgtctctactaaaaatacaaaattagccgggcgtggtggcgcatgcctgtaatcccagctacttgggaggctgaggcaggagaattgcttgaacccaggaggtggatgttctgggggtgtcgagatcgcgccactgcactccagcctgggggacaagagcgaaactccatctcaaaaaaaaaaatgtctgtttcaatttccaatatgtgaaatgtcaacagttataaacaccctccaaaaaccttgttggaatcctcagtgagtttaacgaaactgatttgtaatcctgggaaatgttatttcagtaattatgtcttctgatgtgtctgcttagagaaggagcagatctttacataacataacatgaatggaattgatgaaaggatctcgtttgatgtggggtcatttctaagtaagctagcatgccgaagctttgagtagaaccatcatttttaagttgttatacttaagcttttgcttcttttgtttgtttgtttgcttgctttttgagatggagttacccaggatggagtgcagtggcatgatctccgctcgctgcaacctctgcctcccgggttcaagcaattcttctgcctcagcctcccgagtagctgggattacaggtgcccaccaccacgcccagctaatttttgtatttttaatagagacggagtttcaccatgttggccaggctgatctcgaactcctggcctcaagtgagcaacctgcctcagcctcccaaagtgctgggattacagacgtgagcctccgcacctggcaagtttttgcttcttatttgtgcctgccacagaaagggcgtctgggtgcttctgttagcgaatgtgcttgctgcccccgctgtgaggacagcaagggctgtgtgtggcaggggcgtggcattgtgtgtgcaagagctctaccgaaatgctgtgtgtcacagttcactgttgtccggccctccccaagttctcgatgtaatggaagttactttggtttcgaaaaggaacatgctgttctttctgagtgtttgcattcagcacaagaggaatccagaagtgatgcacagagaacaaactctgtccccatcccattcccagggtggctgttgcaccacgccctccctcctgcccctgaggcccggaagccaggcgaggagcccaggaggcctttggatcgcagcccacctttgggacaggtgcagccccattttacatctcaggtaacacyccttcatctaagacatgcatttttaaaaatatttccctaattgtgtcgttttcattacagaaacttcagattacaataaacacaatataaaaagcctccaattttcaggatccagatatagttattagtaacatttcaatgtgttttctgctgggtttttgttttgttttggtttggttttggttctcatttgtttgtttgtttgttttttgagacggtcttgctctrttgcccaggcttgagtgcagtggtgcaatctcggctcactacaacctccccctcccggttcaagcaattctcctgagtcagccttccgagttgctgggattacaggcatgcaccaacacgcctgactaatttttgtatttttagtagagatggggttttaccatattggccaggctggtttcaaactcctgacctcaggtgatccacccgcctctgcctcccaaagtgctgggattacaggcatgaaccaccgcgcccagcccccatttttttttattttttcattacaaattgtatcatgtatatgttttactatagctttaaatatctgggtactatttttttaatctggtatgataagtgaaaaaaaaaccaaaaacttctatttttttttttttttttttttttttgagacagggcctggctctgtcacccagaacccaaaaacttcttttttttttgtcctttgagacagggcctggctctgtcacccaggctggagtgcagtggtgcaatcacagctcactgcagcctcggcttcctaggctcaagtgatcctcccacctcagccttccaagtagctgggaccacaggtgtgtaccaccatgcctaatggctaatttttatattttttgtttaaatggagttttgccatgttgcccaggctggtcttgaactcctgggctcaagcgatctgcccaccatggcctctcaaagtactgggattatgggcatgagtcagtgcacccagccacaacttgtatctttaaaaagatagcaagatggccaggtgcggtggctcacgcctataatcccagcactttgggaggccgaggcgggtggatcatgaggtcaaaagtttgagaccagcctgaccaacatggtgaaaccccgtctctactaaaaatacaaaaattagccgggcatggtggcactcgcctgtaatcccagctgctggggaggctgaggcaggagaattgcttgaacccaggaggcagaggctgcagtgagccgagatggcaccactacactccagcctgggcgacagagcaagactcccgtctcaaaaaaaaaaaaaaaaagcaaggytgtctctacagaaagataaaaataaaaataaattacccatttgtggtagtccacaccttgtaatcccagactcaggaggttgaggtgagaggactgcttgagcccaggagttcaagacccgccagagcaacacagcgagaccccgtctctaccaaaaaacaaagaaggaaggaaatttcttatatccttagtggcattaaatgctttaatctatttattggccatttatagttcttcttctgtgggtgatttatgtgtgttccttgctaattttccgtaacctcagagccagtcccgaattcccactgcatctggctcttgtgttttcatcctttaacccagaacactccctccgcctttccgtgtctttttgaaaagtcaggcagtgttttgtagactgtggatctgtctcatgttgcagccttgagaagttcagcttctgcattgattttggggttttctacacagttccaatgagttgtctgttcctgaaatggtactataccgctttaaatactgtggctttgtgacctattttaatatctgttagagcaagcttgaccttatttctgttcctttacaaaattttcttggctatcctttcttatttattcttttttttttttttttgagacagagtcttgctctgtcacccaaggctggagtgcagtggcgtaatttgggctcactgcaacctccgcctcccgagttcacgccattctcctgcctcagcctcccaagtagctaggattacaggcgcccgccagcatgcctggccttattttttgtattttttgtagagatagggtttcgccatgttgcccaggctggccttggattcctgaactcaagtgatcctcctgcctcagcctcccaaagtgctgggattacaggcataagaaataactcttaaaactgagaaaagaaaactctatggagccaagactgctttgtgtttccttttttatttctttttaaaatgtatttatttatatttgagacagggtcttgctctgtcgcccaggctggagtgcagtggcacagtctcggcttattgcaacgtctgtctcccaggctcaagtgatctttccacctcagcctcccaagtagctgggactacaggcaygcaccaccacgcctggctaatttttgtttgtttgtttgttttttaatagagacagggtttcaccgtgtcactcaggctggtctcaaactcctggactgaagcaatttgcccacctctgcctcccaaatgctgggattacaggcgtgagccaccaggccyggcatgtatttattttatttatttattcattatgagatggagtctcactttgtcgcccaggctagactgcagtggtgtggtcttgactcactgcaacctctgcctcccaggttcaagcgattctcctgcctcagccttctgagcagctgggattacaggcacacaccaccagacacagttaatttttgtatttttgatagagacgaggttttgccatgttgcccaggctggtctcgaactcctgacctcaagtaatccacctgtctcagcctcccaaagtgctgggattacaggtgtgagctaacacacctggcctacatttattttcttttaaaaaaaatgggccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagtgagctgagatagtgccattgtgctccagcctgggtgacagagtgagactccgtcccccacccccacccccccaaaaaaaaggagcttggcgtggtggctcacaccagtgatcccagccactttgggaggctgaggcgggcagatcatctgaggtcaggagttcgagaccagcctggccaacatgaygaaaccccatctctactaaaaatacaaaaattagccagttgtggtggcaggcacctataatcccagctactcgggaggctgaggcaggagaatcgcttgaacccaggaggtggaggttgcagtgagccaagattgtaccactgcactccagcctaggtgataaagcaagactccatctcaaaaaaaaaaaaaaaaaaaaaagttttgtctgggtgtggtggctcacrcctgtaatcccagcactttttggggccaaggcgagcagattacttgaggtcaggagttcgagaccagcctggccaatttggcaaaactccatctctactgaaaaatacaaaacttagtcgggcatgggggtgggcatctgtaatcccagctactcggaaggctgaggcaggagaatcacttgaacccaggaggcggaggttgcagtgagctgagatcacgccactgcactccagcctgggcgacagagcaagactstgtctcaaaaaaaaatgttttgagacagggtctctgctccccaggctggagtgccatgatgacatcacagctcactgcagcctggtcctcccaggctcacattatcttcccacctcagcctccgtagtagctgagaccacaggtgtgcgccatcacacctgtctaatttttaawttttttttgtacagatagggggtctcaatatgttacccaggctgatcttaaactcctggagtcaagggattcttccacctyggcctcccaaagtgctaggrttacaggtgtgagctaccgcgcccagcctaattttttatttatttattttttgagacagagtttcgctctgttgcccaggctggagtacagtggtgtgatccaggctcactggaacctagaactctgggctccagtgatcctcctgcctcagcctcccaaggggttcctctktatttttaatagtaaatggtgccatatgagaagaaataagatacaaatacagaaaagaactcctacagatcaataagraaaagacaaatcaccctgtgacaaacaggcaaagggtctgatcagaaggtactggggacgaagcccggggggcagtgagcatcaggctgtgcccgtgatcactggcatcagggaccttacatcagacctcatgcatgtgcattcctcgggtgaacaggcaaacgttggtaaacatgggccaagtacactctgcatccactgttgtgggcacactcatggtgtgcctgggaargggcagggctgggctcgttccacagcctccttgcaggccatctattgtccatggctctgtacaggtcccactgctttgaatttccctttctgttttcctccatgtttcctttccatgttcttagggtttgctccctagtgcccccttttggcttcctttccacagtcttccctccagaaggggggagacatcaggcatggggcgggcagaggcaccagtgatgggttcaagaagcaggatcaggtcaggcgtggtggctyacacctgtgatcccagcactttgggaggccaaggcaggcggatcacctgaggtcaggtgttcaagaccagcctggctaatatggtgaaaccctgtctctactaaaaatataaaaactagccgggcatggtggtgggtgcctgtcatcccagctacttgggaggctgagacaggagaatcacttgaacccaggaggcggaggttgcagtgagccragatcacgccactgtactccagcctgggagacagagcaagactccrtctcaaaaaaaamaaaaacaaaaaagcaggatcggccaggtggtgtcactgggggccactcgtgtccatcttgggccggggggctctcaccccaggcaggccatgcataggctgccctggccttgcagagaaggctcctgggaatgaatgactggggaagcctgctccattcctcctgtctgggaaacaggtcccttcagtccgggctgtcaccaaatgrtgtgagtctttaataccagaaatgtgggaaggcatttcttcccaatcttgtgggaaaactcactgacatgcaccrtcagtacatgtgaataccagagtcctctcatttaaatccccacggcaggacgccaagagtgccgaggatgaggctccttccagacacttgggaaagcaccagccccgctcagcacaggtgggcagcrgacttracrccctgcaaggcccgaaggtgagagtggcggcgcccgagcaagtgcagctgtgtggggtgtggccagcagggaagccggggcctgggtgctctgggcctctcggaggggccttcgctctgcatgcctgcctttgtgccgtcatcagggactgctcacaatggcagggtgagctgcagagcgtttgccgggtggtcccacaagggtggtamgagtgttaggagggccccrggacccctaaagcacatggggcccacgctggcctttcctttctgtgcccctcagggtatctgccctgcatttcagctcattccccatcgaaacgaaacagcctctgccctagacatgttttgtcatttaagtgttgagacgagcactgagattcaggccctgcccacactcagcgttcccagcgctgagactcgctccccggatgcatccctgtctgcagctgcctctcctgggtgatcctrggagcatctgcctgggcctttaagccaggcccactgtcgccttactgctccgaggggagtggttggggggagtcctgtggcttcctctgggttggagagggtggctttcaagacgatgatgtcttttctagacacaacacagcatccacacggtgacctgtaaatcacctcggcagaaagaagacaggtccccaaagccaccccaggctcccmagcaccctgaggagcatggtcgccaatcccacagctcctcctcctttgccagtggcaccctccaggacaygtggaggttgctagacctgggatccagcccttctggtgtcacctcccagggtgactcaactccaggtaggagactgccctccccaggagctgcccacagctggcagctggcgagggccaccctctccgaggggcatgtggagagtcagcaccctgcgtgcctcctgcaccctgaaatccctgcactttggttgagtaatgcatggagtctctttacctctcatttggcacctgagtgtttcccgggttatggtgcaaagccctgaagggcagaaaccatgccatttcctagtgcagcaccgtacacccgggcgcacactgacttagaatgcagcaccgtacacccgggcgcaggctgacttagaatggagcactgtacacccgggcgcaggctgacttagaatggagcccaggtgagacgcgtgggcattggtgcactttagacggccctgctcctggggaagagccaggtcgaccccagcgatgctcccggggaagagccaggccgaccccagtgatgctcagcctcacgggccagacaagtgtcagccgcatcctcatcctcgtcctgctttgctgcgcggacgttgccgccctgagactcttctctgcacctaagtcataggcctggtaaactcagcaggtcacagtgccagctcctgctactggtctcaggaagttttcagaaaagtctgtttgaagggtgcaccttgtgaggactgcatgggtctgtgatgtagcgagaaggggggagggaaacagatgctgcttcgaggcagctggagttgcaggacgtgtgatgtggttggggcaggagcgtgcgtccttcctgtgtgcctgcatggagggcgtccccttcttaccttacagcttctgtcttccgtcatgagggtgtgcctcattcatttaatcattctctccttcatgcgcattttaggctatttccagtcctttaccgtcacagatactgttagaatagtaaccttacaggctgcagtgtgtgtgaaaacacacgtgtacgtgccccaggggcttgcatagtcaaggctgcccgcgtgccacgtgtggtggacagcatcgcctcagcctccgccgcccacccagaggctgctcccagcagcagtgtctgagagtcctgtagccacacggaacttttgccggtggcagcgggattggcatcagcgcctctgctgggaggtcgtgcrtcttcgtgtgtgtttaggagccacttcctttccctgttcttcagttacctgcccatttgtrtattagattgtggtctttcttattgatttgtagcagctcattatatgtgatagaaattaggccttttcggtgacaacaatttaaatgttttctcccagttcttcatgtttttaaatgtttattatggtgtttttttatgtycatattttttatttttatgtaatttaatgtccttgttttttatcttgtctgttttttttttttcctttgagatggagttttgctcttgttgctcgggctggagtgcaatggcgcratctcagctcactgcaagctcctcctcccrggttcaaatgattctcctgcctcagcctccccagtagctggagctacaggcacccgccaccactccaggctaattttgtatttttagtagagacggggtttcacaatgctgggctggctcgtctcgaactcctgacctcagttgatccgcccacctcggcctcccagagtgctgggattacaggggtgagccaccgtgcctggccagaaccacttcttattaacccccaaagtggcaacggctcccagttttccatcgctcacrcttcccrcrtattcggactcccacctttgtcatggtgctaaatgttccatgtgcttttggagctatatccggacggttcgttcggccactctcagtctgttcacaggcagttccattgggtcagaatcagtgtcacttcctggtccttttacatgtctggctgatgtaggatctcctctttatccttctctctcagggttttcttggttatttgcatgtatttgttttttcttttttctttctttttaaatttagtagagagaggactggaggcagtggctygtgcctataatctcagcactttgggaggctaaggcaggtggatcagttgaggtcaggagttcaagaccagcctggccaacatggtgaaaccccgtctctactaaaaatacaaaaattcactgggcctggtggcgcatgcctgtaatcccagctacttgggaggctgaggcatgagaatcacttgaacctgggaggtggaggttgyagggagctgagattgyaccactgcactccagtctgggtgacggaatgagactctgcctcaaaaaaaaaaaaaaaatttagtagagatggtgtctccctatgttgcccaggctgatctcaaattcctgggctcaagcgatcctcccgcttcagcctcccaaagtgctgagactgcaggcgtgagtcaccatgcccggccttttttgtatataatttttagacttggcttgtctgagtctggttcccccagcccctccccacaaacactattgtaagtgttcttaggattgacgcagcttcccttctgccttaggaaggaatggggttgtgtggcttccgttccccgtgtgctccagtgctggcatcacgaatgtggcgcgtttctctctgtcttccacgcagccgcgtcccactccgtcttcctgaccctcccacctgcactccrtggctctcctctgtgctcaggattcttaggggcaccgcctccttgcatttttaattcaccacaaaacattttgtccaaattttcatcaactcaatggaaagttcttctggagacgttcgtgttcattcgtttgcttgtttcctttctccttttctcttggagcactttcgtttcttggctcccccctcattttttttttctttttctctttttagagacagtgtcccattctgtcaccgaggctggagtgcagtgcggcaatctcagctcactgcagccttgacctcttgggctcaagtgattctcccacctcagcctcccaagtagctgggaccacagggacacgccaccacgctcagctaagattgttttagttttttgtaggkacaaggtgtcgctctgttgcccaggctggtctcgaactcctgggctcaagtgatcctcccaccttacgctctcaaagtgctgggattacgggcatgagccaccgtgcctggcctcatctttagaacaggtaaatttttacttgactagctatttgaaaaagtttgtatggaaaatgaagccagaaccatcttccagcccagcagagtcgtgtcgttgattttagctttaaatacaagtctccacctatcaggcttttaacagctgatacagcttctctcttccctttccccacagatactgcactttgcagatagggcctgttctgttcctggttcactctccctcctctcttccaggaacggaacaaggtcagggaagcacttgctgccagcccatgttcctactcctgaaacaaggaattaggtcctaccctcagggygtacccttgccttagagaaatgccctctgctctttctggggtctgtaacgaggcatctgtatgtctttgacacagcccttgccgagttcctgcagcctttggtagcccccgccaccaccaccaattctagctcttagttttaatgaaaatgaagtttgcatttttgcttttcattatctttttttttttttttttttttttgcttttggatgatttacaaggatagtggaggagtgctagcttcatgatgccttcttcaagtctgaaatctgtcttgttttctgaccaatgcagccaaagaaatgcatattcctccaagcgttgctttgctttaaccatgtctcataaatctcaacatcctcatgtttcccttgtctttcccttgtaggacttataactcaactcattttgctttaacttaaatggaatttttccttaagtttctagatttgtggaattttatttttttgtctgttactgatttctaatatttttacattctggtcagagaattaaattactatgatgttaactcttctgagagggaaatattagttcttaaactacaattatcaatctatctgtttttgtcaattgttgctttatgtgttttgaggttcgctgttaggtgcatacatgtttaggttttttgccttcttgatcttttcctccctttaccagtatgtaacatccctcataacccctcatgttgtatttcaccaaaaaacctattttgtctgacatgaaaattgctataggccgggcggtggctcactcctgtaattgcagcatttggggaggctaaagtgggaggatcgcttgaactcagaggttccacaccagcctggacaatgtagtgagacatcatctcaaaaaaaaaaaaaaaaaagggccgggcacactggttcatgcctgtaatcccagcactttgggagacagaggcaggaggatcacttgagcccaggagttctaggccgcagtgagctgtgattacacactgcactccagcctgggtgagagagcaagaccctgtctctacaaaaaaaaaaaaaaaaaaaaagttattaggagggaagggagtggttaaactgtgcagtggaacgctacaggtaggtccagttaggtcaggacagaaaagcagcccctgcttttttgcaaggtgaaggtcactggtggtcttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcatgtaaagcctgccggtaggcagtgggaaatgggatgactcaggagagaagtcctggaggaggcaggggaaggggctcggtgcccgtgtgcagggctggcctttaataggacagaggcagaggtgggcaccgaagccagaaggttgattgcagccagtgctgtgcacttgcccagcctgcaagctgacaagcaagcctggcgggagacaggaggctcctgggtcagagaccaagggctctgtccacatagcaggcagctgggcaggcagtggctgcaggtgcagtgggtatgcatctcagctgaggaacccaggcctggggaccgagtcctagagcgaccacaagcacctgccctccgagtcctagagcaaccacgagcacctgccctccgagtcctagagcgccacaagcacctgccctgggcctgagggagatgcttgctccgacttctgagctgcttgctggacagacgcccttgcaaagggtctgcagcagtggccagggcagcctccaccgtgcgggagtgcacaggccccagggaggctgtccctggtcccagcagctggcctggtggtgggaaacggttctggcagattcctttcatttcctcttacatgctcagcatccaggctgagagcccgaggccggccacaggctctgmaggaggaaggagcggtgtaggaggcttgagaaagtgggttgtaaaatggtgggttggcgcctcaggaagcagatccggsagagagtgaagagggccaccaagctctctgtgagaccagggagctggtgaccacaggagtcacctggggccraggccgtgctgcaggaaggagcgttcctgacacagcagcacacgtccaccgaggctgagagtgtgggtggcctgggagggaaggcgggctggtgtggatcagttaagatgcttttagctacaagtcacaggacaggatatgaaagtgacgtgaaccagagcttcccggcctttatctcctcgtggtaactgtggaaaatgacacgcctcactaaaataaggagagaactgaggggtccatatcctgagtgcccaaaatggtctcagcaggcggcatgcacggccccatggcaggacgcgctgactgaggcccaggagctcatcggagccctcagtcccaggtcaacgggcctcaggtggcccctctgggattctcttttctcctaatggctccgcaatggctgcagacactcccaccatcccctgagaaggccaaaaggtgaagggcctctctctcctgawtctttttcttttaatcagggagggagaagctgcccagagccctcagcagacctgctgtccatctcctggctgtgggggtcatgttgcctccctatgacccggctccaggcgcctgtcttaacagagtcttagaccctgagccctgtgagtgaggtcatgtcctcgagagcctgctgcctgcagctcagtagcactggggcctcttggcaggaaagctggggaagcactgggggcctcagcaggtggaggaggtggccagatgcaggccctgccatgtccctgcctccctaggctgagacagggtggctggtatttattttttctttattatttattttagaaacacggtctcactgtgttgcacagactgggctagaactcctggcctcaagcaatcctcctgtcccagcctcctgagtagctgggattacaggcgggagccaccatgcctggcaacggctggtatttcttagcatcrgtgttgcaattaaaaagcaagcaagaggccgggcgyggtagctcacccctgtaatcccagcactttgggaggccgaggtgggtggatcactaggtcaggagatcgagaccatcctggctaacacggtgaaaccctgtctctactaaaaatacaaaaaattagccgggcgtggtggcggacgcctgtagtccyagctacttgggaggctgaggcaggagagtgctgtgaacccgagaggcggagcttgcagtgagccgaggttgcaccactgcactccagcctgggcgacagagtgagactccatctcaaaaaaaaaagcaagcaagaaagatacgtttcagcataagtccatggggcttttgattcaccctgtgaaggatttaggaaaagactaaagtggttcatgcagttgagttgtttaatgatctgcgaagtatcttgatgctttccttgtgttttgaatatttgagcatgcttaactgaattatctgtgtgatatttttacttcatgtaagaatactttccttaaaaccttggaaactgcgttggtgaagtaaggggtgccacttaagggcaccgggtttctggttaagatgcgacactgcgccctccagtgcaccgacactaggacagagcgcagctcggcagtcgctygccagacaagcagtctgaaagctccattctagaaacggagaggaagtttcctcctcttttttaaacrtgttccatgcattgtgggtaacagagtatgcacactacacagtcatgattggagtttaaagtaataatgttgccaggcacagtgactcagcctgtaaacccagcactttgggaggctgaggtgggcggatcacttgagccyaggagttcaagaccagcctgggcaacatctctgcaaaaaaaaaataataataataataatgaaatgatactgaaatagttaacaatttagtggcatctaaattaatgacatgaacgactattgtaggatatggtgtttagtcacgacgtcacacagctgtgttgaacagccatactcctcttggacctgggataggccccgaaccaccctcctgctcatgtcctcagccctgctttgccaacctrtccagacccagcagtcaccccgtcccagggcacggccaacctctgaggctggaacagctggctggagtcggggctcccccatacaccctggatgcggctctttggaggacccacctccaagcctagcctcctctctcacctgcgtttttatgacagcctcagatagataggtctcccacacagactgctggggcccagcacgtccagcctcatctccctcccttcttcccccagctacctgcactccagctccagcctgtctgcaccctgtgggtgccccccaacccctgtgcacctgtgggtaccccacctgcagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccacccccacccccgcccccacctcccgcccgctcagtggagcctggtagataagaatgtagttgttctccaggagccaaggaaagaaagaaccattcagcaattggcagggtgggaacacagcttactctgatctccgcttcctctcacggggaccacacactaccaggcattccagggcgagggagggactccaaggcaaaccacgaaaatacgcagaagtagaatggagtatttacaaatggccggaagagggttaaccttagatacgggtgaagaaatcacagatttctaaggtagtgtttttacctgaaaaatcatcaaactggaaagatattcttcagcagcacaacaaaagtcagcgtacataaaaagcgcggcagactgagtggcacccagtgcggacggaagctctccctaaggcagttccagagaagcacccaggcagatgtctgacctcaccccaaagaaatacctgcttctgaagccgaccccctgcagcaggcctgcctccacctccctagagtgcaccttatgggtgtgtatcaagtgcccaaatgtcctttcaggagccggtacagggaccagccacccaacagtctgtcccacgtgtgtgggcagctaagccccgcaagttccggagcacctcgcacctcgctggggcaaaggatgttccaaaccccatctccggatgcgtggggcatcctgcgctaatgaataacacatcaggtttcagtcctgcgctaatggataacacccacatcgggtttcagtcctgcgctaatggataacaccacactgggtttcagtggactgtgttccttctccctcttctcttactccctcccagtccctacccaccaggccacaactgcccagtccccctgcacccctccagactccccagccaccctcagaacagaagtggttttttaartatatgtgtatatcctcttttcttgtcaattgcatatcgtgggggcagcttgcttttttatttatgtctgcagtattttttatgtcagtacacacagagccgacagatctttctggtagttttgtgagccgccgcatcggctcacctccctttgttttggtgtctgatgtttgtggacacttggacggcctgtcgtttttagctcttaagagagtgaacctcctgtgcgtgtgccctgcgtgctcacagaggctgctgttagatcagaagggaaatagctggtcaaaggtagggtcagtttgagttctgagcgctgttacccaattgcccccaggacgttggccccctgctcctggttgcaggcgtgaggcacctttcctcactcagtattggtggatttagcaaatggtttgtttgtttgtttgtttgttggccaatctgataagtcaaaactgatacttcattattggttttaatttgccttttttttctagtccattttattttatgtatgtattttgagatggagtctcactccgtcgcccaggctggagtgtagtgccgcagccatggctcactaaagcctcaacctcccaggcttctcaacctcccgggctcaagcattcctccttcctcagcattccragtagctgggaccacaggcacgtaccaccacacctggctaattttttacattttgtagacaggatcttgccatgttgcccaggctggtctcgaactcctgggctcaaacagtcctcccaccttggcctcccaaagtgctggattacaggcatgagcacctggcctaatttgcctggttgttgtttgagtcaggatctccctctgtcgcccagtacagtggtgcaatctcagctcactgcaaactccacctcctgggctcaagtgatcctcccacctcagcccctggagtagttggggttatggcgtgcgccaccatgcctcgctaatttttttattttttttgtagagatgggttttccccatgttagcccaggctggtctcgaactcctgggctcaagtgatctacctcggcctcccaaagtcctgggattacaggcgtgagccatcgcacctggcccaattcgccatttttaaatgatgaggttggtcatttttcctatcaattggccatcttatatgtggtttatgtgttgtcgacatttttgtccttttcaaaggggactaggaaagctagcaacagaaaaatgggcgtttgttgtgacttctgaaagtcagggactcgaagggagacaggagctttccggagagggccctgctgtggggggacctagactggagaccagagggagggctgcaagcctggtttacagatacacataatgggaatggttctgtgtgttttcctcgagtatttgttgagtgcctactaagtgccagacaccatacctggtgtctcacctgtgctcaggtctttaggctaaggctgtacagctactaccatcccattgtcaaatgcagaaatgaggcccaacgctacatggccacagakcccatagctgagggtcccaaggcccagcccttgttctgcaccctggagttctggaagggacttgtctgattagagcagggggagggccaagcatgtcctggggtcagaggagatgcttggccagagcttctgaggaattcggctgtgctgtgggggtggggaagactgcataggagaagtgggtagggccgccatgtagrgcctcatcaagattggggccagggctcagtgggccgcccctgggccgctccctgggggtgggatttggaggcggtccctgccatgcaccctgtgggtgggtcggaggtgagtgattttgttttcttctaggtggaggcccccctgcctcccaccctcactccccaccccactctccagctgcagaggatggtttaggagcaaaaatggtcacaactttaaagggtgtcccatgttaatgctggctttttttttctttaaaaaatttgttcttttgaaatttatatttgtttctccacagattttgagatgtttactttaaaaaaaaaaaaaaaaaaaggttgtggccgggcgcggtggctcacgcctgtaatcccagcactttgggaggctgaggcgggtggatcatgaggtcaggagttcaagaccagcctggccaagatggtgaaaccccatctctactaaaaataagaaaaattagcctggcacggttgcaggcacctgtaaacccagctactccagaggctgaggcaggagaatcgcttgaactcggagggtggaggttacagtgagtcaagatcttaccactgcactccagcctgggcgacagagtgagactccatctcaaaaaaaaaaaaaaaaaaaaaaaggttgcataaattttttgtatttttgagacagagtctccctctgtcgccccggctggagtgcagtggtgcgatctcagctcactccacctcccaggttcaagtgattctcctgcctcatcctcctgagtagctgggaccagagatgtaagccaccatgcccagctaatttttaaaaactttttttgtacagacagggtcttactatgttgcccaatatggtcttgaactcctgggttcaagcaatsctcccatgtcagcctccctaagcgctgggattacaggcgtaagccaccatccctggcccataaaatgtatcctaaggtcgcataattctgttaactggctgctaactcggttaatttttttaaactgtttgtagaattagagcatttctgggcagttttgtgtgttgaagacaccttgtagccaggcttttctcatctaaagatccaaagggaaagaaggacaaaaagccgccccctcttgccccctcttgccccctcttgccccctcttcccggacagcccgaatgctggtggagcctccgctggagatcacacagggctccagtgactgccctgctcggccccagtggttgccgcaggctggggctctttgctcagatgaaggccaagtccaaagtcacacagccccagctggtggaatcaggatctgaatccaagccctggatccagtccaggccagagcttcctctgcagagaaggtactaggtgcccatgcacagggtgactgccagcctcgtggagtgggggcagtggtgtccctgcgggcgggcttggtcttctgaggccatgtcagtgccaccccagggccgccctccatggcagtgtggggccaacaagcctgtcttcccatttttctgagagaggctggaaatcctgttctttttatatataaagtgtttccttttcaaaatattggcaactaagtaaatccaaacaaagtatgggccaaatcatggcacactcctgccccacaggtggccctccagctaagagtcatgtttacaattttagaggtttggtgggctccagtgggaccacgcctgggggtggagtggctgtgggtgagcgtgtctccactcccacacctcgccactgagaagacagagcacgggatcgtgacagccgagctccagccgccctccacctagtcactgtggccctgcaggggctgccagcctctgcattcaggagccagtgggcgccgaggacacactccctccctcccctgcctggggtcctgtgcttttgagctgagactgttctgggcctttcctgaaaggatggtagaacgccagagtggcatttcagtgtgattggcctctgcaggaccagctgggctcccaagacataaaaacatgccctgagcatttggcctcagcaccagctcatcctcacgcccccgtccctcccccctcacccagccagaagtccccatgctgcctctggcccccacctccgcaggcacttttgtgcttcttatgacacccagggctttcgttcatttcgttcaggagagcaggtcgggatggccccgccatggatgggtgaggagccggctgtgacatgttaagaaacggggacagygaagaacagtctgtacctcctctgtaaacgcgcagggaacgttacagtccactcttccatctgtggcgtcactctgtgtactgacgagggaaccccctcagggcccaggtaacctgcactagaaggtgcacgtcaggctcctgatggccaaggtgagatggacagcccaacatagctgcaagaccaagctgcagggcaggcaagggggccttggggctcttatttatttactttattctcgctctgttgcccaggccagagtgcagtggcacaatcttggttcactgtggcctcaactttccaggctcaagtgatcctcctgcctttgtctcctgagtagctgagactacaggtgcacatcaccatagctggctaatctttttacatgttattttatttttttgtagaaatggggtctcactatgtcacccaggctggtctcgaactcctgggctcaagcagtcctgccgccttggcctcccaaagtgctgagatgacaggtgtgggccccacgcccagcctggcgtggagtggagcccttcacccaaacatgaaccaggaggcgagcttggtaaggagcacgtgggctccaggaatgygagggggaatgaatggaggcagctcctcagtgtgcaaaaacatgcagcgcgggcctcactggtcaccatcacagcagccttgcagtgggatcaggacagtcctgctgtccaggaaggagaggaccctgctctcttgtttctcactacctgctcctgtcgttctagtcccattgctgctctcaggacaagctgtgactgagagagcgggtcacgctggtgacattttatgaggctggatgcacagccccacagcaccttgtcactgaagctacaggaatccaagaaccagtgctctggccaagaagggagcactggggtgccctgaatggcacggacaaccccagccccccgccttcactgattatcatgacctgtggcttctgaaaggacagggcagtctcggaactttctgagaaacagatggtcaagtagatgtctgttagctcttttcttgaaattgtagtgacgaaaccatgactgccacttaggaaagtaacttgtgttgaaataacttttagaacaaagtaaatacattaasaaataaccaaatcggcttactttctgataatatttattctatgmccacacaacggctggcactcacttctgcttctggccaggccgtagttacaaggaccagactttaatgttcctccatgaacaactagaaaactggacaaagtatatgaaacaactgtttgcagacattggacaactggtcaaacaagaccgagatccccaacaagaccgagaccctggacgagtccgagatcccrgacaagaccgccacccttgttggaagggagacaggcaaggtgaaccctggggccctggccttctgcctgaaggccgtttctgggctgccggcrcagggagggaagcagggcctgagcaaagctgagcacccttacggagctgagactgcactagggtctggggacacagaaggagccggcatttcagggcagaatcccgcaaggaggaaactgcagaaaagagctccagaaatctgcacagggttctattgagtctgtactgaggaccagcctgtacatgtatagaagaaaactccacaaagccaggcaaagaggagaaaggagcatgtaaggtgaacaacttccagacctcgcacacggtcatgacatactgaagctccagccagggggatgggtccccagtgatcactgtggacattcagtggagactcaggaggagccacaccgtgggaacagggctgatgctgtctgcagtgaaggctcgtctagaacctgcctgagaaactgcagctacagaaatccaaggcctggcatggcggctcacgcctgtaatcccagaactttgggaagccgaggtgggcagatcacctgaggccaggagttcacaaccagcctggtcaacttggtaaaaccccgtctctactaaaaatacaaaaattagtcaggtgtggtggtgcatgcctgtaatcccaactactcaggaggctgaggcatgagaatcacttgaacctgggaagcagaggttgcagtgagccgagatcgcgccactgcactctagcctgagtgacagagcagactcctgtctcaaaaaacaaaacaaaacaaaagaaaaaacaccacataacccaactttcacccaaaacaaggcccaacactctttaaaagacaagaaggcgagcaccatggctcacgcctgtaatcccagcactttggcaggccaaggtagatggatcacttgaggtcaggagttcacaaccagcctggccaacttggtaaaaccccgtctctactgaaaatacaaaaattagctgggcatggtggcaggtgcctgtaatttcaactacttgggaggctgaggcacgagaatcacttgaaccttggagctagaggttgcagtgagccgagatcgcaccactgcactccagcctgggtgaaagagcagactctgtctcaaaaaacaaaaacaaaaaacaagaaaacatataacctaactttatttcaaaacaaggcccaacatgctttaaaagataagaagactggatgtggtggcacatgtctgtggtcccagctgcttgggaggctggggcaggagtatcgtttgagcccgggaggttgaagctgcagtgagccacgatcacgccactgcgctccaacctgagcgacagagcaagacagcctctcaaaaaaaaaaaaaaaaaaagggccctaggcactttgagaggccaaggtgggtggatcacgaggtcaggagatcgagaccatcctggctaacacagtgaaaccccgtctctactaaaaaaaatacaaaaaaaattagctgggcatggtggcgggcacctgtagtcccagctactcgggaggctgaggcaggagaatggcgtgaacccaggaggcagagcttgcagtgagccgagatcgcgccactgcactccagcctgggcaacagagcaagactccgtcccaaaacaaaacaaaaacaaaaaacaaacaaacaaagtctgtctttgattctgtttttgtgctgaggagatgatgaggctgtcttactgtctatttctactcctgcacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtctctatctcctgacctcgtgatccacctgcctcagcctcccaaagtgctgggatcacaggtgtgagccaccgcgcctggccggatctttatttttaaaaagttcaatctaagaattctttttcattagtcagtttactcatctataaatatccattgaactattgtctactggaacttaatctccatattatttattttccatttgtttcattttcctacattcttgttttacatgggagaaatcaagtttttctctgctgttttacaagttacacattctaattttgtcctgtggtaacatctgccagctcacaccgggctcacagaaccttatgcctcgcagccgcctcgtaggcccctcgcaggcatgcgctccacacgccccgctctgcgccaccccagccctggagtctgagctctcctgcggggcgctggggccacttggtttcctgtccatgtcttgctctcttatggcttcttctgagctctttctcctccttccttcagtgactcccccaacactttctgtgtgggcctgggatagaacgaggctgcatatcccgcctgtttaggaagccctgtgcttgtatccctgtaggtatttggaggtttatgtttaacatgttttgatatgaagatgtagaaggattttgtgtaggtttggccttatccatattctgtcttcatcggcctcctcgaagaacttcattctgtcctaaaggaagcagtcgcagcttaaagagtgtgagcacgcgcccactccccacagacacacccggcctgccccgccccacgctgcccctgccctggagaaagyraggctccttcctttcctggagacgccggccacagttcttcagtgaaacgcttcactctctggtcatagaggtaggaaactatagctgtcccaactaaatgtcaggacgaattagcccagctggtcacgctcacagtcaccgcctccaccagaactgatgcggacccctgggaactgaggtgtttgctctgtgacttgggaaggacagcggaaggtatttccgtttagctcttgtggtcagatttttttgtgaatgaaaatctgctgtgcgtcttggacaccgtcacatgcactaccctgtgtatttccctttaaaactcagagccagcgataacatgacaccaatgcaacacaagcaagagagatcctgccctgaaactcactgttgttttaggctttcggcggaccctgctataaatatgcagattttatgcccagtctgtgaccagggccgaacctctttcctgaggggctgggggactccttcgaggagcaagaacagcccggctgtccacagaggagcccgttttcaggggtgggatcacaggtcaggtgctctctcagcacaactccaggacccgggcaagccatgacactcatctcactaggaggcagagcgccagagcggccgcaggtcactcgtctctgccacttgctctccgagtgctccagagtcaaggactgcggcctggccaaggggacagtggcctgtggcctctgactctgagcttggagaaggcttgctgctccaacatcacgtggacagaggcaaggaggcacgtgggattgggaatggggatagagaccagcctgccccaggagcaggtgggtccaccagaaatgctcatgcatttgctgaccaggacttccatcctgaggtgtgtgcagagtgatccaaagccccctcgtccgtgccgtgactctgggccctggagcccaccccctttctttagaaaagcctgttctgtaggcatctgtcctgagagcacccgatggcactgtaggatgctgagagcagctgaggcaggagggccggcggctgttccctcccagagtcccatctcaggtggacgccggtccacgacttccagcccaagggctaatgtgtcttctccagtccacgtggcaggtgttgccaggggagcgggcagtgcagctgttggacagcagggggtgtttcttcaacccaggctgccctccttctcctgtcacaacagggccccattcattctggaacctgcagaccaactccatccgcccatcctcacagtgtgccgagcgccaggtccagaagcacgcacctacctgggggcctcttcctcctttctggcgggggtccgctttggcccctgatgctaacctcgccccgtgtgccgtgcagctggagtcaaacggaggcgcagagacgccatggagggtgacaagccacacagcagggttcgaggcagccactccccactccccactcccgcggcatctgtgccccacccgggtgccaagccactgtgccatgcatccccccacccccaacctgctgcaggtgtgtgggcctttgcctcttttcccaggggaaccaaaaaccctgggatccagagggtcattgcccagatctctggagagcaactccaggggcctggtctccaggggagaagagggagtggggagaggcctttggccaggcatgtggccctcagtgtcctgagcaggtcgggcagctgataagtgtgtggctggcgtagctcctgcagagccaggctccctggaggagcgtgtggcctccttcccagctgtccgccctcctgccaagacatgcagggagcagccctgagacacgggtctcaggcaaagtgagtggcaggcagtgctgttccccggggacatggcggtgacctgctggtctatggccctgagatgctagggtgcccacctggagctgtaagctggcctggcagacctgggaaggccccatgggccccttttgaaagttcccttttcatgaattttacccagaatctcccctgcacactggcccctgctgctttttgctgtccccagacagtgccaacagagaccacgagtcgtctaaacaccagcccaggcactcagcactcagtgcagagtcctggcccaaggggcatgaggccagcattcctcactttaggaccaggaaacagttcccatgcctccgaaacagcggagacagctgccacttcctgtcgccccagctcagccgctgcctgtcactttccttccggggcctcagggcgttctcctgcgtttactcttctgaaaggcaggagaagggtggggtgtggagatacccagaggctgtccagctctcaggccactgcctggccctggctctcaccgtctcagcctcctagtggcctcctcggcacccaccagcctgcagccacctgtgcttggggttcttggcacctccccttcctgtgggctgagctcagatgggctctggtcgggagccggcccaggaggaaggccatgcgtctctgggtctcttctcgcccaagtgaggcctgtgtgcccgccttccgtgatgcagcctccggtagggacagacccacgtctctcaaagccttatgcccacgatgtgtttcccttgaattcccttccttggggctccagcttgcaccccactactaggtgactcctctcaagggctgggatggggcccacattgggcaacactgacaggctgtagcagacaggcctgggcaggctcagcagcagcaggggacctgccagtgccgttgggggagtagccacaggcgcccagaggaggtgctggcatgaaacaaggggtcagcctgtggtcggcgcccaggcccccgagggcccacctctcctctgctccaaaggccagcaggcggggcctgaaggatctggggtttcctgctggccctgcctcaccaggctgagtgatgggtggcaggactgcccagagccctggagcatgcaatgtccagtaccctcccctcttgtgcatctgcccagtgggggctccaggctccatgtgccagtgaggtggggaaggcagctggacatagcaggcccggagtgtccccctgtggagggaccgtgggaaccagatcacgtgggcctccctccccctgtaccccattgctctcctgttgtcacactcagtcccacaaaggcagccccggggcyacggtgaccccccagggctgagctccaggagctcaggggtgggggtgtccattaggagactttagcaggtgagggttgacgcaggctggggagacacgggtgggcgtggcctgtgagcctcccaggcgtggggaccctggaaaggtgcacgcagcttctggagattcggggtggggggagtcaagtcacattcactgtcaccgtctgcactaaaggcctgggtgccgtgctgacagtggtgggaaaagccttgttcccaagagacttggaaataactagatgcatttgagaagggttgatcttgggtgcgtgaggacccctgtggcagccagagggggttcagcagaacaagggcccttgacacagcaggggtgaaccacacagagcagcggaggccacagggagacggaagggcctctgtgccacagaatggacttgaggcctgagctgccatcagggccaggccctccccagccccaaggcaggctctggagaaccagggaaggcgtgggctcaccgtcyggcccttcccaaagccctaggaagccacgtaggtgtgcccaggggcacccagagagcccggagcagcctggagaatgagccaccagaggccaacttggtcaagagctgagctgaggctcaggtgcaggagaagaaactcacagggtggccagaaagctggggaccagctccgtcctctttgtgctcagagttctcatgcccccaggctgagacgggagtgagggccgcaccttccctgcaataggacaggctatgtcctccctgagattccaccagcttcaaacctccaagccgggcttggtggcycacacctgtaatcccagcactttgggaggccgaggygggyggatcacgaggtcaggagatcgagaccatcctggttaacatggtgaaaccccgtctctattaaaaatacaaaaaacttagcggggcgtggtggcgggcgcctgtagtcccatctactcgggaggctgaggcaggagaatggcgtgaacccgggaggcggagcttgcagtgagctgagatcacgccactgcactccagcctgggcgacagagtgagactccgtctcaaaaataaaaataaaaatttaaaaaaccctccaagtatggtgcagccgcctgaggggacggagcccagcctgggtggccctgcctcagcacacaccaggacctgggaggggttaagcctgggaggggcaagcaggccccagtccccctcccctggttaatcactgcaaggccttggatgtttcaggaactttccagaagctcagttcggggccagagcacaagcagcccgtgggggaggggtgcaggacccaagaggcgcgttcctcacgctgtgcccggcaaactgtgtgtccacatggtttccctgcggcccagtcagcccaacgcagaaagagaaatcccggccaggctcggcaaaacaggtcaggcgagaaggcggggcagagagtggtggaggccaagagcgtttttacacaccagttactgggttgacctcagattagcatcaggtagaagaatccggggtcacagggagtcacgcctggggcagccgccttgacacatccagctccgtgcctctgacctaggactggctgggctggggctgtccgctgccctggggtcctgggctcatggccagttccctgccaccatcactgaggagggctccgcaggaaaaggaccagtgaagaaaccagagcctgtaaagtggatattctgagctaggggccggcctgccctggagagggggccagctcaccctccctgcccctccctgccccggggactgtgacccactcacacctccctgcttcgccccgggatacagccagggtcctcccagcagggccagctcaggcctcccaggcaaaggggcaggcccttcacccccctccctccgctcactttttctgaaaatccccgcaggctttgtctcaggaggatcaagccgggcaaagcccccagaatccctgagcattacagagggacaaccaaggcctctgggtttgaggagatgcctcagggtcacagtggagcactagggcctggtcagaggaccagcttccccgcaggaagccctttccacgggataccccaccctctgccagccagtgtggggggtggggggagggagtggggatgggggcgttggccgggaccaggaggtcaggcaggcttattgttgagagataaagggtggtagcctttgtgtgaagaggaggaattcctctgggggttggaaacaaagggagcaggcagcgtccagggccccccaggaccccagcagggggccagggactgtgtgactgtgtgaccccaacggggctgcaggaaaaggaagactggttccgggtgtcttgagaccccaagagtggatcggagtggaagaagctgagatgggaagaggggcccannnnnnnnnnnnnnnnnnnnnnnnnnnnnnnnnnnnnnnnnnnnnnnnnnnnnnnnggctgggagtgtgtggctgcccccatgggcactgcgcagcccagctgagagtgcgtcattgccggtgtccccaaagcacagacgcttcccagtcacccaggctgcacgcagaccacacaggctgggctccagcaggaggcgttggccgcccgctgacctgcctgggtcagcctgtccagactgcccactgggccacattcagccacgtgctggagtcctctagacctcaccccagccacrgtgtggccacgcagtggacgctgagctcacatcttactgtggggttttttttgtttttttttttttgagatagagtttgcccttgtccgcccaggctggagtgcagtggcgcaatctcggctcactgcaacctctgcctcccgggttcaagcgacyccgctgcctcagcctcctaagtagctgggattacaggtgcccgccaccgtgcccggctaattttttgtatttttagtagagacggcgtttcaccattgttggccaggctagtcttgaactcctgacatgaggtgatccacccacctcggcctcccaaagtgctgggattacagacgtgagccaccaagcccagcccttgcatggatttttagtaacattttgctgttgttttaccaaaaaaaacccccacattcttaattgaaaaaatgaaaaatagagaaaaactggccagataaagaagatcacctacaacacccctctgcgaagatggttttagccgatgtttaggaagggctatctggcatttaggccccagcctctgtgtgtagcgcactcctgggcccttggcctgtgcctggccacgtggtgcccaccagcacggcctttcctttggcctcaaaagcctggcactgctggcccatcggggaggcgggggcaggcaatgtgtctcagatggtagggacacccggggcagcctggggggaggagctttgagtcaaccatttaccccagcacccctgccccctcctgggacccattaccacacagcacccctgccccctcctgggacccattacgaaatggtcacaacaggaccattttcagagccacatgtccaggtgcccagtggaggggcaggcccagtccctgccaagcaggacccactgagcaaggcgaggccacagctctctggtcactccaggatcctttggccttcacrgactcctggaggaaagccaggccaagggtcacagggcccccgctggccgggaacacggaagtgctgcacctgtgcagtgcctgtgagcacagcctcctgctccccctgccatcctgatgcatgctgttttttyctctttacctgacagagctcccagctcctccagcagccgacaggaggcccgtcaagatgcaggcaggyattgccaccccagggatgaagacagcagcccaggcaaaggccaagaccacaggagcctcccggtctcatcctgcaaaagctaaaggctgccagrggccccccaagatccgtaactacaacattatggactgacttcctccccccaccccgccccactaaggggtgctcggggcctccgcatggtgcctgtgctttcacctacrtgttgtgggggggtgtgggcacagcgtgcagggtggaggcagggagctgcagggcaggctcccaaatgctgctgaggcgaccctgctgactgaaggcctccctgagcacagggcccattaaaaccaggttcctccctggggcgtctgcttggccgtagcgttgtttatctgtcctacttgggaaatgcagtatcaagtgcctgtgccagagcctggcctgcccgtgtcaccacccacagccatctgcacaccagtggtgttggggacagtgtggccttcctcagagcctggtagcaggtagggggcagatcagaaagcccacccacaaagcaggcgtctcctgagagtaccatgggaggggccctcccagaaggagtgagagccttggatcccagtgaaccgggccaaggtgacccctggaagccaggtgggcacctgggcctcatgcaggttggggtgtgcatgtcaggtgctgacagggtgggggccaaccggggacagcggtcactgctgggccttccacgtccacccccacgaaggataacagcaaaatgtccctgccacctgagtgcccggggccaggtatctgcaaggatgagaaacgcacacgtaaactgacgcccgtccgctcggaacacactgcactaccccgccaaaaagcacttccaagagtcctcgcgtgtcctccacaagaacacaatgctctgcgaccggcaggagggtgactgggggtggttcatcacacggacgcagtgctctgcaaccgacaggacggtgactggggtgggggttcatcacacggacgcagtgctctgcgaccggcaggatggtgactggggggggttcatatcccacccccactcctcaggagcccagtctctgtcccccgcaccccccaggcctggtcacactctgcccacagcagagtgcaggggtggaggcagccggtacccagctgggtgaattgacgggccttgccatataccctcgggccacctttctgaactgggcagacagcttctctgggaacacgatgggagaacgctgctcccagccctaacctgccgtgccaccttggcaaatcgtgggacctttgcagctttggtttgcacccccagtgtaaaatatagacagtgccatcggctggcctagctcacaggtgtgcgggccggataaccgtgacaagcagagaccacaccacacagacaaaggctgtggccccagggcaggggcgtttgaggttagcctccgtcacttgctccatgggaatccagacggagttggggatgggctggaggctctcagtgctctgtggtctcccacacatgtcccctggaatcgagtcacggccctgtgaggtttttttgtttgtttctttttttgagacagagtcttgctctgtcgcccaggctggaatgcagtggtgcaatctcggctcactgcaacctctgcctcctgggttcaagctattctccagcctcagcctcccgagtagctgggactagaggcacgcgccaccacacccggctaatgtttgtatttttagtagagacggagtttccctgtttcccaggcttgtctacaactcttgacctcgtgatttgcccgccttggcctcccaaagtgctgggattacaggcgtgagccaccaagcccggccgctgccgctcactttctgtggaagccctcagggtgctggacgagtctccaacctccttgggagccagccagggctcccctgtagctggcccagccctcgacaggctgcagagagcagggccccgctggccgctgatcaccagcactggcagccagggccacctgggaggtttggagcatggagagccggagctgcgtgcccgcacgcctgaggctgacacagggcctcaccctgaatcagaagaacccccgcagtggggacagcagtgcggggccagccccggccctgtcttcccttgtccttccttgaccctcggtcccaccgtgcgtcaaccacagccccagaagggaaaagacgcggagtggccgcctgaccctcaggcctgctctcaggagaggaaggaagcgggacacctgcagaggggccgggggccccagtctccggttccccttcagcggcccgggcttgctgagccctcaaagtaggacacgcagccagagacacctgtggcctcacaaggcccgcttgccccccatggggtgcctggccccgcaagcgcgaagcggtcagaaaagggaggccgcgcttcagggctcaggccgcccaaggggccacgattcgaggaatcactcgggagggagggagcgcgcgagggccgggctgagcccccgcccgtgggtgcgcgcctggaaaactcgcagcctccgccctgggaagtggggcagcggctccctttgtccgcaccacaccaggtgggtgtcccggccgactccgctcgccacgtggccgcgcccctcccctccgccgagctccagcggcctggagtgcgctcgcccgttcggccctgcgcctcgtccgggtccccgggaagctgctaaggaggggccgtcgggtgggtggacgtccgtctcgggtctgggttccccgccgcacccgcgaggaaaaccggggatgcgctgcgatgaccggcagtaaccccggccggggcgcccgcggccggggtcaacgcccgcacttgcgccgcggcccgcgaggcaaccgggaccgccccgccgcccgcccatcaccctatcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10597 - DNA, 28516 bp, Homo sapiens
gggtgtgggagaattctactgtgagttatgaggctagggctctttgttgttgaggcttttctcttagtgtgacaactgttaagggtcaaaatctctaggtgcataacttaatagcagcattactttatattggtttcctttccccagcacagagcagccttccaattgcacagaaaatgtatcctcagtctgcgtactgaagcactctttcatgaaatcaaaaattgtaaaaaagttccagaacacccaactccccttccctctcaccacaggagctcttttcacaacaagataatgaaaagtaaaaacactgagaaatgggattctgcatacacataccttacatattttacatgcttaaagtttctcttaaaaggcatttgaattgaagcaacaaaatatgtttatcttaaggacaattcatggtttataaactaccagaaaagaagttcgctgctgaaatacaaaacagtgagttcaaacataggctttcaaaaagccacgaaatttctaacaaatacaaatgagtgtgtacatatatgactatgtgcacatatgtactgttttgctggggacagggtacacagcttcctcaaagggaccctgatttggaaacagaaaggttaaaccagtataatcaactaaggtcattttaaattactgtttaagtaaatttaattacacagcagatactaggttatttaactcaagcagtgaaaacaacagactatgtgaccacacttcctacctctgtgtcccaggaatcctgaaagacagggtttctgctacttcttttggtctgggggggaagatggttgtcttcttcgttgccattccttctccttttcctgaaattaaatcacaaggagaaaaaaaaaaaaacccaaacaaccgatgttttggacacttgaattgcaaaccataacaacatataaatttgccctctggcctgagaaaacataattcagcatatgatatcccaataggttatcagttggaagtacagcatcactggacactaagagcaaaaatacaagacagcagcagcgaggtcaagcttaagttagtaaaactcatttctaaaaagaagcttaacaattttaaatgtctgttgggactgaaacaagaacaggaagaggttaatgactaagctttcaacctctaacctaattaaggttttcttctttttacactccctgaaattaggattccgagttacctaattgtactcccttccatatgacaacatttgatataagagtggctgcctttgcctatttgccctgaaaacccttataaaagtacctcttggtcacattcacctgcttattctggcaacactagccggtattatgatataacaattacttcactagattgttactatgagatgatagcataagctgcttaaaatttccaggtttaaagaaaaatcacacatctttcttaggcaagtgttctcggacatgcaagaaagaccaaatttgtatgtactctatttaagaattatgtgctgtcaaaacgatttctgaacctgttagaaaacagaaataaattaaaggaggtataattttcagtcaaattgcccggaactgtactgtccaatacggtagccactagccacatatggttatttacatttaaattaactaaaattaaccatccagttcctaggtcacagctgccctgtttctagtgctcagtggccacgtgtagctagtggctactgcactgaccagcacagataaaggacatttccgtcactgcagaacgttctccggagcagcacaggctagaggtctgtatgtacatggcagcagcacctattacaaaacccttgaagtttcagctttctatagttaagagacaaaaggctagtgtggacacacagctcttggaaagcatgtacatttggaggatatagtgtcttctaaataattatacactttctatgagagtagggtggcttacagtggcaggcctttaatcctaaaggttttgagttgaggtttgaatattagagaaaataaatgatcaccctaagctcacttctctgtactctgcaacattctgaataggtctaactttaataatgagtatggatcccagcttaagtttggaataataaagagtgtgtggttctgataaagcttcaaccatcctgcactgggctatgtaatttacttcattctaagacatttctgctccccacctttctcttaggagatcagatcttagctgcacattactttgaagtagttggaggttaaaaaaaaatagatgaatatcaggttttaataatcattaaatgggtgtgcttttatcataaatttgaaccaagaaactgctaatttcatcctaatatgatcagggaatttgagtgggagtgttctgcagaggcaaagcaatgtctgctgggaggccagtcgacacccaaagagaaagtcattgagtaagtagcagctgctggtcctcacacacccattttatcagcgtgccaacagctgactgggctttgggctgctgagtcactctaaccaaacttaggagcctgatcaaaatttgctatctcctcatttataatgggggatagatctttccagggacaagactatgaatgtcaaggaggttgcatggcagagggactgtaagaacaaaaaaagatgagatgattttgtggatttcaactaatctctgggagagtcacatgaaatatccctgcctcataaattacttgatctctcaaggcaccagaataatctctttggcctgttggtagccttctcctctggatggtaccagattaagaaagagtcctacctgctcttcatttgcctttttctaggctcttagcagatctcatccttgaaacattcttctttcaacaatggtgttaacaactggcaagattacagcttcatgctcatccctatcagttcaatcaatcagattacaatttttggcattaatgccacagaccaggttatgattttagcaggcacccctataactgattatattcttccctaaccatctaggtgcagattaccagttagcatctgttacttctacagatggttgattccatcacgttgcattatttcatttctctccaaccttcctgtcatctcctagagactcggcatagaaataatcttaagagtatgggctgggcacggtgactcacacctgtaatcccagcactttgggaggctgaggcaggcagatcacttgaggtcaggagttcgaaaccagcctggcccacatggtgaaaccctgtctctactaaaaatacaaaagagttagcagggcgtggtggcgtgtgcctgtaatcccagctacttgggaggctgaggcaggggaactgcttgaacccaggaggtagaggttgcagtgtgccgagatcgcaccactgcactccagcctggccgacacagtgagactccatctcaaaaaaaaaaaaaaaaaaaaaaaaaaagagtatggaaactagtggttttcaaactttattttaaaaagtaacagaactctttctttcttactgtaaaaaaattctctctatataagagataaaggatctgttaaagtagggactcccagtctggtgaggtggctcacatctgtaatcccagcactttgggatgccgaggcgggtggatcccttgagcccaggagttcaagaccagcctgggcaatatagtgaaaccccacctctaccaaaaatacacagattagctgggtgtggtagctcacacctgtgctccagctactcaggaggctgaygtgggaggatcacctgagcctgggaggttgaggctgcagtgaggcatgatggggccactgcactccagcctggtcgacagagtgagactctgtcaatcaatcagtcaatcaatcaaccaatcaatcaatcaataagcagggactccctcactacacactcacctctctgcggctatccaatctactgtgggagagcctgaaaacccttttttttttttagatggaagtttcgctcttgttgctcaggcttgagtgcagtgatctccgctcactgcaacctccgccttccaggttcaagcgattctcctgccttagcctcccaagtagctgggatgaaggtgcccaccaccaggcccaactaatttttttgtatttttagtagagacagagtttcaccatgttggccagagtgatctccaactcctgacctcaggtgatccgcccgccttgacttcccaaagtgctgggattacaggcgtgagccaccgcacccagccgaaaaaccaccgtcttagaccatcctagagctggcagagctggcccatcatactccattaaacactggcaggaaaagcctgtccaaatcaaataacttctttaaaacatgttgagattatttgtgtacaagataaaaggaatctactgccagtataaatgcattcagattagttatgtacagtagaatttttatttgtaggaaatatttagattttttttcagatatgtgagacaccccaagagaatatcgtaagtataaactgggtttgggaaagaataatatggcagtcgggtcagattcactgtatctaaagatcttgctcctaattccgatggcatgtctgtaattgggcccccaatttcaaatttagtccactcttcttttctatacaaggagaggctttatgctccacctgctacatgacccaaatcaataatccaatgcagcagcttggggaaccctaggttttcactatgggaccaaataaactcagaatacttttgagaacttcaatcacatgaaataattatttcagagaaggatccttgtggaaagaccgtaacaggaagagcattctgaggtaacctttcccaactttctcctccacacattcttgcagaggaaattaagagagagaaaaaaattaagaaatcccaacttagtccggactctagtagtacatgtcaagcacagaacccctaatttaagacccgcgtcccgaggccaggctccctcgggaaggtagcgagtgcatcgcgataaaatctttcctcccgccttcggagtcaaacggccccgcaatccaaacagtttagaatccagcttgttcttaatgccacagtcaagagaagatccataacccgccttggtcatctgcccttctgtgttcacaaccgttcagggcacaagttcttcggtctaaccgaatctttccctgctgcggggttaagcccaacctttctttctgaccttggggagccggcagctccccgcccggtgccctcacaaaagcctttgggggctccctctccaagatgagacgtttatcccatccccccaccctcctaaatttaggacaggaaagctttagggccaccgtctctcttccgggaccgatcacacttcgttccaaataggaaaagacaggggggaaaaaagatggaggggcgggagacctggaccccggagagtcaccttccagctacccacaggaaccaagcatccgatcactcgcgcatccctctcccctcctcccccggcccgcagtgcaccccacagggagccccgccgggtccactcttgctccgacccccatttcgcgcgccccctcggctctatctyccagatcctcaggcgacgaatggaaagggggtcccttccctctcacctgggacggaggcgctcgctcatggcagctggcggatggaagctacgcggcgccgctccgcgaagagagggaacagagggggttgtgtttcggcggccgccacgcccaccccctcgggccttggctctcgcagccsctcgggtggacgcagccggtggcgagtacccctcagtcggacccgtaccaccactacttccggcgtctgctccgcgcccccccatgtcgctgccgccgtggtaccgccctctygcggctgcgcagtggcaccatcccaaccgcaccgactggtaaccccgcccacgggaagaggcgggctcggagcgggaggagcgactaggagcttctgggagaaaggacctcccctggggtggcagaagcgctcgcctgttcacagccaacggagggtacggtataaaagtcaagccaggtttcaaataaattcaattatgtcataataatatcatacaagtatttgagttgaatccgtgtaacatattttaaaacaggcggacctatccggcagtggtgcagacggcctgacgmggttccttggccgggggttgggcaggggcctggggggcttccctggggggcttgtcgccggggccgcctgggctttcaggtcttccgaggtgaggacggtgctctgtggggagcttgcaagggcgggtttgttttccgcggcccacgttctaagtctgggggagactctyctgagcggagagggkagggaatcgggtgccggggccggcggagggtcttcctggaaccgcaggaggaaatcctcggtggggctgcgggaacggctgtccctgacccaggagctgccgggccgaccccatccactccgcagaatcagaacagctggcagaatcagaacagctttcagggaaaggaagggtgcggggaggtgggcaggctggtaacgcagcgggaggagggaaaggcggctggagagcgccggaggtgagggtgaggattagtggaactattgaggtyctccttgagcccggaggctggggaggtcttaactctctgctttccggaacctgtgtttctatttggttcastatcgtgccgcgtttactcactgtgcatgctgccaagtcacctgtctgatcgtgtcytacacaggctgacattcacgtttcattctgccacactcgggaacggtgatcggggaagcatggggatccgggagaagcacccacaaaactagcatcctcctggaggagctcgggtaagaaaacagacacccacgtatagacgttatcgtgggaatgtaccgggatctttcaagtagggttgagtgtgaggtggagtggaggcagaaacgtctagcaggtgtcaagcccttcctaacgttgttagccgaaggtccatggactggcttcatttgtgtgtattattgtaaacaaacagtctgtggctttcatcctgttagtgtgtacctccaaagaaagaaagaatgatggctcacgcctgtaatcccagcaggctgggcgcggtggctcacgcctgtagtcccagcactttgggaggccgaggcgggtggatcacctgaggtcaggagttcaagaccagcctggccaacatggtgaaaccccgtctctactaaaaatactaaaattagctgggcgtggtggcgcacgcccttaatcccagtaatcccagccacgcgggaggctgaggcaggagaaccgtttgaacctgggaggctgaggttgctgtgagccgagatcgcgccactgcactccagcctgagtgatagagcragactccatctcaaaaaaaaaaagaccaaacaacaacaaagtaaaaatgattactgtaatctgttggcagaaaacagttttgttttgaaggacttcgtacaggataaggtgggttggttgctttattgaatggattggtgaagattgtgtctattttgtaagtggtttcagtcaccctttttaatctctttggtagtcagaagatattatcagttgtagtactgaataatatttaaacgtttatatctaaagaattaagtgaacaaatattgtatgccaggctcagtgctaggtttttacatacagctgtgtgcaggayagatatgtttcctgccctctggaactttatagaaagaataagagatgtagaaaggaaataactttcaactaaacattggaattaaacattttcttttctggactctaaagaataacaggtacaaatatacatggtataaatgttttttttttaattttttacatcgtatatgtttaacaaagatgtcaaactaatttgccagtaatctgttgtactagaaactataagtaggccaggcgtggtgtctcacgcctgtaatcccagcacactggaaggccgaaggcgggcagatcacgaagtcaggagattgagaccatcctggccaacatggtgaaaccccgtctctactaaaaatacaaaaattagcctggcgtggtggcgcatgcctgtagtcccagctcctcgggatgctgaggcaggacaatagcttgaacctgggaaatggaggtttcagtgagccgacactgcactccggcctggtgacagagtgagactctgtctcaaaaaaaaaaaaaaaaaagtataagtgaaaaacaggactgtgtccttggccatgtatatatttgtgcattatgcatacattttatgtatatctgtgtgtgtgtgtgtgtgtatatgcatattactaaatgttagtagagcttcatttctcattctttgattgtggtaattctaatattttcttcttacaccctagtgcatattctatttatcactttggaaacctctgctgtaatcagtaacctttggctgggcgtgggcgtggtagctcgcgcctgtaatcycagcactttaggrggctgaggtgggtggattgccagagctcaggagttcgagaycagtctgggyaacacggacacggtgaaaccccgtctttactaaaatacaaaaaattagtcaggcgtggtggcatgcccctgtagtcccaactacttgggaggctgagacgagaattgcttgaacctgggaggyggagtttgcagtgagcagatattgtgccactgcactccagcctgggtgacagagtgagactctgtttccaaaataaataaataaataaataacctttggttcctggcctaagttttttattctttaccattctgtccttgaataacgtgtttaagggtttttaaacaattttttatactcatataatgactagttgacttgctgtaaccgtaagtagcaaacatctagcttgttccaaatgaatttaaaagatacaacacataagtaaaatattggtatgtacaaactatgtgcttctyataatctcacatttmcctttttcaggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagcyacactcccacgtgctaaaaagatgaaaggrccaatcaaagatttaattaaagctaaagggaaagagttagagacagagaatgaagaaagaaattctaagttggtgrtggacaaaccagracagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttaygcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactrgtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaamagcaggaacggactgtcatgagccatggctgtgagaacttcaacaccagggattcagtcacaggaaaggagtctcaaggggaaaraccacatttaagtttgytcattccgagggagacgacttaccagtttcattctgtatcrcagtcaagtagtcaaagtcttgcctctctagctacaacatttcttcaagaaaagaaagcagaagcccagaatcatmatygtgtccctgatgtaaaggcattaatggagagtcccgagggacagttatctctggagcccaaatctgatagtcasttccaagcatcacacactgggtgccagagccctttatgttcagcccagcgtcacactcctcagagccccttcaccaatcatgctgcagctgctggcaggaagactcttmgcagctgcatggggctggagtggtttccagagctctatcctggttaccttggactaggggtgttgccagggaagcctcagtgttggaatgcaatgacccagaagccacaacttatcagtccccagggggaaagactctcrcaaggtaaacaagcttattttcaattgccatctgtcccatccaaaatgctctctctgccttttgaatttataagggtcaaaatactaacattttcagtcatttagtttattttcacctaggcatgccagtagactgcatataaagttgtcctgaaagaggctgggtgtagtggctcacacctgtaatctaagcactttgggaggctgaggccaaggcaggtggatcacttgaattcaggagttaagaccagcctgggcaacatggtgaaaccccatctctactaaggatacaaaaaattagctgggtgtggtggcgcacctgtagtcccagctatttgagaggctaaagtgggagatcacctgatcccggaaaatcagggctgcagtgagccgagtatgtgccacttcactgcagcctgggcgacgggaatgagaccctgtctcaaaaaaaaaaaattgtcctgaaaacattacttcttgcttcagkggtcagtagtggtggtttatccctctctttttctctcccccaagagttgagggttacactagggcaggctggcgatactgaaagcagttgagtttctgccttgagaagaggcatgtccrgtagaaactggatgggtaaacagactggagaaaaatataaagacttaaaattcagctagatagaataagcactgtgttcagaatccagtcaggaccaggttgtacaagaaataggttctaagtttacaggacaagaaataggttctaggtttcaggcaaatgcaacatctaggaatttagagtagcaaagtaggatgcaggtggtaggacacaggtaaaactagccaggtaagacgggcaggcaaggcagataagtggaagtggaggctcaggaaatgaacagtgaagatcaaggaccagaaacggaggatgtggccaaaaacaaaagaaaaaatgtaggccacagagactaggacccaagaataaaaccagtgattgagcctggaaacaggagagatgaggcgagaagggcttggggcgaaagactgaacgttgaaactcaccttgattatgaatcaaacttcagaagcttcctagaggctccttttgctgatggctggaatcggttaacaggagggaagaccaaggcccaaggagccaggaagttcctgacagtcatttgaaatatctttgcttttctctgctgaatctcatctttagttatgagaccacctctctagttaaaatacataaagtttcttaagcttttctaggggcagggtgattgtaaagtagcatacctgtcgtgtgtagtggccattggtgctttcatgcttattttgacaggagacctgtaacaactcagaataggtttgcaagagaaaaactggtattatctcttcctaaagggaaatcattttcttctctggtagattttgcaaatgatctcatattcactaaacctctatttgcctggtctcaaaatggatgtgtactaaaagcagaacattgctagcccaaagctacattttctttaactaccttctataaacaggcctaacgtctagacctttttgcacaaagttgtagtcacaaagtcaagccccttctccrtaataaacacatttaattatattaacatttgtgttgctttgtggttttcagagtgcctccatctgtattttttttattttgggcacaaggtggacagagaggtgggcagagtgaatttatcctattttgtggatgatgaaacaggcacagagagcataagtgatttgtccaagtttgtgttgccaataaatagtagagctgcaaggagaacctagtttcctgaggcctagtttaatcttttccactaaaccatgttgtagaaaatacaccataactaaaaccatgtttgttatagtgccatacttttctgtgtgtgtgtgtgttttgtttttttgtttgtttgttttttgagacagagttttgctcattgcccaggttggagtgcagtggtgtgatcttggctcacctctgcctcctgggttcaagcgattctcctgcctcagcctcccaagtagctgggatacaggtatgcgccaccacgcccggctaattttgtatttttagtagagatggggtttctccgtgttggtcaggctggtcttgaactcgtgacctcaggtgatctgcccrcctcaacctcccaaagtgctgggattacaggtgtgaaccaccgtgtccagccttctgtgtttttcagttgcagatgcacacactccccccatgataaatctctctaccaaattgaaggacttgtgtattttctgtactacattttatagtgcttaggagtgtccttgatacacacttttcattttagaggaaaaagtgagggacctgacrtttatctgtgatgactatgactatcgttatgctagatacattatgtcatttaatcctcataacagctctgagtgacaccactgtcccaccctcttattcctcttgaggaatctgagcttcagacatcttttttttttttttcttgagacagagtcttgctctgtctcccaggctggagtgcaatggcacaatcacggctcactgcaacctccacctcccaggttcaagcgattctcctgcttcaggctccagagtagctgggattayaggygcctgccaccacgcccagctaattttttttttttttaagtagagatggggttttgccatgttggccaggctggtctcgaactcctgacctcaggtgatcctcccgccttggcctcccaaagtgctgggattacaggtgtgagccaccaggcctggcctgagcttcagacattaagtgacttgcctatgttcatgcagtaagtgacagaatcaggattcaaacccaggttcgtctgactctactaactattccaaacagtgaacctgaagttgagtttaaagaccacagatagaagagtcaggtgaacctggaggtattaactactaactctcccaaacagtaagcctcaagyagagtttaaagaccacagatagaagtcaataccttgtttgatatgttattgatacatttcactgttagctcctragaatacaataataagatacagtaacttaaaacattaaattaccaagrttatgagacaggatataggagggaaaatagaattttttcttcagtaacaagttccttccaaatagtggtgagaaactattttaatcccttttattgctcatagtctgtaactaataaatgytgtacttagtttgggacttctacatcaagacagtaaataagrtgtaatcatcatagggcctctacttctattataaactgaaaaactattgaagttggatccaggatcagtgttcagactttgatgttaccaccaaatgaacacaagatactagaggagagagaccctaggatcaggtcaagccctgatccctccattggccaaggacttcaaggccatatcaatctatagggattaaaagatggtgccattggctccttaaaaagctttgtaatttcaccaggcaatgactgtctccaatgactgcaaattagagttttattggaatctttgcacaagagaatgggctataccttttctcactcaggcaagacctttgataggtcatttgcccttctcaggaagccaactcattcctttggtacttaaaaggcagggccagtgagctaacagttactgaattaactgcaggtcaggacagtaggctcacctgactggagaaagcagggcaaggtcagggagccacgtgatcctgacactgctgacaacatggttgcaattttcaggaagttgtctctttacaccgttttcctcaaattttttccaagatgaatgggttttttttttaagagactaaccttcaccttgcaagagaattatcttctgtgcaatttcttggaagccagcatgattcttttcattgttctttaatgatcatttggatatttttacatccacagcaacttttaccacacttgctaaacctgttgtcggtgtttaatttcttctttatcttgatgaaccaaaccaagactagagaactatcagtagtagagattacctgtcataaaacatggagaaaaccatgtacaggagaaatgtgattaaggagcataagccctcttttttttgtttttgaggcagagtcttgctctgttgcccaggctggagtgcagtgtagcgatctctgctcactgcaagctccgcctcctgggttcacgccattctcctgcctcagtctcccgtgtagctgggactacaagcgcccgccaccacgcccggctaattttttctgttttttagtagagacggggttttacagtgttagccaggatggtctcaatctcctgacgtcgtgatccacccacctcagcctcccaaagtgctgggattacaggcgtgagccaccgcgcccggcctgcataagccctcttttctggttctgcttaagttattcatgcactgaacataaataggaaatgtttgctggccaataatagcgatagggtgatagaacaggcatgttgactgtgggcaagtcacaatcataaaaggagaaagtcacgcttttagctgacatgtttagcagatgatagaatatgtaaaagaggccaggcgcagtggttcatgcctataatcccagcagtttgggaggctggggcgggcagaacacatgaggtcaggagttcaagaccagcctggccaaagtggcgaaaccccgtctctactaaataacaaaaattagcctggcgtgatggcgtgtgcctgtaatcccagctactcgggaggctgaggcaggagaatcactcgaacccaggaggtagaggttgcagtgagccaagatcatgccactgcactccagcctgggcgagagagtgagactgtgtcaaaaacaaaaagatgatgtaagagactcacttcatgaagcacatgcgcatcaatcacctggccagggtactcagcagaccaaaaaacaagtagacgccctgattttcaggggtcccttggccttttgaaaaacattttttcaacctgtaattgatttgactttcaacacttagctgcagtccaatgcagaaatctttaatgcacctgtttagaatatgctcttcctgaggcttagccgtggatccttcggcactggatgttagggaagggggtacgtttcggtaaacaatgacagtgacttctgtttggaaccatagtttctttgttggaacgaagctcaactcatataaggagtttggaaccccctrccggacttacaacctccaacttctctctaatgaggctcttgggagctgtacaaaaaggtgaggctggagtttgactgttgtcttctgttgcrggttctgggcatttsgaaaagtttctcttcgggctgttaagcaaggctaaagaggagaggaaaaaaatgttaaaatrtgtgttgycttcctagttttcyatttgtctgtgttcattttggagttggacataattgaaagcaccaaagctaataacagctaccatttaytcaacagcttgtattttttaatacctacccccaactttcccttgcccacattgattgtgcctcctcccaaagccagaaaractctaaacctcaagttaaccagttgtattagcctcctcccactaaagattttaaccaagcacccaaaacaagagtaactaatttgaatctagtcaagttaaggttctttgatgttagcctttatgtgtttaaaatatgtgcgtgtaaatctctgaattacagttccatcactcaggctaactgggaaaacttgaatgactcrcggatactggccctagtttcagtygctgtaacaacaagcygtgtttccttttgaacaggctggatcaggtgcaacaccaccataaggaagagtggattcggtggcatcackatgctcttcacaggatacttcgtcctgtgttgtagctggagtttcagacgtctgagtaagtctttctatatttctagcctaaataacaggtcccattccgttatgtggacctccaagggattctctgaattttttttttttttttttttttttacagctttacagtatctggcatgccctggtgaatgagctattgcctggggtttctgggttttatttttttgagatacagttttgctcttgttgcccaggctggagtgcaatggcacgatctcagctcactgcaacctctgcctcctgggttcaagtgattctcctgcctcagcctctcgagtagctgggattataggcatgcaccaccatgcccggctaattttgtatttttagtagagacggggtttctccatgtgggtcaggctggtctcgaactgccgacctcaggtgatccgcccacctcagcctcccaaagtgctaagattacaggcataagccactgcacctggcaggctctggggttttattagaggcttggttgtaatggcctgtataagatttgactagaatttacataattgcccttgtcctccatttcatgttgtcttttttttttttttttcccacccaggctagagtgcagtggcatgatctcagctcactgtaacctctgcctcctaggttcaagtgattcttctgcctcagcctcctgagtagctgggactacaggtgtgtgtcaccatgcctggctaactttgtttttgtatttttagtagagacagggttttcaccatattggccaggctagtctcgaactcctgacctcatgattctcctgcctcggcctcccaaagtgctggaattacaggcatgagccaccgcactcagcctttgtagcttttttcccttccctgctaaaaggtcaggtacctaagaactgttaccctgctccaatggaaggtgcttttccttggtgcctaagagcacctttttggcattgaaaccaaacacctttacaccacaaaagagagaaggaggaatagaatacagctgtcacttaccaatgtgtctaagtcttattgctatctcagttaatctrctttgaacacttaaaaaacaaagtgccattctccaagtttcagcttgcactaagtcttaaccagaaggaaaataccttaatttcatttatcttaattcaagatgtgtttgttcatttcttattgtattattaaaaaaatccttctagttaaaaagatgagtgggtatcaaaaatatcagcatttttgtataattaaatttttgtgctggtttttgtacaatcaaaaaccagtattttggggccgggcgcggtggctcacgcctgtaatcccagcactttgggaggccgaggctggcagatcacctgaggtcatgagttcaagaccagcctgcccaacgtggtgaaaccctgtctctactaaaaatacaaagattagctgggcgtggtggcgggcgcctgtagtcccagctactcgggaggctgaggcaggagaattgctagaacccaggaggcagaggttgcagtgagccgagatcgcgccactactccagcctgggcaacaagtgaaactgcatctcaaaaaaaaaaaaaaaaaaaaaaamccaccagtatttttgtacaattaaaacaaaaagcccactttcagatgaaaacttcaggtgtaaaagtacaagataacgatgaattctgaaggccagcataattcacacactggacttcttaagaaaaaaaaaatcacaatttgatgctaattgggattcgtttgatgaaatcagtgcctagtgagtagcgggtaggtccgacagcaggaacaaggcggcagcactcctgcatgctggctgggatggcctcgccgccatctcttgtatcagacacctggccatgggtgaggaaaagaagtgcctttctgatcgtcctgcataaatggagaggcccaaaaccaagagtcatttctcccacagagaaaagggcttttcttaaagttttaccagtctgaaagggattgtttgatacctgacattaatgaacagagactgaagaaagtgaaacaaacttctcattgtgcttaatactctatttctaaacttataaaacaaaaagagaatgatctgtagaggcaaaagatagtaacagtcattggaagtggcctctcggatycttacatttgtctctgtttatccaaagagctgcagcggtggcgtaagtagtgttgacctggacatcacttaaagctctggaacagcaaagggcgtacagtggagacgactgcaatacatacttaacagtttaaaaatgtataatatttgggacagggagaggggagtgaaaaaaataaagaataaaattattggaatctaaaataatgatacaggaagtaaacgtattattaatatagacagatctggttctgtctggatgttcttggcttgctctcaggagcaactgagaattagagaaaaactagttttgtttaaccataaagttgttattcaaggagatgtgaagatgacaaagttcatcactaaaattaagaagtcacttctcagtaaaaagctagtatctcattaccattcagctatatgagataccagactactacctatatgttgatacaggaaagtatctgaattggcagaaaataagcccacatcaggcccttccccttagtttctttggggcccttgaccagatcttgataaggtgtgagaaacacaagagctaaggatgggcattcgagttgcaggtaagcctccgaaaaaaagcttacaaatatttttaagctgatttttaaaatagcacactaactataatgttaaatcacattttatacatcttaattgagtataataatgaaccggtggctaatgtatcatctcttcctggaaacttttcagaatcccacccctatctatccctttctcaagagtttctgtgcattactgagaaattcctctccatttgttagggttgtttttggctggtgggttttctgtgtctcttcatctcatcaractattcagtgtctgattttttgacttctgctttggcccacagagagtaacttggatacttacaggtagaaaaagctttgaggaaatttaggcaacgttgatggataagtgtttccccaacctcctttctaacgtagagggttagttatatatcacacgcacacacccgtctgtctcagctttgcttgtggtgtcctcatgccaaaatacatgaggtcagttcctcttatgtcccagctcttttaaaactacaggaatgctgggtgcggtggctcacgcctgtaatcccagcactttggtaggccaaggcgggcggatcatgaagtcaggagttcaggatcagcctgtgcaatgtggtgaaatccatctctacaaaaaaaaaattgtaaaaagtagctgagctcagtggcacacgcctgtagtcccagctactcaggaggttgaggcaggagaatcacttgagcccaggaggcggaggctgcagtgagctgagattgtgccattgcattccagcctgggtgatggaagtgaaaccttgtctcaaaaatcccaaaaaacctacaggaaagccacagccagcatgtgttgacttgtatgtcgtttctctctcttctcaaagctggaatgctggggctactttttacctaccttttctattcccaatcccctgctcctttccatccctagtgggagtaatttaattctgcaacaaattctcatagttaaggtattcagcaatatatccctgtatcctagaattctctgtaaggaaaaaagttgtggttgaggggaagagttctacattcagttattttagtttaatattactargaacttcattggaacccagaacaatcttccctgccgaaagagctttgtgcccattctctgtgaatgctctttaggagagatgcttaaggattctctccacacctccccatgtgtccttactcaagaccagaaactctcaaggtgagaaggtagatgagaatgaccttcagtaataccctctttcccggtcccccagttccctcgagcaggggcagcagaccccactgtgacccacggaccaaagccagcccactgccttgtttttgtatgtagtcaaaatgtacaaaaacaagccctgctcatttggttaggtggcatccatggctgtttcacacaacaacagcaaagtcgagtagttgcgacagaaaccatatgccctgaaaagctgaaaatatttactatctggcctttacagaaaaattgtgccgacccctgccctggaagagcacagtacctccatgcattggtgtggcgaagacgactggggattgccgctctaaaacatgtttggattaggaagcacgtttaagtaggagaagccttygtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatcagggtgctgaaacataatgaaaaggtttaacttagtcacagtaaatattttatatccctgaaaataagttatttaatgagaatagaactatttaatgatccatgagtcctaaaaggatatctgccttgtattgccaagtttaaggcaaaggtgagatcctgtattaataagaagacagcttttttgtttgacattggtaagtaccaagaattctaactcacatatagtaggaaacaacaaaaagtctccactgacttctttgaattagatactgagaatccacaatacagtagtgtggataactttcaagaagccattggaaacatctccacattctgggatgacttgtaaatgtctacagagtaatggaaggaaaggcttccttgtctgctcattgctgccacctgggttgggaaaataattgaagatgttttctcaagtccttcaagaatctcttcttaatgttcagaatagtttaagagcgttgttgaggtaaastgatagctgattattttctgagatttagatctaaacaaactcagcatgacgaggaagcacacttcacagctccagggtgcaatactgatgtaaagttgcctcgtgaggatacatttttcgctcatgtatgcaaaattcctatcagttcatttgcacagccagttccaatcatgtatgtgatcaccagattaaaagcttcatccagaaagacaagactcctcagaacgaatagtagacaagtaagactgctacccacagaagccagtacgcttcaggtgtgaggcggggtaactactcatctcttcacagagccaaggaaagaaaaagaacgtctctaacatgatttaccattttaaacagccttataagttttgtctcttaaaatcatgctgcagaaggagggggtaaaagtcgtgttctgccctgtctgtggcattggagtgccccgctaggtaagaagcaaygcttagatcttgcttccaggcagcagcttgaattcccgaatcttcctgcaaggtgcatacaaatgcagcgtkagaatccatacacgtaatccatattcaccttcccatccatcccgcagaagaggcatggtgacacccaggctactgtccatgcttgagaggacgtatttgaaggttctgttactacaagttgggaatattcacggacatgcctgaataccccggctgtaactcacacgtggtctgtgtaagtggattaacctcggggcggccttgtttaatcctgaataatatctgaaagactgagtttacttgggaatgtgtagtttttctaatgcacattaaaatttattttagctgttaaaaataaaatcattttattatcagcagactcttttatactttatggggcatctacatactacttccgccactcttcataataaaattatttgtaaaatataaaaagtactcccctgagctgattatttgcctcttctagagcctcacctgtgaaatgggtgggtgtgtccctgggtaagttacccagtttactggagcctcctttgtactgtaatttagggataattattcctactttgcagacatttggtgagattagaagtcttacatgtgttaattccagcaacgtctgtgatggtagcaactcattgacagcagctgttctaaagcctgtagtatgtgccatcatactatatataaattccaaccttgaacggaggaagagaggccctactgcaatccacaggcagatccagccaacatctggggcttgctttgtgccgagtgccatgcaaggttttttacatgcgttttctccttttagtttcaaacagtcctgtggcgtaggtgctatcctgctcattttccaaaaagaaaacgggcttgaggtagagtgatttgcctacgtagctctgtgctgttcatcacatagcagcccccattggtttgaactggcattcaaccccccaaaacccgactcctgggctccattcttttagactgccctgactggggactccagctccaggcaggccaggcacctgtctttttaccaaggtggggggccagttcttcctcacacatcccattgctcttctccattattccaaaaggctcagcacagccactaccccccctttcccagtggattaagttgcttggtattggcctttcatgatggcattaaaagatggtaataccgttaaatttttgtgttactaccttacctccccaggataagcctattttattccatctactgccccataatactccacacataaggtacagagtatattcttagatttaaataagccatacagggaagcagctgtcatgctaaagaaagccatttgagttaattgccagttgatagcggcagctgaagccatatacagaggagctgccacgtgcaacccagacctgttggtaggagctgagcaaagtataatgatcgtggatttcccatagactcgagcttttggttttatgtacattttgctcccgttttatggataactcgttcctgccaatctgcctccaaacctgttgtatttttagtagctcgttcacttacaggatcaaaagaaataaacctgcctgccacaggctacttctgcacctcactcataccctgcttaggatgacagcaggcttactgtggaacttgggaaacagaatcccatagtaagaccattgagcatcttctcctgaccataggttagtttttaataactcctatcagttgagtcttactgtacttactggcataatggcctggtctttgacacaaaaacagaaaaagtgaatggcatgactttttgtaaattcagatttctaaagatgtctagggaaccataggagatggttagctacctttgtgaggaattggatggattctgcttgttggtgaagcttatttcaggcattcaagcccagcatcacaatcccagagaacgaggctggcacataaaagcaactgtacaagaaaagtcaagggttctgccactcttacctgtcatcccaataaaactattctcttgcagaatggagactgcaaagctcaggacagtttagaagctatgagaatgaagatatgatcaaacatgattttttttctttctgataaaccagaagataccagaaaaaggaaccaggtgatacgttccctcccttaaccatactctgccctcctgccaaagaagaattttaaggacgttatgtacaagtaactgaagagtagtaggcaacaaagtgggaaatgactgttccttttgcaggaacagtcttgtctagcaggagatgccaacaggatggtttacagtatcctctcattctcccctaattcacactcctatctgctgcagaaaaggagtcattctccagctccctgatcattccttgccctcccagctctcagccaagcactagcccagccctgtgggttcctttgtccaccctgtggcacaggccctgcccttgacccctgatccccaggcaggagagcaggcactctgttggggatgggggtttccaagcttccacagcagaaataggaggtgctgaatcccggggccggctggcaagctacagctgaagtgcagtcgtgagaaaacacctactgcagatagtccctgtgtgcagacaccaacttcacagagggccgggacgctggccatgcatttagggtgaaaccagggttcaagatgcctttagttacagttttaagtgccaaaagcatacctttccatcaaagttaggctttcattgtaaatgggcttgtaaattccccgcagtcccacagatcgcctcccaccttctttcaaagcctgctcagaaccagcagggactgtcttcctcccaggccatcaccctcccagcatccagtgctcggaggccccagtagccgtcagtagctgccccagtgttggcgctgtctggcctctgtgatacttaaacaggtgtccaacattcagtcatctagaccaggggtcagcaagctttttctatagaacaccaaacagtgcatattttatactctgcaggctactgggtctctgttgcagccactggactctgccattgtaagcaccagaacagccatggccatgtcccaacaaaaccctttatgagcactggaattaatttcacatgtcacaaaatattttgattttcctcccactttttacaaaccattcttagcccctcgcctgtacaaagacaggcagcaggctggacttggcccacaggctgtagtttaccaacccctgacataggtgctcatcaacacttgggtctatagagtgtgtgtgtctctccatagggactgagcacagttctcaatcagggccagccctgattccaaaaaccatgcgtgctacccagctagcagaaggaaagccttggactggtcaacagagaagtcctaccctacccacagcagagattctagaggttggagagtagtctgggaggaacaaccacatatatgtgtcccacatgcatgatgacatgcctttcaaaggagagtgagggttcgctgggaaccatgcagtgctgctgggtgagcttccctggggagcagaaaggagtgggaataaagggatgagggatgacggcacgtgcctgcctgcactcaccttcatgtaactcgggttgagtaaaagattcatcttgggactaagggaagtggagagagagacgattacagcccagctctcgccctcccatcttctgctcattaacatgctctgcgccagcctgctgcagatttcatatttcagaaccctgtagggaagttgccctcccttagccagggcgtgagggagaattacagaggactggggagaaatgggcattaagtgtttcttctcttattactagaacagtttgtgaaaagatcgacacctatccccagcatgaatacacattaagaggatgggttagagttctgagattgccagggtcaggcagtggtgccaggaaaatactggagcggatgcttgccagatgcttcattttccactaaggaccagcgaaggtatggaaagatctagaactagaaggccaggcctagcactctggtgggagttggtaactgagggatcatacttactgagcaaattggcacttgggtccctcggggcagaagccaactaaatagttgagacacattattctggggacatggcggtatttacacagaggacctgctgagcaaagagaaagtgatgagaaggatccgcttcagcaagaggggaaaacacacatgaaaaagctccctaggaagggtgtggatggtcataggggcttcacttaataggggtggataaatcttcccatcctttctgtaccaccctaaagcatccacttctagccatgagacagggatggggaaaaggaaccttggaatgtgctggagcaggtgtcagctggcaagttctgaaatagagttggaaatgtcactgacatgctgtgtcctggaggacttgcatggatatgaaccacactttgttgccttttatttatttaagtatgggaggtacagctgagaaaaagctgacctggccgggtggggtggctcacacctgtaatcccagcatttgggaggccaaggtgggtggatcacttcagcccaggagttcgagaccagcctgggccacatggtgagaccctgtctctactaaaaatacaaaaattagctgggcatggtggcacacacctgtaaccccagctacttgggaggccgaggcaggagaattgcttgaacctgggaggtggaggttgcagtgagccaagatcgcaccactgcactccaacctgggtgatagaaagaaaaaagctaaccccacaatcctactgatcttctcagcagccctcacccccgcccagatccctaaaaccaacagcactaagaactccgtaagaaaaacctatctgaagacaaaggagagggagaaaccctgttgcttagggcatgggaaccctgctggggtaagctgcctcttaaatttggctggcagcaatgggaaaggtaggacatgcttaagcaacactcaggaccccccaggtgggtaagtggaatgcggaagagagcacacatgaactaagcgtctcctatgggcctgaccctgtgtcaagagcttcctgtgtggttcagtaacttggagaaaggcatgcagctgatacatgctgaaggtaggatttgaacccaagtcagtctgcctcaagcctgttatggccccacaccaggctgtgttttgtgtgtcacagcagagctggaggagaactacagaaaggccttctatttggggtttctccaaggcacagcctcatcaggaaaatggcccctcccctgctgagagctcccaccctgatccccacagcccctagggctccctggcttccaaggcctcaccgtccttgcagaaaccttggtcataccaaggacagtcctgggacttgaaagctggcttcacatggaggaaggaacactccttgttgctgcagtcacctgaaaatcccagcactctctgtagaagcagtttctctttgtgatcacttctgtgtccccaaaccagattgaccttgcccctcacaaacacagaagacactggcctttattctgggagtcaccagctttttgaagatggaaagtatgcctaatccttgctgcagtctaaaaagggtggatcccagtcctatttgctaagcagggcatggtctgaatatacacctctggaagagtaagagtgggggaccccagatggagaaggaggcactggaactgaaggccattagaggctagcaggaacaaggagagccgagaaggcctgcgacgttaagtggagatatttccatgtcgctgtaactgcagccccctcttcatctctactacaaaacccatgctgcctgcagagcctagggaagctgttccccttggtggaaatgcaaagaaaagcagagccctgctcaaggtggcacaggtatgaaaagaaacattctacagagtgggcacctgcattatactaagcctgcgtcatcatctctctatggattagaccaagtctcaggtttagtttatttcctacagggagccagcccagtaggcccaggctacccaagtgtcattattattattattattttgagacagggttttactctgttgcccaggctggagtgcaatggcgcaatcttagctcactgcaacctccgcctcccgggttcaagcaattctcctgcttcaacctcccaagtagctgggattacaggcatgtgccaccacgcatggctaattttttgtattttagtagagatggggtttcaccatgttggccaggctggtcttgaactcctgacctcgtgatccgcccaccttggcttcccaaagtgctgggattacaggtgtgagccaccacgcccggacccaggtgtcattt

SEQ ID NO: 10598 - DNA, 22207 bp, Homo sapiens
  misc_feature (1)...(22207): n = A,T,C or G, or insertion/deletion polymorphism (see Tables 1-2)
tgagatggcaccattgcactacagcctgggcgagaagagtgaaactccatctcaaaaaaaaaaaaaagataatggtagaaataaaagtttaacagaaggattggaaaatgaagctgagaaaatatatcaggaaataggaaaataacaaaagacaagtaaatagaaaataggagacaaaagataagaaaattagaagagcaatctaggaggcccattaactaacaaaagttccagaaagatgccaggtgctgtgactcatgcctgtaatcccagcactttcagaggctgaggagggtgaatcgcatgagcccaggagtttgagaccagcctgggcaacatggtgaaaccctgtctccactaaaaatacaaaaaaagttagccaggcatggtggtgcgtgcctgtaatcccaggtactcaggaggctgaggcaggagaaccgcttgaacccaagaggcagaggttgcagtgagctgagattgcgccactgcactccagcctaggtgacagagcaagactccatctcaaaaacaaaaaacaataaaccaaaaaaaaaaaaaaccaaaaacaaacaaacaaaaaaacaggtcacctacaaaggaaaaggaaaccgaatgtgagtggccttctcagtagcaacactgaaagtgagaaaacagtgacccaatgcattcaaagatctaaatgaaaagcatttccagagaagccctactcttagccaagctaataatcaaacaggagggtaaaataaaaccatcttcacacacagtctcagagattttatctttcacgtaccctttttctctccaggaaactattggagaatgtactccaccaaagtgaaggtgtacacatggcaagacgacaacctgggatccgggaagcggaggtgagaacacaggaggcggagggaagcttggggtgatggtgagggggactgcaccacagcagtgctgcaggctggggaacagcccaggatgcagccagagggcacagcgctccagaaaagaagcttcccccaaaaccagtcattcatagattcagtcatatgtttcatagctctgtcggagtttgggaaaggatgaataatggcttgagagaaatctaagcaaatcaataacagaggcaatttttaactccaaaaagaaatttgtaccaaaatagaactatgctacactatgtgaacgcttaatattgccaagcacagtggctcatacctgtaatcccagcactttgggaggccgaggcgggaggatcccttgagcccaggggttcgagaccagcctgggcaacatggtaagacttcatcactacaaaaactgaagaaacttagccaggtgtggtggtgcgtgcctgtagtcccagctacttaggaggctgaggtgggaggattgcttgagcccagaaggtcggagctgcagtgagccaagatcatgccactgtactacagcctgggtgacagagtgagaccctgtctcaaaataataacaataataatttaaaaaccacttaatattgatttaccaagaatgatcacataactacattgaaagaatgaggtcagggaaaattatatttttgttggggcataaaatggccaaatcatcattttctatggtagaaaatgaacagttaactatctaaaattttaaaatatcataaaacagcaggattaacttcatttaaagtaggacttgggggccacgtatggtggctcatccctgtaatcccagcactttgggaggctgagtttgggggatcacttgagcccaggaattcaagactagcctgagcaacataggaagaccttgtctctactaaaattaaaaaaaaaaaaaaacaagccagggatggtgccacgcacctgtagtcccagctactgaggaggcgctgaggtgagagtgtctgaggctgcagtgagccctgatctttccattcactgcactccagcctgggtaacagagcaagagaccctgtctcaaaaaaaaaaaaaaaaaaaaaaaaaaggacttgagaaatctttttacgattgtaagcctataaatttcacttcttaaataattcacattttttgattagaaaattatcccagcttctcaggaaactgaggcaggaggatggcttgagcccacgagttcaggtccagcctgggcaacacagtgagaccctgtctctaaaaaaaaaaaaacaaatgtaatatgattaagttaatcaaataagaacagaagtagaatgaatatactccaaatcagattccagaaacatggaaccagagtgcagctatgacaggtgcctatgctggtgaattggtggacagataatggtagatttagcttaatactcatctcatctctatatatatatatatatatatatttgtttttgtgagacggagtctccctctgtcacccaggctggagtgcagtggcgcgatctcggctcactgcaagctccgcctctcgggctcacgccattctcctgcctctgcctcccgagtagctgggactacaggtgcccgccaccaccacgccccgctaattttttttgtatttttagtagagacggggtttcaccgtgttagccaggatggtctcgatctcctgacctcatgatctgcccgccttggcctcccaaagtgctgggattacaggcacgaccaccgcacccagcctttcatctcaatatctttctacagtcctccctacattgcacaagctgaaaggtcgaatctacatttcctagatgaccttgtggcagggattttggacacaattttggtttttccaatcatttcctctcatgagatgtataaggtggaggtgaagtgaagtctgtgtgtgctatttatgctggggagtgctgtggtggaggtgtttgatttttttttttttttttttgagacggagtctcgcttcgtcgcccaggctggagtgcagtcgggtgatcttggctcacagcaacctctgctcctgggttcaagcaattctcctgtctcagcctcctgagtagctgggactataggcgcctgccaccacgccctgctaatttttatatttttagtagagaccgggtttcaccttgttggtcagactggtctcaaactcctgacctcaggtgatccacccacacctcggcctcccaaagtgctgggattacaggtgtgagccactgagcctggccttttttttttttttttttttttttttgagacggagtctccctctgtggcccaggctggagtgcagtggtgtgatcttggctgactgcaacctccccctcctggatttaagcaattctcctgcctcagcctcctgagtagctgggactacaggcacacgccaccacacctggctaatttttgtatttttagtggagacagggtttcaccatattggtcagggtggtctcaaactcctgacctcaggcgatctgcccgccttggcctcccaaaatgctgggattacaggcgtgagccactgcacctggccgatgcttgatatttctgcagtggcttctcatcatgatgatacctgtatggttcaagagctggtaagtgtagagacagctttccaatttagtagatggcttcctgatttcaaaagaggcagtgtctcctttggtggctcagtattgcagcatagctctcaaagtcattcctcaaagttcaacctggagtcggttgcttcagccctccaaacaagtctggaagtcattttataccctgtaatatattcttttgtacttaaaccatctagaatggttctgttctctgaaacttgacccaaacaatgtaacagaaaagcagaaataaaatgtaaagaaaaatgctaggcgcggtggctcacgcctgcaatcccagcattttgggaagccgagacaggtggatcacctgtgatcagcagtttgagaccagcctgaccaacatggtgaaacctcgtctctacaaaaaatacaaaaaattagcctgcgtggtggcgtgtacctgtaatcccagctactcaggaggctgaggcaggagaatagcttgaacccaggaggcagagattgcagtgagccgagattgcaccactgcactccagcctgggcgacagagcgcgactctgtcttaaaaaaaaaaaaaaaaactagccgggcatggtggcgcaagcctgtaatcccagttactcgggaggctgaggcacaagaatcacttgaactcaagaggcagagtttgcagtgagctgagatcaggccactgcactccagcctgggtaacagagcaagactccgtctcaaaaacaaaccaacaacaaaaaaaaagcatggtaaataacacaaaatacaacagaaaaaaaaatccaattataattaataaaaatagctaaattctagctaacagagatatattttcagaatacattttctaaaaagtccagttataggctatgtctgagagacaggtgaaaaacataatggaatattatcatataaatgaattgacacaaatatatctcgaaaacataatggagaatgaaaaaagatgcaaaatgattattcagtatggtgtcatttttgtaaagtttaaaaacaaaattaggtattccatatagcattgctggatccccacatcatatgtaataaaagtataaaaacacaaactggaatgatatgtaccaacttgagcacggtgactatctgtggggcggaagaagaaatgagagtggggccgtcgttatgactaattttgtatgtctttaataaatcccaagtacatgcagcaaaatgtattgatgtctgtttaatcttgatagtggggggcgtgggtagtattaatattattttccgtactcttccgtaggcctctaatatttccctctttacagaacactgacacacgctcagggctccccgggacatctttgtgcacatcaacatttatgctgagagtagcttctggactccaaagaggaaactccccgggcactgtggcccacgcctgttatcccagcactttgggaggctgaggtgggcagatcgcttgagcccaggcgttcgagaccagcctgggcaaaatagcgagacccacccccgccccccattgctacaaaaacatttacaaactagccgggcgtggtgacccccgcctgtggtcccagctggtcgggaggctgaggtgggaggatcttttgagcccgggaggtcaaggccgcggtgagtcgagatcgcaccactacactccagaccgggcgacagagaaagacatccattcactcccccaaaagaaggggaaattcgctgaggctgagcgctggtttcccaaggtggggctggcacctgctgaagctgccacaggagtggagaggccgtagggagacttggaaagaacctggaaagggggccggggctatggagccaaggctgcagcagggctggatggtgtttgtagtttgtgcagaataggaggcagtttttaaagccgagatacagctctggttgactggagcggggaggggtgggtgtgagaggtcaggaaaccagcggctggaggccgggggcctggagcggcagggctggcgggcagacgttaggccccaggcaaaatgggcgcaccccctgcgggggcccgaggtgacctgctcgaggtccggtcgcccaggttccacctggagaagaaaatcttcgtaatttggctgggggaggggggatgcgggcacaggctgtgttctccacgtcgcgtagacgcagaggccatccctgggtcggagagtctccgtggagtggcaccccagcgttccccgtacgccggggccgctttgtcgggctgacgggggtccctccgggtggccgccggcggcgggtcccgagccagaccgggaagcggggagcagccctcagcccgcgagcgcggggccggggcagactggaggccgggcgggccccgccgagggtggggcggggccgggcgcacgggggcggacctcggcgcgctcccggccgctcggtggctccggggccgcggcggctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggtgagggcccgggccggcgcgggcgggggcggccacggccgcgggcgggacccgcgcggcgggtgagaggttgcggggccaaggcgatggcggggccgggcgggggccgcgcccgggaaccggcggctgggagggggaccggagcggccgcggcctcggcgtttccccgcctggcgacacccgctagccgttcgcgatcccgggctgaggtgggagggtcgcccggccccgtgtgcgggaagatgggcaggggtgaagcccgtggaggcgggcggccgtgcgagggcggcctgagggggaggaggacgaggagccccgagaggaaatcgcaaacagctcggaggccggccgggtggcgcggcgcggcttctggtcgctccgaacatcccccaccatcgagccctgctgttctgccggcgtggaaggccgcgggcaccccagggtcccacgcgctcgtrgggggagctctgtgcacaagtccatccagggcccggccctggggtggctcgggttgttggaaccacgacgggattccgtgtcgagtgtgaggctctgctccttttactccttggaggtgctttatcgggtccagtttactttgttcggcccgggatatttagtgagaactgacaagcgtcgctggtgactggagagggacctggaggaatgagtaaggcgcgagccgggacaaacacctggagaggttaggtaaccgctgagtgaggcagtggaggatggagagccaaccggagtgtccgcgcagggttgcagagaaggggggtcagcaggagtggggctggccttgaggatcctgaatgctgaccttggaggaccatcgggaggatgggggaggatctgcagattctgggggactgaggcgggggagacagtttgaaggagagctgagagcagagttgcaaaccagctgagttgcagacacattattttttggccagcgcagtgtttgggaaaaattattgaatctgttgccagaatttttaaattggaagacttccacacaaaatccaaatttccgtattatttatttattattatttatatatgttaaaaattgggagacctggtaacactaatcctgaattcctacatgacagctaccgacctgctggagctgggtgatgatgaaagggagctgagctgagctccctttcaaatggagtaagaactctagtttgccaccgtccactctctgtcacagtcccccaaggggagattaggtgacagttgccatttatactcatgatggtgttttctttcagtgaagttaaggaaaaagtgaaatatttcctgtacttacatttctgttcacattgagaaaaaatatatatagagagagaaagaagctgaagatttcaagaaaatgttttcttataccctatcagcttcactcattttttacctgcctggcatccactggcatttacatctgtgaccttggttagattcagagatgaactcgataagctcagagcacgttgaaaagaatgggtgggtgaaagctgaggattagtgttggggcctgtgttgttatgtgtttttaaatacatactgtacattgtttatgtacaaatacatgcactgtatatgtctgtatacttatggcggatccaatctttcacccaattcatgaatcttctttaaaatatccctgacaggtgtggccatgagtaatatacagactctcttttaaaagcaaaaatttttcacagatcctcactgtttacttactttcaagtaaaaaaaaagtgtttacttactttagagaccctgctatagctcagggtctcttgaatttagcaagcctaatcaactgtggcccatatgataattcagtcaccactttattctaattactacaaaattatggtgtcattttgcccttcacctggtacagggaatcatttacatattaattctgyccgtgttttcttcttggccagttaccagtaaagtaacactgcttggctccaccgtgttcataaacacatctgtaaatgataacactgaatttggctactaatgtttgcttatttaaaaatcttaagggttattttcataaagaaatcacaaaattagaatacttctcatagagaactcttagattcccagcatgtctatgaagaatgcgtctctaaggatccaaagatcccagttggaggagtatctgcctagttcataattggtaactgggtggcagatatactgacttttcattactagcccatgacagacatgctaattcctgacttttcattactagcccatgacagacatgctaatcgatagggcagacattactgatctatctagatgctctttcccctctgagcctgtgttgggattcaagttcttctctacatgatcaaagcaatccttcagagttggccttacttacctattcacctaggcgttacttatcctattcacctagtgggtaggatagactagactgtagaggattttctctagctttagaagtccggcattatcaggaagcagtgggaaaattttgagaagggagtactaggaggaggagttgagtggtggtacctggaatggtaaagagagggaagaaagtggggtcgggcgtggtggttcacgcctgtaatcccagcactttgggaggctgaggcgggcagatcacgaggtcaagagatcgagaccatcctggccaacatggcgaaaccccgtttctactaaaagtacaaaaattagcctggcatggtggcgtgcgcctgtagttccagctactcgggaggctgaggcaggagaatcgctcgaacccaggaggtggaggttgcagtgagccgggatcgcaccgctgcactccagcctgggcgacagagcaagacttcatctcaaaaaaaaaaaaaaaaaaaaaaaaaggccgggcgcggtgggtcacgcctgtaatcccagcactttggaaggctgaggcgggcagatcacgaggtcaggagatcgagaccatcctggctaacacagtgaaaccctgtctttactaaaactacaaaaaaattagccgggcatggtggcgggcgcctgtagtcccagctactcgggaggctgcggcaggagggaggctgcggcaggagaatggcgtgaacccggaaggcggagcttgcagtgagccgagatcgcgccattgcactccagcctgggcgacagagcgagactccgcctagggaaaaaaaaaaaaaaagggaagaaagtggttgcaggtatgcctgggaagaggctgttctgttgttcatttattaatgtattcatttgtcagtatttgagtgcctactttgttgttaatggggtgtgtgtttgtgagggagaagagtgaaaacatggggctgtcctttaaagatcttactgatttgttccacaaatttacttactgagtgagtccttagtgtgtgccaggggttaggatggacactgggtatatagtaatgagcaagcaaaacacagtgtcccagtggattttaggatttaatgaggaagacattcatttaataagtaaggacacattttggtgaatatcaccaaaacagaagtaggtggagctctggacctgtatggtagggaattctcacctcttccagtggcctaaaggctcagggggagtgggggaggcattcgagggtttgtgtgttgagggagggaatatgttgcaggtacagagaacagagattcagtaaaagaggatgaggaggggatgtgagatgaggctggaggcattcatagggatcaggttgtagagacaggatttggaacttgatcttaagggcaatgggaagtcactgaaggggttaaactatgtgagatttgcttttttaaaagattcctctagctccagcgtggtgggtagaagagaggaggaggaggattttagtaggagatgtgatagtggcatttactaagatggtggcagtcgggaggcagagcggtgagcagattgatacttaggaggtggaaagggccagattttgtgaatgggtgaggaaggtgagaaagagggagggctggaaccatttcagggtgttcttcattaagtggacactggcaggagcaggtttgtgcggaaatgctgagtttgaggtgcctgtgaggcacataagtagagatggtccagcaggcagctgtttagatggttttgcagctcgagaaggaaggctgagctactgagaaaaatgggggaatttttgttatgtagccacagaagtagatttggctgcctaggaagaattgatggaacagatattgtaaactggtggcttaagttctgtattttgccctctaacatgtttttggttttggcccaaaatgtggttagttggttggttggttggttggttggttttaattaggactaacartgaatattgggattttatagtaaaatctggactttggtttcttttgaaaaatgagataatccaacgacactcacccgacatttctggacggcaccagttgcctggagctgaatggtggctgccccattagaaaggccatggatgtggtcttcagtttgccacagtccctaccaccctctaaggtattctttgcagtgatcccagactgcttcacttagattccctgcttggcagctgtaggcatttgagtttgttacccttgtcagaaggtgaactgtgaggccaggcgcggtggctcacgcctgtaatcccagcactttgggagaccaaggcaggcggatcacctaaggtcaggagtttgagaccagcctgaccaacatggagaaaccccgtctctactaaaaatacaaaaaattagccaggcatggtggcgagtgcctgtaatcccagctactcaggagactgaggcaagagaatcgcttgaacctgggaggcggaggttgcagtgagccgagattgtgccattgcactccaacctgggcaacaagagcgaaactccgtctcaaaaaaaaaawaaaaaaagaaagtgaaccatgaggagggcctaggagaagccaaaggaactaaggaactacaccatttgaaagggaggtggaggagctggccaagaaggcttgaagagcaaccagaggggcaggagaaagccaggagtactcttatgaagaggagggaatgccgaccagctgagcctagtgctgctgacttggtctgacacaaaagatgtgtcctttggtctagtcatgtggaggtcatcagaggaggtcatcagtaacctcggtgagagatgctgtattctcagggtgctgggtgaaaggctaattgtgagacgttgaggagtggacgggggtggggaatggagatagggttggaaacttattccagaagtttggctgtgaagagcaacttgtgttgmggaaccagaggactaactcagcatatcaccctggagtgttgattggacttgaatatttgcgcagactcattattttcatgtgaaaataaaccaatgataagacaatagatatgtcatagattagcgagctctcaggatggaggagagagagaagatggaaatattaggtttgggctaaatattgaggactttccttttgcgaggcactgtaatccctttcacatgttgttatctcacatagtcctcaaaatgagcctatggtgtgtatatctggaattttcctcatttttgtggatgagtaaactgaggcttagagaggcatggttgcagagctggtaagtggtagagccagggtttgaatctagctatcacagtgaatgtctgtatacttagctactttaatttccctcataaggatcttcagctgcttttactccctgctgtaaggtatcagtatcatttgttgaaaagacttttctttgcccattgaattgctgtggcaattttgttgcaatcagttggccatataagtgttggtttatttttagactcttttctgttccagtgatttgtatatctgtctttttgacaatagcacactgtctgtatattatagctttataataaggcttaaaacctggtaatttaagtcctctaacttasctctttttgaaaattgctctggccaggtgccatggctcatgcctgtaatcccagcactttgggaggctgaggcgggtagatagcttgagcccaggaattctagaccagcctaggtaacatggtgaaatccgtctctaaaaaaaaaaaacgaaaattagctgggcgtggtggygcgtgcctgtatttgggaggtggaggttgcagtgagctgtgattgtgacactgcactccagcctgggcaacagagaccctgtctcaaaaaaaaaaaaaaaaattgctctgactattctaggtcatttgcacatccataaattttagaattatcttgtcaatgtctctgaaaggacccgctgggattttggattgtaatcgtgttggctattgtgagacttttctcaamaaggaattaatgaggcctggatctcatttcctgtaggcattaaagaaaattccactragatgtgtgactgtaggccaaaggtcactaactcagtaagtgaggcaggtaaggaaaatgaatggaggggccaggaatgagatgatcatggcagctgatcctgggccatcgtgaagggataatagggtacagtgaggacttggcaaacacgatctaagggggtggcctcttctcagcttcatccagcratgccatgcaagaacatgggttcagtgttgtctgatctttcaatcaggagaagttggaaatccatatttttatgcagtgtcctgattttttcaattgaaatttaatacactgaatgggtcaacatctggtgggtaaacagaacactctaggtgaaatgtggcctatgggctgccagtctgtgacctcggccttaggctaatcattctttggttcacatgttcatcatctgtaaacatgaaggtgttgaagacagtctcaaagttctttttctagctcartgagtctaaatttcaaaagaggaaaatgtcaaaataactcagagtttgaagaggtagctgagatcagcaataatgataatatcttaagaagttgaccagagctttacatttgacataccactcttgtrtctgtgtcatttaatcctcactttatcttgtgcaggaggcrtcagagttgtttgcccaaccacacgggagttgcaggttacaaagtcacatcatccgattccaggtccagtgctttttgtttttttagagtctcgctctgtcgcccaggctggagtgcaatggcgccatctcggctcacggcaagctccgcctcccgggttcatgccattctcctgcttcagcctcctgagtagttgggactgcaggcgcccaccaccatgccyggctaatttttttgtacttttagtagagacagggtttcaccgtsttagccaggatggtctcgatctcctgacctcgtgatccgcccgcctcggcctcccaaagttctgggatttacaggtatgagccactgctcctggccttttttttgagacagagtctcactgtgtcacccaggctgtagtacagtggcatgatcttggctcactgcaacctctgcttcctgggttcaagcaattcttctgcytcatcctcccaagtagctaggattgcaggcatgcaccaccacagctggctaatagttagtagagacggggtttcaccgtgttggccaggctagccgtgttcttttttaacagtctttgaaggcttcggaaataggtgctttgggagggagagcagttatgggggattgtgagacggccttcagctcagttgagggcaggtccctatctggatttataacttagtttggttgaagtgtcaaggcttttgggtaagagttgaagcctttgtgagaactctctgaaggcaggaactttagcatacattcatcttagtaagccagtgcctggcatactacctgacacacagttaagtttttgtatcagtaaatcaatggataaattgatccttcaaaaaagaaatcaaaggctttaaatcaagatggctgagaattttgtccagagaatttcaagaatagtcagatgcttctgataagtacttttagaatgttaagattgaaagctgagagactttattcctataactccactcctagatggaaaaaactcaccatgtcgtcctcctcatgtttgactctgagatttgggttttgattaataggttataactgtctccctgtgcagtacatttaagaaatcaaatacagcaggtataagggaagttaaagccactgaaggatttcgtatgcctttaaaatttccaaacaagtataagtctttatcttttgagaatacatattgaaatatggagtgataccatgtctgaaatttctktcagtgaggcactgcgggtagtggagagggtaaagatgaaagatgattgtatataagttggtaatttttaagctagaagatggatagatggggtttcattatacttgtctttatttcacatatactatttgaaatctttcataataaatgtaaaaaggaaattatcagagagcttcataggttcaacaatgcttttggtaaaccaaacttcacctttttttttttttttttgagtttgtaattagtatgatcatcgagggaaagatgggacaaaggaaaagagcatggcagaaatgggcatatgggctttgaggctgacagccgtggctcagcctcctgctagccacgtggcaagtcactgaacttccgagtctgggtctccaggtctgtaacagcaggagagtacagtctcatttgcatggttgtggggaggattagggatgaagtgggccaagtgtccgagaacagcacctggcccatcctaggggcttagatctggtagtgttttattattgttagagacagagagtgatgaagggtaaaaatctgccccagggctctcgtctataaccctttcttctctatatgaattatagtgccaagggttatgtaaccatggagctaatttattattttagaaacagaactcttaaagaccagatcagaccactttgagatttacaagaactgtaaccagtttattgctttttgaaaaatgaagtaaggaagaacttacaaagaaangcatattaaaatggtgggatgccattttatacctattgaattgacctccttccttaccccaattaatggtaatatccaatatcaatgagtttttttggtgaaacttttctcatatgtatattagtaaactctttgggaaagcatttcggcagtatacgttgagagccaccaaaaggcccatatccagagatttagtaatcaccctttggaaggtgttctaaggaaataattcagaagaactgttatatacccactaaaaattactctgtaatagcatagaaaaggcttatgatgagcatgctaggttgtacctatcttatgatcacagctatgcagtncttaccataaatgtaaacggaggctggaaaagagcatgaagaagggaaaacagctaatgtgttagggttgtggatagtagcttagtttttctttcagaaattcttttattgttgttaaagattatgccagtgtatccaaacatacacactcaaagaccttgcaagaggacgttactatcatggtatatgggacatttggaacatgggtaagctctttccgaaaatagagtaatcaaaacccagaaagcaccggaaaccttgagggtgtgatcacttacgtcgagaagaaattgaaacaagactttcattcttgaacngttcccctacaaaatactatactttgatgcttctttagatctttgctgttacctctcagcgttcttaaatcactttgtttccaggttcaatttcagaagcttcagcaactgcgccttacacagtaccatggaggatccttaccaaatgtgagccagctgcggagcartgcgtcagagtttcaggtacctccagatatgtactttcttgaagctgaatggagtgtaaaaaatagacaaagattatcactaaaaagatgagatcttgaaggataagctgggcctaggtacagttcagtcttcttttggaaagtccattaatattctctctcatagtttctacagcatacgatagtgttatttcacaaatggctgaaggcagcactggcaagtagaattataacacaagcatatgtaatttaaaatgttctagtagctacattaaagaagaagaaacacgtggggttaattttaatatctatatttttcaaaatgcagctttctcatctataattttaatattacttaaataaatgtttggctgggcatggtggctcacacctgtaatcctagcactttgggaggccaaggctggcagatcacctgaggtcaggagttcgagaccagcccggtcaacatggtgaaaccccatctctactaaaaatacaaaaattagctaggtgtggtggctcacagctgtagtcccagctacttgggaagctgaggcatgagaatcgcttgaacccaggaggcggagggtgcagtgagcagagatcataccactgccctccagcctgggcgacagagcgagactgtctcaaaaaaaaataaaaataaaaaaataaatatttaatccaatatatccaaaatatgatcattttaacatgcaatcagcataaaaaaactgagaaatctcacatacttttctgtgtactatgtctttgaaatctgttgtgtattttatactcaaagcatactttaatttggaccagccgcatttcactagtttcatgtggctggtggctaccacatggctcagtgcaggtgtaagacacagataagtagtctgtattgcatttagattactgcagtgtcctcgggtgctttcatcgttcacatcagtggaaagccttgttcaaaccaatgtggaattggtgtttcagacaatggtatatggcactattgttaagacctgaattagacctgcttagatatcccaatctgtgaaacattaggagcctgtcattctaattatgcaatttaagattcggtgttaaagttgagatataaactttaagatgaagcattaattgattgtttggatgcctgaccattttaaaagcactgtcttatttctttgtggtagaaactgggttcacttttttgatgatgtcaaataaagccaaatgtattatttaagttggggacttccatttgagagtgctgatgggaactccaaatataatggtgattagaaaaagtactacatgaacatatttgtaccctattgcaccggaatcttgtcttcaatataatgacaatggactctttaccatattactgcctgtattagagatctaccttcatatatcaaactaccttatatattaacccactgggttatttagtatccaaataacataggtctctgccttatgcgggatttcatacttcaggaaatacagcattgtgcaagtttgctgtgtctgagatcccaattttgtgctactttattgtcaactttagaggaatatagaatttactatgatgttcccctccggttgcattggggaatgggataaaatgataatccttggccttcccaggattcttttttttttttttttttttttgagatggagtctcactctgtcgcccaggcaggagtgcagtagtgcaatctcagctcactgcaacctccatcacctgggttcaagcattctcctgcctcagcctcctgagtagctgggattacaggcgtgcactaccacgcccagctaatttttatatttttagtagagatggggtttcaccatgttggtcaattggtcttgaactcctgacctcaagtaatccacccaccttggcctcccaaagtgctgggattacaggcatgagccaccgtgcgtagcccccaggattcttttcatactgtttttgttttgttttgttttgtttttctttgcaacagtcacaaacttacacaatacttggaagtatagtccacttaatttttttttttttttgagaccgagtctcattctgtcgcctaggctggagtgcaatagcgcgatctcagcttactgcaacttccagctcctgagttcaagagattcttctgcctcagcctcccaagtagctgggatcataggcgtgcgtcaccacgcctggctaatttttgtatttttagtagagacagtgtctcaccatgttggccaggctggtctcgaactcctgacctcaggtgatccgcccatctcgtcctcccaaagtgctgggattacaggcatgaactactgtgccctgctgacataacttttttttcacttgggaataagttcctgacctgatgccccatcaccccctaatatttcactgtgtttttcctacaagcaaagacgttgttctatataaccaaaatacagccatcaagataagaaaattaacagtgatccattattacaatctgatcttcagactgcattcaccaaatgtccccctgctgtcctctgtagcaaaaggattcagttcagaatcacatgcagttattgcctgcagtctccttcagtctggaacagcttttcagccttttatttttgacattaattcaagtactcttaacgtttgtgatcctgtcacatttgaagattacaggccagtttttttgtagatataacccctcaattggggtctgcctaatgtatctttgtgatttgattcagactatgcatctttggcaggaataacgtagaagaagtgaggctgttatggtatcacattagggacatgattttgatgtgtcctgttaatgatgatgttctcttttatcaattaaggtggtgtccaccaggcatggtggctcacacctgtaatcccagcattttgggaggctgaggcaggcrgatcgcttgagctcaggagtttgagccagcctgggcaacatggagagaccctgtctctactgaaaaaaaaaaaaaaaaaggccagatgtggtggtgcacgcctctggtcccagctacttgggaagccgaagtgggaggattgagtgcttgagtccagagagcagagatttcagtgagctcagatggggccacagtactccagcttgggtgacagagccaaaccctgtctcaaaaaaaaaaaaaaaaaaaaaggtggcctgtctgtcaggcttccccatttaaagtaactcttttcccctttgtaatgaataaatattttgcgaggagatactttatcctgatcttcattaaactttcaatctatacattcattttttatctctcggtatatggttttatgattttctattttattcaatctattataatctattattttatttattcatttttgaagcaatgaaagcacagatttattgaaataaaagtatgctctacagagtaagagtgggcttgaagcgcaagctaatctattatttttattttgatcttcacattctccccaatkaggctggtgggagccctcttccgaactgagaaaaattcttgaaaaactgaggagagtcccagagcacagattttttttaagtaaatgtttttgaggtattatgtaaatacaatataatttataccttttttaggtatacagctctttgccatataatcaccaccacaatgaagatgtagaatagttccattaccccaaaaggttcccttgtgtctgtttgtaagtattctccatcccccacctccagcctctggaaaccaccatctgtagttttgactcttccagtgtcctattagtggaatcaaatgtccgtagtcttttgagtttttctctcacttagcatttgagattcatctgggtggttgcgtgtgttagtttcctagggctgctgtaacaaagtaccacaaacttagtgccttaaaacaacagaaatttattttctcatgttctcatgttctgagtccagaagttggaaatcagcatggtgtcagcagcaccatgaacgctctggggaagaatccctccttgtctcttcctagcttccgtggtctgcggcagtccttaacttgtagctgcatcacttactctctgcctctgtcatcacacgactttcttcattgtttgtctgtgtctgtgtttaaatcttcctctcctttttcttataaagaactagtcattggatttagggcctaccctaattcaatatgatctcacctttgcttgattacatctgcaaagattctgttttcaaataaagtcatattcacaggttctggggcttaggacttgaagatatctcttttggtggccataatttaacccactacattgcattgatcagtagttcatttctttttattgctgagtagaattccattctatggatgtagataatttatgcattcatcagttagttgatgggcatttgggttgtttccaccttttggcaattatgaataaatattctataaacattcacatacagtttttatgtaagtagctagtagtggaattgctagatcatacagtaagtgtatattaactttagctttataagaaatcgccaagctgttctccaaagtggctctactgtttcacattcttaccagcagtgcatgagagttccagcgaccctgtatctgctctagcacttggtatttcagagtttcaaaaaaatggtggttaaaaaacagaacataaaatttaccatcttaaccattttttaaagtagtttattggtatcttctaaaaccatttttaaatgtatagttcagtggtattacatacattcatattgtgcaaccaatctccagaattttttcatctgacaaaactgaaattctatgcccattcaataagaattctccatgttcccttcccaccagcctctggcaactactgttttttctgtctctatgactttgactattctaagtgcctcatatgagggaaatcatatactatttgtcttttttgtgactggcttgtgcttagtataatgtcttcagggttcacccgtgttatagtctgtgacatgatttccttccttttcaaggctgagtaacatttcattgtatgtggatgccacattttgttccattcatccgctaatggatacttgggttgccgccacctcttggctattgtgaataatgctgctatgaacatgggtgtgcaaatatctcttcaaggctctgctttccattcttttgggtacatactcagaagtaggattgctgaatcatatgacaattgtggttttaatttttttttttttttttgagactgaatctcgctctgtcgcccaggctggagtgtagtggcgtgatctcagctcactgctgcctccgcctcccaggttcaagcagttctactgcctgagcctcctgagtagctgggtttacaggcgcgccccaccacacctggctaatttttgtttgttttttttttttacttttgagatggagtctcactctttcgcccaggctggagtgcagtggcacgatctcggctcactgcaacctccgcctcctgggttcaagcaattctcctgcctcagcctcccaagtagctgggactacaggcacctgccaccacgcccgggtaatttttttgtatttttagtagagacggggtttcaccgtgttagccaggatggtctcgatctcctgactttgtgatccgcccgccttggcctcccaaagtgctgggattacaggcgtgagccactgcgcctggccttgtctagtttttaaattgagttgttaattttcttaatcagttgtgagagttgtttatatattctggataccagttctttatcagatatgtattttgcaaatattttctcccagtctgtggcttgttttttcattttctcaagtctcgaagagtagaagttttaagttttgaagtctagtttatcaattgtgttattttatgatttgtgcttttgtcttatctattaataagagttcttcatctaactcaagttcccgaa

SEQ ID NO: 10599 - DNA, 90865 bp, Homo sapiens
gtcagagtttgtcattgaaatactaagataccctatatttctgttattctagaagttaagaaacaaaatcagagctaaaacttgccaactggttggacccagtaacccagacaggggacagacttttcttgttagatcccatctaagccacgtaggcttgagacacagattctggaacctgagggaaagaaaaatgtgtttgcagatataaaatatggatttaaaaaaatcatcagggaaagaaaatgtctatggcaaagggcataagattagaatctactacgctcagcgaagttgcactctcatctaagaagttcttatctaaataactgccctttagaagccctctgttaatcaataaacagctgtataattagacattactttcttttctgacaactactcccacttaactctatttctgttcacttttcttcccttccttagttttcagacattgtctcaggtgtatccttagaccctttaaccctggtctgcatgaaattccatacttatatttatgttctccttaatgcctaggtattggcaatctttggcagtcattcccttatccccagtggggaaaatactgctacaaatttaaatgcatttcaccactttagtagttcacaaactagacaaaggtactgtcaacgattgcctggataactcttaacagtagtctccttgcttcttcttttcctcccactactgtcttttcttaacacagcagaaaaattgttttatgtctttatgcagacataggtaaaaacgtgtcatttgcctacataatgacccatcttatctctttatttcattcaagttaaaatcaaagtcctgtcagtagctcactagatgttacaattttttttgaggcggggtcttgctctgttgcccargctggagtacagtggaacaatcatagctcactgcagcctcaacctcctgggatcaaagggtcttcccctgcctcagtcttctgagtaactggactacaggtgcatgccaccatgcctggctaatttttttattattttgtagagacggggtcttgccatctttccccagctggtcttgaattcctaggttcaaggggtcttcccaccttggcctcccaaagtgctgggattacaggcatgagccaccatgcctggctgatccattatctttctaacttattttcctactgttgttttcctggatcagttcataccagtgacactggccacttcatattccttgaaaacaccagacacattcctatcttacggtctttgctgtagttgtcttctctgcctggaaaactcttcactcagaaatccacttagatgtctaccctacttcccccaagtattgccttctcacagaggtatatccaggataatctatttaaatcgaaatcccactgcagctgccagtagttctctttcactgacttgctttttcacttttcacagcagttaccaccttctaagatactgaaatgggaaaggtcttcttgtccccctcacagggcttgcaacagcgggagtggctcacttcttcagtgccctgctgctcaaacctctagggagagcatacagacggacaggatgtggggctctggcctcacggcagcatctaggggtgtatgtttacagttcctgaagccccagtgggcatgtgttactgtgtgctcttttagttttgccatgtataggcagctagtgttaactagctcaattagaccctctgccttattgcaaggacagagggctttctgtatcccaggttcttaccttggtgtaccagaaaaatcagatcacatgtgggcttgaagaatgagagcaaggtcttattgagtggaagtggctctcagcagatgggggagccagaagggagatggagtgggaaggtggttttcccctggagtcaggctgctcagcagctgggttcccctccaactgccctggccaaactccattttgttccgctggtcaatggcctgccagcgtgccagcatctgctggttcctgttggcatgatctttaaccgatgtgtccctcttgacatccagccacttgtgtgttcttccactgatgtgttccttttgacgtccagccgcttctgtccctgcctgctagggtctcaggatttttacaggcacaggatgggggcatggcaggccagggtggtcttgggaaatgcaacatttgggcatgaaggcaggagtgtctgtccttacctaggtctgtgggcacaggcccaggggtggagccttagccagggaccatgcccttcccttaccagcacttccctgcccctcttctatatcacctcccctgtctgaagaggtacatctaactgctgttcgaatatggatgatgacgggtcttagctgcttcctgctgataggggcatcgttttggggaaaacggcagtcagattcttcccagaggtctatataagggttcctagcaaaggggagccatcatccaaggctccggttccctgaccatttggaggttgatggcttccaggtgtgagagaaaaaacaagttttataaggttaagtatgcatggattatatatacttgggtatgtatacccaagttatacacactgtaactacatacatacatactatacatactataataaatacgtgtattatacaaggaaaaaaaattagtgccaaagattacagagwtaagaagtgaaatatactaacaacaacattgtaccctgagatgtttcaccctggtgaaagaaattaaaccttgtatgggagtggataaacttttagaatgagataactgttctggccatatctttagtagttaacaggtgtaccctgggaattctggggtttgtgggcttgcctggtggccattaaagcttctgtctctttcctgtatttcctctctctttcctgggcctccctgtctgtattataaaagaccaaggtggccactttcagaaggtcctctaatgtactatccggtcccagggcccgtttctgcaacttcctcctgaggtcaggagctgcctgagtaataaatttatcctttagggttagctgtccctctactgaatcaggagatagacaggtatgctttaccaaggcctctcttagtctctccaggaaggcagcaggattttcatcaaatacctcgtcgatcatggacaatttagtataattgagaggcttggtcttagtcctacaaaagccttccattatgcacatctgaaagcgtctcctcttccagtcttccacctgtcattgggatcccacttagggtcattcacttttactgcttctcttccagttggataatgtttgctcccttccctgatgccatatgtgatacaaagctcattcccaaatctctttactgcttgcagagcggcctgcttctcagtgtccatcagggtctgattcaaaagtagcataacatctctccaggagagtttaaatatatgggtgaaagtctggaaaacctctatatatctataagggtcatctgaaagcttgccaagatcccccttggtttgctttaaatcctgtaggaagaaggtgacctggaccttactgggcgcaaattcactgggcatttgttggaggggcaaaagtgagactggttgaatgttgaaggtgtacctcaacacacacacacacacacacacacacacacagagttccttggcacagactagcatagtgtttgctttggttctaggcattgtctctgttcaatcattagctaatgactaagctaaccgggcagaaacatcaaacgttacattcaggaaagaatggagactttataaaattagatcagaaaaatctttaaacaaacaaacaaacaagtagtaatacaacaaatgcaacaacagcaaactctgtagagggaggaaatctggtttctaaattgcaacattataatattcaaaatgtctagatttcagcaaaaaataatgaagcatgtaaagagaaaagaaatcatgacccatgcacagaaaataataaaaagaaactgtttctgaagaagcccagacattgtaattagcagaataagacatgtctaaaaaataaagtataagaatgatgtctcagcaatttgagaatatcagaaggagaaattatagaaataaatagcaattctgcaggttaaaaatactgacttgcaaggtttccgttgagaagtctggtaatggacttatgggagatctcttacacatgatgtttctttcagaattctctctttgtgtttgacctttgacaatttgattataatatatcttggagtatgtcctttttgaattgaacttgcttgggatgctttgatcgtcttcaatctggatgttcatatccctctcaagatttggaaaattttcagataatattccattgattaagcttactgccccttcctctttttcttcttttggtacttccataattcatatatttgtatgtttgatggtgttccataagtatgcataaaacacttatggaaaaataatctcaacaattttgagattatttttggcaggtggagcatcctaaaactagaagtcatcaccttcctcttcaagtgactgacttcttaacttagaaatcaccaccacaggatgcatagaagactgaaacaaaatgtggctttgtgaatacagtgtgggctttggagtcagaaactctgccatttgttggctgggtaacttctagtgtctctctccatctcaaagaatttcatcgtacagtttattagggattaaacaagtttgtgcttataaggtacccactatagaactttgtagtcaatagacactcaataaaaggtgttattactcttccttgttctccacagtggcttatgagatcccatttactggctcactcttcctagcaccatagacctctggactggatttcttcttgctatctaactccaacaacttgacttcctttgttcaccttcatttgtttcaaggctcttctttttttaacttttagttttaagggtacatgtatgtaattgtttgttatatgggtaaactgtgtgttgtgggggtttggtgtacagattctttagtcacctgggtaataagcataaaacccaagagatatgctgtctccctcctcctagcctccacccttaagtaggccccagtgtctgttgttcccctcttagtgtccatgtgttcttgttgtttagctcccacttataagtgagaacatatggtatttggttttctgttcctgctttagtttgcttagaatagtggtctccacctccatccatgttgctgcaaaggacatcatctcattattttttatggttgtgtagtattccacggtgtatatttaccacattttctttatccagtctgcctctttttaaatatagtcatttttctcatttttaattatcaaacatttataaaatgcttattctgtggaaggttctctgcctcaagagttacaaacattaggctgggcacggtggctcacgcctgtaatcccagcactctgggaggccaaggcgggtggatcacctgaggtagggagtttgacaccagcctgaccgacatggagaaaccccacctctactaaaaatacaaaattagctgggtgtggtggcacatgcctgtaatcccagctacttgggaggctgaggcaggagaattgcttaaacccaggaagtggaggttgcagtgagccgaaatggtgccactgctctccagcctgggcaacaagagtgaaactctatcttcaaaaaaaatttaaaaaaagagttacaaagattaatgatatacaatctctggccttaaaaatctctgaaaaactagaaataattctaaagcccagatagagtgagttcccttccagtatcctatacaagttcaaggtcctccaaagcattattaaatcttcctagccttttgatcctctgccttttctcctgcctcactaatgttctaagtctctgttatgacacagattctagaaccttcacaggccacactcccatcatttgcttaggtctgatcaatctgctccacrcaatttctcagtgatcctctgcatctctgcctacaagggcctccctgacacccaagttcatattgctcagaaacagtgaacttgagtttttcgttttaccttgatctctctctgacaaagaaatccagatgatgcragacctgatgaagacaatacatggaaaatgacagtcttgggtatggactaactccctctttgaggcttcctcaactctagtagttcaggagtctcctcttagggacttagggactttaacacaactgctttatcttccttgcctgcttccttttcaaattcartattttttctttcactcttattgattcctctggaagcctgggggaaacaacccacagttaactaagctctaggctgatagtgctggtttctcctttggtttctagagtttaaactgaacaaagaaaataaccatcctccgtagcactaggaaaaattccttagcccattatctcacttcctgtagcatggtcactctatataatctgcctcaactcagaaataatgatttcctctcattttccctattaatagggtggaccatcttctaacygccctatagacagggcatttcagacactaaaggaagaaaaggaatatacagtagtactgagtacaccatctagttatcctttcctccccratgagttatttaacactagaaaaaaaaattcacataatagagggcatattgactacttgctgttcattttagaggtacattagwagaaaatctccaaaagttgatttggcaggagaattttctcacaggaccaaacacctagaagactcagtagacaaatgcctaatctgccctggttggaggtgtgttattatatcttgagatggattcacctattgttcgtttgaagtagtcttaatgtgggtgtaatctactttcctagtctttcagagctcaatattcttcagagtttttactttcacaggcagttttatggttgtttttttcttctttcctttctctctctctctctgttttctttttttttctcccccgatccttcatagccactgccctttataaccatatgatattgtctaagatttttctctcctatgactgcaagactctatcttacatcaattgaatgcagatcaatgacacataaacaaacacaagttaagcaatcccagcatattttatcctactaaccacaataacaaacctcgcaaatatccatcttatcatcaggaggttggcaagtgatgactgaaaggtttttgtgtgacaagaaatttctgtcctttgctgtggctttcattaataaaaccaccttcagtcagcacccttcagtcaaggtgctgaaagttttttgatcactcactaataaaaatgttttgagtatgcattgcctataaaagtatatttataaatcttatttatagccatatatatatatatatatatacagaaaatcttgcaactttaaaggtatgagttaaaattacacagaaaatagaagttctaatattttccccataccccagtggatagcttcgtagaccactgattccctttaacattcttcctgcctggggagtaaagggttcaactgaggaggaaatctgtcagatttccaactctaaaccaagggtacacagcatctgaggttcttagtatacgaccaaagaactaaaaatgggcaggggcgggaatgtgaggacagtaatatgcggcaaataaaagaataaaggagttgaagtagcagaaaggggaaagaaaaaaaagtctatctggtggatagtaagaggtgatcagaagttgtttctggtaatttcctggtctaaataagcatgtttacaggtgagtttttgttttcagaaataactttggctgtcatcctgactctactgggacttgccatcctggctattttgttaacaagatgggcacgacgtaagcaaagtggtgagtaataatgagtcaaaatgaagatttcctgtgaaaaccatggagggagggatgccaagattcagtctgagttcatctcactcatcaaacagctagagactttgccaatattctgggaatctgtttcaatacttgagtcaaagaatctctgacctattagtgattgtccctgcacttttaactcccaaggtttacattatcaataatgtcaaagaaaaagtcacaggccgggagcggtggctcacgcctgtaatcccagcactttgggaggccgaggcrggcggatcacaaggtcaggagttcmagaccagcctgaccaaaatggtgaaaccctgtctcttctaaaaatacaaaaattagctgggcatggtggcaggtaactgtaagcctagccgctcgggagactgaggcaggagaattgtttgaacccaggagayggaggttgcagtgagccgagatcacgccattgcactccagcctgggtgacagtgcaagactccatctcaaaaaaaaaaaaaaaaatcacagagtttagcaaaagtaataagaatattttaaaagaaaattacctgagctccaagggaaattacctgagtttaaaaaaaaaaaatagaagtgagaagacagtatgttgctaaacaccagtatctagtattatataaaaagaattggagacttttagtgacttaatttggggagatgataagaagagacaaatacagagtagtacttgtcgatgaaatagagatggagctcataaaagctaagacctatttctatgccataaggtctctctttcctggatttttctgtttctctcccacaactttctaatcagctgtattccctccctgtttcccatcctcaatgcctgtgagccctcaaagcataagtagtgtgaaaagataggtaaaacagggctgatgggagatgtggaaaatgggtgagaacaacaatgcattatatcaggaggaccaccttggtaagcaagaagcatagcttagagtgagaagagtttgatcagaggaagaacacttctcctaagtaactaataaaaacattttgcctaattcttccacagaaatgyatatctccagatacagttcagaacaaagtaagtacttatactcatgagaaaaataaatatagtattayagaattttcacaagtcaggaatgaaatctgtcttgtttacagttgtgtttccagaaccttgcatagtgcaccattgcatgaactgaactgcttctaagtgagtgggagaaatctaccagagatttctgagcagtactgaatgccaaactggagttggggagaattaattaatactgggtaggcctgcataattctgaggctcccttcagatgcttcctgtggtctgagagcagcaacagagaactgttccagttcaggcactggaacagatggttcagtaaaaagcctaaatccattcatgaagacggccttagtgaagtggccggaccgaaaaatataatgtatcctagaataacgagagtgaacacagttagggtaattatgattgagaagagtaccaacttcaggatgtgaagaattgaagaagactttccatggaaagrtctggagagatgccaaagttgttaagaaagatagcacaggattggtatgaggcaaaaaccaggagactagctgctgaagtatcaagaggtaaaagaaactctgaaactccttctgactatcatttagcctggctaatattataaaattggtgattgacacagtcacttatcatcrtcagctcttgtagcttatgcacaattcctagttcctgcaaagtaaattaattcacatcattattcaccattaggagttcatgtttacattagttctcagagtcttaaataaagcctcattaataatcaagaagcaaaatcatgtgctctccctttttttctaggtgctagacttctggactatgaggatggtagaggtaaatagattaggaactactagacagttaatgaaggaatatactctttagagtgtgaatcaactcatctccatttgagcatgatttgttgagtcagcatatctttcgtttttataatattcaaatgcttatcactcctctctctctttctcaagaaaaattgtgcatttttctcagaaaaggtaaataattctccttcttaagaccatcaaaagaattcatttccatcttctgtctacttccaagatattagaaaggttaaggaaccgctcygaaacaatttcctggatgtttaaaatgtggataaaatgaatatgaaatggaatagtatatgtgaaaatacactttgaaagccatacagtagaagaggtaaacaaagcttatccccatttaagaagatgaaatttatgctcaaaagattgagacttactcaagttcacctagctgaggagggagctggatatcaaattcaggttttgaaacgtgagagttatgagaagacggcaatgcgctgtctacttttttgaagggacacaccagtaccactaatttcaatgtaccatggctatccctaaccctcacgccccaacactcaatgttctctttcagtatccactcaccagggctgcctatagatgttccctcggctgtctctctctctctttctctctctctctctctctctctttccttccctctttctctctttctgactagtcctatctccagaactcaacaagaaccactagagctacctctcattcttgctggaagccactaaagttgtccacaccaggcccaccagctacaccagaactataaggttatgagattgtggatgtggaaataattacacacacacacacacacacacacacgctacaagcatatagatccctgagagttgaggaaagaaaagagaaagtaactcagtcacttcgcttgctgtccatgccccacacttggactcttggtccatccttctccttcttacctctatgattcatctatcatgaacaacaagagtgaagagcacagtgccatggcattccctctttattttctgaaatggaacctaaagaaaatgggaatatctgggaaactagcaaatcttttagtagttggattgagactaatgataaacttttttttttttttttttttttttttttgagacggagtctcgcactgtcgcccaggctggagtgcagtggcgcaatctyggctcactgcaagctccgcctcccgggttcacgccattctcctctctcagccttctgagcagtgaccacaggcacctgccaccaygcccggccaatttttttgtgtgtttttagtagagacggggtttcaccgtgttagccaggatggtctcgatctcctgacctcgtgatccacccgcctcggcctcccaaagtgctgggaacataggcgtgagccaccacgcccggccmgataaacttattttttmatgaactgttggkaaasttaatatgtttttttctttcctaaaagatttttcttctcagagatctaaaagaggaagaggtaaacagatttctatctaacaaaaaataatatagactcacttgttgaagtaaaatctcattatgtttttatcttctcttttaggatcccgacatgcatattcaacacaaagtggtaaattattgtattgctaagaaattaatataggagtctgtttatgagaaattaagaatcttataatttttcttcaattctctagacacttcatrtgataaccgaggtaagtatatgtagagatttttgtaaaattaaaggaaaatcaggcttcttcctgccacaacataaaaggctataaaaactgaccaaaatttaaaaaagaagaagaagaaatcaaagtagttacagaatattctgagaaatgttcacaaatgttcaccatcacgctatgaggcaccattttccccaaagctatgcaattcctctcctatccaactcctaattatttaacaaaagtaatatgagagaaaggcatcagcaaaatagtagaataggagctttcttcccacacagaagcatsaatttagacaactatccacagatgagacaataccattgtgggagtccaggagtccagcagagaagttccagcacgctgtcaggttataaaatcctagaacagatgtaytaaagagggtaagaagaacagtttcactttacccacatcactcctcccccaaggtggcacaactcaatgctgagacagacccacttggcccacaatttctccmacagaaaaaatgtrcagaacttaatgagkgcccacatcccccagccattcaggatgctgtccgataagcccacttatttctcactccacccagaacattgagatgatcagcatagttgaatggttaggagaggctgggagcagggaaaagagactgcagaacccactcatcagaaagcctcatcagaaagcctgcyatttgagatgcgtgacctatgctccttgcactactgacccacaggcaygcctttcacacatttcactctcccatctaggctgagtccccaaatgagccaccatggacaacaaaaggaaacatctcacagtcagtttgactttgtrggatyggaaaaaaggacacaaacttgagaattccagagcaccaccctagggaaaacaaagggaaggctctcagaacctggactggctttgcaggattgagasaaagcacaatcttagaaatcccatctaccctgggtgtggtagttcatgcctgaaatcccagcactttgggaggccgaggcaggaggacttcttgagactaggagttcgagactggcctgggcaacatagtgagactccgtctctaaaaaaaaaaaaaaatcagttggatgtggtggtgcacacctgcagtcccagctactcaggagkctgaggtgggaggattgcttgagcccaagagtttgatgctgcagtgagccacgatcatgccactgctccactctgggtagcagagtgagattttctctcaaaaaaagggaaaaaatcccacctgtgaagkaggcacaaacaaatattgaacagggtgactgtttcttcaaatgtgaaaacacaagacaagacttcaaggtcataaaaatcaaggaaacatgacaccrctaaaagaacacaataatatttcagtaactaacccccaaaaatgaaggtttgcctaaaaatcaatccaccagttgcctgacaaaaaaatccaaaacaattgttataagaaagctcagtgagctacaagacaacacaaacaatataatgacatcaggaaaacaacacaagaacaaaagtagaagttcaacaaagagaaaaaaaaacaaaacagagccatacaaattttggagctgaagggtgcaatgcctaaactaaaacaaaaaggaaatagagagcttccaagatgatggatcaagtacaagaaagaataagagaagtcaaagaccaatatttaaaattatctagtcagagtacaaaaaaaaaaaaaaaccacaaagaaaagaaatgaagaaatatgtacaagatttatgggacaccatcaagggagctaactttttgcattattggagtctcagaggaaaagagaaataaaatagaataaatgcttatttaaggcataattgctaaaaactttccaaatctgtgaagagatatagacatctcgatatatgaaactcaaaactctccaattgtatttaacccaaagaagacttctccaagacattatgtcaaattgtcaataatcaaagttaaasagagaatcttgaaagaagcatatcacatttaaaggtacatcaaaaggatattagcacttctatgcagacattttctaggccagtayatartgggatgatataytcaatttrctgaaagaaaaaaactgccaaccaataactctttacccgtaaagctgtttttcagatctgagaaagagatagtctttatcagacaaacaaaagctgagggagtttatcaccaatagatctgccttacaagaaatgctagagaatgttcttcaagctgaaatgaaaggccaataattagtaaaatgaaaacatatccaagtataaaattcactggtaaggtaaatatacagtcaattcagaatattctaatactgtaatgatggtatataaataacttttaatgctaatataaaagttaaaagacaaaatattaaaagtatataatttgttaatgaatatacaattttttaaatgtaaattttgacactgagaatgtaaaaagtagkgagaataatatgtagagtttttgtatgtaatctattttaataatctaagttattattagcttcaaatagactgttgaaaccatgttttatgtaagcttatggtaaccacaaaccaaaaacctatactasatacacaaaacagaaakatattaaagcataccactacagaaaatcagcaaatcacaaagaaagmcaggaagaaaggaagaaaggatatacwaaacagccaaaaaacaaccaagaaaataactatattaagtccttaactatcaataattacttgaacgtaaatggattaaattttctaatgaaaagacacagagtagctaaatgtatttaaaaacaagttgcaactatctrtgctgcctgtagcagacacactccagctctaaggatacatatagaatgaaagtaaagggatgaaaaraagatgctccatgcaaatggaaaacaaaagacggtaggggtggctatacttacatcaggcaaaayagacttttagtcaaaaattataacaagagacaaaggagctcaytatataattataaagggctaattcatcaagaggatataaaaattataagtacatatgcacataatgtcagagcacctaaatatataatatttacataactgaagggagaaacagcaatataataaycgtagcggacttcagtaacccattattgacaatgaatagagcatccacacagaaaattaacaagggagaaaataaagttaccaagaatacccaatagggaaaggataaatgttattaggaaaaccggatatccatatgcaaaaacaaaaagaaattggcccttatcatataccatacacaaagatcaattcaaaatggattgaagactttaatgtaagacttgccactataaaactcctataataaaacagtgaaaagttccatgacattggtctttgcaagttgttttatatgacaccaaaaacacagtaacaaaagcaaaaataagtggtatctcgtcaaacaaaattgtttctggacaacaaaggaaacaatcaacaaaatgaaagccaactcacagaataggagaaaatatttgcaaaccatatatctgataagtggttaatatttgtcttaatctgtttctgttgcttataacagaatatctgaaactgggtaatttataaagaaaagaaatgtattattatttcttacagttatggaggatggaaagtccaaggctgagggggcgcatgtggcgcaagagagccttcctgctagtggcgactctctgcggattcctgaagtggtacagggcataacatggcaaggtggctaacatgctgtgcttaggtcgttcctcttctttytttttttttttttttttttgagacggagtctggctctgttgcccaggctggagtgcagtggcgygatctcggctcactgcaggctctgcctcccgggttcacgccattctcctgcctcagcctcccgagttgctgggactacaggcgcctgccactacgcccggctaatttttgtatttttagtagagacagggtttcaccgtgttagccaggatggtcttgatctcctgacctcgtgatccgcccacctcggcctcccaaagtgctgggattacaggcttgagccaccgcgcccggcccgttcctcttcttatgaagccaccagttccacttgcctgacaactcattaatccattagtggattaatccatttatgtgggtagaaccctcatgatataatcacctctttaaggcctcacttctcaatgctgtcacattgargattaagtttcaacatgagtttcggagaggacattaaaaccacagcaatatccaaaatatataaggaactcatacaactcaaaagcaagatacaactcaaaatacagctgaaacaaataagctgattttaaaatggactaaggttcatatctgttcatgaaccttagtccatgaacagacaattcttaaaagaagacatttacgcagccaacagacatatgaaaaaatgctcatcatcactggccatcagagaaatgcaaatcaaaaccacagtgagataccatctcacaccagttagaatggcaatcattaaaaagtcaggaaacaggtgctggagaggatatggagaaataggaatgtttttacaatgttggtgggagtgtaaactagttcaaccattgtggaagacagtgtggtgattcctcaaggatctagaactagaaataccatttgacccagccatctcattattgggtatatacccaaaggattataaatcatgctactataaagacacatgcacacgtgtgtttattgtggcactattcacaatagcaaagacttggaaccaacccaaaagtccatcaatgatacaccagattaagaatatgtggcacatatacaccatggaatactatgcagcaataaaaaatgatgagttcatgtcctttgtagggacrtggatgaagctggaaaccatcattctcagcaaactattgcaaggacagaaaaccaaacactgcatgttytcactcataggtgggaactgaacaatgagaacacttggacacagggtggggaacatcacacactggggcctgttgcggggtgggggaagcagggagggatagcattaggagaaatacctaatgtaaatgacgagttaatgggtgcagcacaccaacatggcacatgtatatatatgtaacaaacctgcacattgtgcacatgtaccctagaacttaaagtataataaaaaaaaaagagagagagaaaaaaacaaaataaaataaaataaaatggactaaggacctaaatagacattttttcagagaagacttacagccaactaataaataaaggtgcacaatatcactaatcatcaaggaaatgcacctcacaccagataggatgcattcaaaatgtcaagggataacaagtgttggcaaggatatggagaaaagggaacccttgtacactgttgttaggaatgtaaagtaatacagccattatggaaaacartattgtggttcctccaataaattaaaaatagaactaccatatgattcaggaatgctacttctgggcatatattcaaaggaaataaaaatcattatcctgaagagatrtttgcactcccatattcattgcagcattatttacaatacccgggatagaggaataaacwaggtgtccatcagtggatgaatggataaagaaaatgtgatacacagacacacacacatacacacacacacacacaatgaaatattatacagccttaggaaaagaaagaaatcttgccatttgtgacaacatggatgaacctggaagaccttaggctaagtataattagccacgcatagaaagacaaatactacatgatctcatgtatatatggaaccttaaaaagttgaactcagcagaaaggtgattaccagaagttagggggtrgaagaaatgggcagaagttggccaaagggtacaaacttgcagttttatgacaaatacgttatgtagacccaatgtacagcatggtgactataatgtattatacacttgaaatttactaagagtgtaggtyttacatattctcatcacaaaatgaaaaatagaagtaagtatttgaagtggtagatatrttaattagcttgattgtggcaatcatttcacaatgtatacatatattagaatcrcacactgtaataccttaaatatatataatttttataattatacctcaataaagctaaagaaaagaaaaaaataatctgagtagtcaagagaaattcaacatcccagatctcacaaatgctaactactcattgaattaattcaagatggattaaagacttaaatgttagacctgaaaccataaaaaccctagaagaaaacctaggcaataccattcaggacataggcatgggcaaggacttcatgtctaaaacaccaaaagcaatggcaacaaaagccaaaatggacaaatgggatctaattaaactaaagagcttctgcacagcaaaagaaactaccatcagagtgaacaggcaaactacagaatgggagaaaatttttgcaatctactcatctgacaaagggctaatatccagaatctacaaagaactcaaacaaattcacaagaaaaaaacaaacaaccccatcaacaagtgggtgaaggatatgaacagagacttctaaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctasagaggatgtggagaaacaggaacacttttacactgttggtggggctgtaaactagttcaaccattgtggaagtcagtgtggctattcctcagggatctagaactagaaatactatttgacccagccatcccattactgggtatatacccaaaggagaattgaacaatgagaacacatggacacaggaaggggaacatcacactctggggactgctgtggggtggggggaggggggagggatagcattgggagatatacctaatgctagatgacgagttagtgggtgcagcgcaccagcatggcacatgtatacatatgtaactaacctgcacattgtgcacatgtaccctaaaacttaaagtataataataataataataaaacaaatcatgctgctataaagacacatgcacacrtatgtttattgcggcactattcacaacagccaagacttggaaccaacccaaaagtccatcaatgatacaccggattaagaaaatgtggcacatatacaccatggaatactatgcagcaataraaaaggatgagttcgtgtcctttgtaggaacatggatggatgaagctggaaaccatcattctcggcaaactatcgcaaggacaaaaaatcaaacacctcatgttctcactcacaggtgggaattgaacaatgagaacacttggacacaggaaggggaacatcacacaccggggcctgttgtggggtgaggggagyggggagggatagcattaggagatatacctaatgtaaatgacgagttaatgggtgcagcataccaacatggcacatgtatacatatgtaacaaamctgcaygttgtgcacatataccctagaacttaaagtataataataataaaaagaaatcaaggaataaattcttaaaagttyatcacattaagatatgacttgtgcaataaaattccaagggtgcaaagaaatactgctgttgtctactgttgtcatttacatctcatatttcttgggaaaaaacctctccagtaacagtcyaccagaataccagatttaaccagtgcaagaagctacctcagtgttaggaatttaagggtacacggataagcaaaataaaactacacactataagaagggaggagaattaacatgtactcagcacctactatatgttagtcattctggtgagcattttttcattttattaatattgaatatctacaaacaaccctgtcaaccacacaaagrtgagctacccaaaaatccctccctggctgtccaaggcctccagtagcctacaggttgctttggtgcatattaggaaaaggtgttccttcctgcaagtgaatgcagccccaccccagagacactgytgtggatttcagttcccttaaccctttgtgcagtgagccaacctatataatcatagcacacrtgtcctgaagatatatgaaaggcatctcactcttagcatgtctaaaacccaagccctaatcccttctacacactggtgctagcacctgtattcacctaattgctcagactatctaccttggaatgatatttaactcctttcctactctcttcatccaatccaccatcaaatcccatctctgatgctttcaaattatactccaaatcaaaccaccttccaccaccatgacaatccttgcccaaacaccaatatctcttgcctcctaccttgtttcctkgatactcctcttgccttcttatagtctattcacctcaccacagcgagggagatccttaataagtacctcttaaatgaagaaagtaatttactattgttatccctaatttacagaagagaaacttatgcttaaaaaacattaatgacttgcccaaggccacaggacttggaagtgacaacctggataggaatttagaattgtctaattccaaattttaggcagtcagagagtttattcttatgtaatttagtaatatcttaatttttaatttcctgtttacagatctttagtgtacaagcctacaatcttagtatctttctaatctgggctcccttgcattcttaaggaaaaacttgaatcagtaaacattttattgttgtttcaataagtcatactttaaaattcataaacccaaatgactatttctctgactttccagtccccctaacataacctataaatctcagtcatcctaagtttctaggttcccacgccctgctagtcttccctccattatttctagacataggaatataaatgtactggtcaacttgagactatagaaatcttctggcaggaagatattaatattaggtaaggtcattatgttagtttaggtacatgaaatttagtactcaaagtttagtttaacttaaatatatcacatataaaagctgccatggttattccaaaatttttttgaaattaaatttattcttagtatttttcyagcaaatgttaagtgcagcgcatgaaagtttttataacaaatttcaagtgcagcatattaaaatgttcggcatttcagtggtattttccatttttgyggcaactctattaacatcttgatrtattttcccttttttttttcattgaracagagtcttgctctgtgggccaggctggagtgcagtggcactatctcggcttactgcaatctccgtctcccrggcacaggcaattctcctgcctcagcctcctgagtagctgggattacaggcgtgtaccaccaggcccagagaatttttgtattttcactagagacagggtttcaccatgttggccaggctggtctcgaactcctgacctcaggtaacacacccacttcggcctcccaaagtgctgggactacaggcttgagacaccgtttttaaaatccccatagaaccatgagaaacaagaaacattattataaaacagagaatgtgttttgtacttaattcccatcacaatgactgccaagtatggaaggagagcactcattttcagaaaagaagctgaaaaaaaaatactattgtcttcacatttctgagtakatctttaactatactttagtgaaatagcaaatgatattatgattcaacataatttaaatcaactacaaagtatcaatattactatttacttttacacttttatgaaaacaacagtgataacatgactagttttccatgtaatttgctttgtctccagatcttttagaaagtctgtttccatgacatcactaagaaacaagttttagatcataggatgcacattcaatcgcaatcaatatacacatttgcattcattataatttgccatattgtcactgaacttgaattctcagtcagctgagtaaatattttgccattccttcttttatttgacctcaacttaccttataactatacattcttctgtttcaatgtttgcatgtatagtttattatttcttctcactacatgtatttaccttaattaaactctgcctgtttttttaatgtcattaaacttataaattaagccatgaggagattttgtctccagtttcttgcctaactggatatttgagggtgttgaytgggtaatcctctgtagtgataccaaaactacagaaatagaatatccaaattgatttttctttcttttgtttatgttttcagagagatccaaaagagattacagtaagtattatcttgcttcttaacaaaaatttgcttcctattagtaacatttccctagattgtaaatgctttggaggaaagagaaatcctgtcatatgtcaagtcatatgaatactaagcaatagataaagttttctagtgctggtttagaatgatctggctgggagaaaaggaaaacaatagaagtgatgagcaagagaaaaggaaagtaataaagataaaagggagagagagaagaaaatagagagggaaaaaagggagggaggaattagggcagtaggaatggcatctgcctactaaaaattaaacccatttttagagatggaaagcatatgcagtagctggtgggagtggctgtcagtacccatcaccagatcagtgatgactcccggggcctagactttaactcctgagaagggggtgacagcaactgaagctgatatgtaaagattagggatccaaactctcatgattcacctcatgttttctgtgtgtgtattttagcaccatcaaccaactctctaggtaagtgctttgtggttttctttcaattctactgtcatctggtttgcaagccctattttttctgtattttttctcttttaagaaagtttttaaaattaagtataaaaataattaacacttgtatatcacaccttagatgtgacaaattgataatattcttgtcatatttctcaagttatcatagacatattccactcccttcttcccaaaggcttattaatatattttaaatatttaagtctatttacatatatttatagtctctacctatcactgaacaaaatatagtatctttttttaatgtttaattttactaaaatggcatctgtctgatagtatcattacgatttgcatttttctctcaaaatgtagttttgaaatccaggttatacactttgttgaataatattccaccttatgaatatacaatatttttctattatttctactaccgatgcattctcaatgtttccaatttctgctatcacaaataatgctgcaaagacartccttaagtagatggaaaagagtttatccggggtacataccctgaagtaggattagtgttcacattgtatatgagcatttatgtaatttatgcatattttaaattttagtagctattaattaagctccttggtagttacatagaggcatacaaaaataaataaatatttccaatttctctgcattagtaacaatcccagattttgtcatatttttctattattgccacttgaatacgtatacaatttttaaaatctgcattccctgctcactcctgaaattgagtatcttctcataggcttactagctagtgaggcttcaccctatataaattgcttgttcatttactttacccatttatctattagttattgatctgtagtaattctttattattatgaaagatcaacttttatatgttatgttaaatatctgcaattatctcatccaattctgtctcttagctttaaatttttatgctgtctcttgacttttagaaggcctctactcactctcccccarcaccacacaatttattgtaataaaatttgtcaatctcttgttttcttttagagtttctgctttttagtttctttggccttatctgggtatcacaaagattttatctaatactttctcttaatagttttgaaatttccctttctacatatagaactttaatccaaatggggctttgttaattgttttttggttttggtgagtgattttagtaataatacaggtgagatctaattttcctttcatctggaaaaccaactagagggatttcgtctcaycttgttccaactagatttattgactggtgcattctttctctgctgatttgtaatgccatcttcatcttatatatttcgtttttccgtggattttattttctgttccagtgatcttttgtcttttactgaaccaatactccattgctttcactactaaaactttataacatttattacaaaaaatagcacattatctttgttctttttcagaaatgtgttggctattctttgaccttttctcttacacaagaatttcataatttctcaaaatctatgagtcatattaggatttcattgaaatttcattgagcctgtagattaatttgtaaaatcaattattcccatgcattaacatggttgcctactattcaaattttctcatatacccttcaataatgtaatataattttcttcagaaaggtcttgcatgtcttttgctgcattaattcttatacacatacttgttttttgtttcggatgtkaatactatctctctacatggattttacaaataattattgttggaatataagttatatgttgtatatttgagagtagattttgtatctagccaccctgctgtgctcttagarttctaataattttcagattcttttgaattctatatgtaaaaaatcatgtcatctgcaaaatctgataatcttgagtttccttttccaattcttaaaaccattttcttgtcatagcttgggctatgtatatctatgggtaaaattccttctctttacttttgctttatttttgttcctttttctagcttgctgtatgaaactcttaatcaatttccagactttctcatcttctttttttattttatttttatatgggacaccatgaattttcatgccatccttacacacgggccacgctaatcttctctgtatcattccaattttagtatatatgctgccaaagtgggcgctcttattttctaatataagtatctaagtaacttctaaatgctgctgaaactcatatcctcatatccactcatatcctcatgactatttttttacttcaattctacactctgatattagcattgttctaacacctttgttttaattagtatttgcctatttttcatccttttattttgaaccttaaaagtttgtttttgtcttgtgtcttttttaaatggcatattgcttgactttgttcatattaacaatgtaaaattttctgtttcctaatagatgaatttagttcattttatattgtgaattgttatatgtttatctaaatgtttccaatttatattgtgttttcaacttacagtactatgctctgttctttcatttttaaatcttcttttctaccttctgctggtatattagaattccttgtttcttttgttttacttagtgtttttctggattttgttttatgtatcctgatatttgtaacatgtgtactatttaayttttctttaaaaattaaagataatcggtatcttcttccaagactagataataacttttatttgaccatcttccctccaaactactctttccaaattctccatcttgtttgtggtattctttttaaagacaaaataattatttattttcacaattaattattacttagacttacaacaatatttcagcattgtttttgcttaacattatttgctacatcctgtgtcttttctcttctatttcttgcccaaatacaatcctttactggttctttaaactctacatgtatgtgaaaaattttctaagccttcatatggctgaaaatagctttacttcaccttcagccttaaatgaaaatttagctaggtatagaattgaacattattttccctctgtactttgaagatttattccatttgcttgttgtttattatttattattgttgataagaatctatcactagtttgatgtttgttcctaagtaaatatattttcaagattctctttatttttgtgytctgcatttaattataatgtttataggtgtgagattaactttttatgagtgtgaggttatcctgagcaggataaatgaagtgaatctcacacccacaatggaaaatcctgaatgcttccatttactctgagcaggataaatgaagttaatctcacactcataaacattcaagagtttccattctgtggactcaatctttctaattacagaaaaatttaactttaattgctatgaattttgcccatatttatatctatatctaacaacaaactrtagtctctacttctaaaattactatgtatgtaaagattttccttccatctttcagatcttgtgacttctcttttatatttcttatctgcactgattaagttagccccggatcttaaaatctcagtggttttccctaatagaattttatttcttacttatgagaagtccaaaacaggaattccagattggcggatggcccttctctcagcagtgtcttaggcactcaaattcatcttaactaatgactccaccatcttcaaataatggctcctaagttcatcatgttagtccaccttaagtgaacagaaagaaaaaagcttgaagatcatgagtggatgactttacaaacaagcctggatgactttcatatcacttctaacaacattagattggctagaactcaagcatatagccacacctaactacaagggaattttggggaaatagtcaaccacgttgtattagttttctatagctgctctaacaaattaccacaaacttaatggcttaaaacaacacaaatttattatctatcagttccataggttataaatctgtcatatatgtctccctggacaacaatcaggttgtcagcaagactgcattctttctggaggttctaggaacaaatctgcttccttgctttttcagcttctagaggctggccacattccttggttcatggctcccttcttctatcttcaaagtgaacaaaaatgratcaagtcctcacatcacaccattctgcccttcytccactgtagtacctctttctcttactctcttttatctccctctcccactcttaaaaatctttgtgattatattaggcccactcagatataccaaaatcatcatcctattttaaggtcagctgattagcaactttaacttcatctgcaatattaattccctttttccatgtaacctaacatattaaacaggaagataatcccaggttcttacaatgcatgaggcctatggccttgatttctgctggtgatcaggtgtttaagcctcagtcccccaataaggtatcacatgggtggtaaaacttctcattcattaccaagaatatgggttccttcttgatatatttttcttgaatatattacttctctttttagttttcaagctcagctctactttataaactttaaaaaataccatgttcaaagtaatcacttaaaggagaggatgaaatattcccctcaatagcaagcaccctttcagtaagccccgaggttctaaatactttcactactttgactctttagcttctaatattattcaagaacttcctgatttggtctcttgctattcttcayctccatagggcacaagtgaattttggaaagtggaaacccctgttgaagcagttaggtggtaaytgtttggtgtaacaaaaaatcttttcgaacaaagggaaaacagaaaattaaggagagagaggaagaggtggaggaaaggtagagaaggaaagaacagagcagcagaatcaccaatgaaagaagacttatagggacagaaaaatgtcctcagattgagaaactagcaatctccaaaaatatttttattctcttaccaaaattgaaagacaggttgcatagatcttgtagtcccaccttaccacaaaagtattggaatccatatgtagatatccagctgctcaccacattgcattgcaattgataccaggaaataagttgtgactcatttctatcytcttttccacaacctttctgcaatatagtgtctatggcatctaagttctccctgggacaaacagaactcattcttcttttgatgtgttttattttagcactgtctcgatcaagtattggtaagttcctttacttttcttcaattctgctgacatttagccccakttartcaagaggatatcttcctaaacttcccagacttcttcgctgcagcacagcagaagcttaagcttcacatttctccaatttctttgttctccataaccagacacttcaataatcagtcaaaagtaaatgcaagtttctagtggtttattatgatgacatgaagagagcaatttccaaacctgaagtgttggraaaacagagtaaataaaggataagagcaaaaagttagtaagaaaaataagatgaggatgargataatatagaatgagggataaatgatattagctgtgtcctcagaattttaaagctttacatggctagcacgaaagggcagccttccytgaggcatccccaagtcaggctggcagcaatggaagagatggctaattccctatccccctgagctgcaactgacactaagggtttggtgctcccaggcgttcctggttctgatactcattcctgccctgtcccctgcaaaaaaaaaaaaaaaagaaagaaatggatagtttttgagccagacaaccacatgaattttttgtttatatttacttttaggagagcaaggagggaaatttcatatttccaaattctaagtctctttagtgtgtcacagaactaaggaacattccctaaccctgctgagattttgtccctcacctscttttccttccccatcattgagcattttgtctaaaattaatgagaacttcgaagaatgagaagtccaccgattaaagaataaagagaggattaaaatggttttagctggcaatcatagtttcagcaaaacagtaataaattcattaacttaggaataggagggaagaagagagaggcttgtgaagagaycagggaatggragtaggggacaaggagaggtttgtaattaaagcaagtcatctttcttgactatttacagatattacacatgaggaaaaaatgaaatttaaagatattatttaacttgacccaaggcatatagctagcaaaagagtaaaactgaggttctaaacactggcctttggactccaagtcctgaggttgtccarctacccccaggacatcattaaatgtatttactcttccaatccaaagtattctttggaaataaaatgtttgttccaaggaatttagaaaatcatgcatatgttraaaatatattacttcaatttttaaaatgtaatttgaaaatcttaaaatgtaaattaatataaaatatcagaattagtgtgctaatccaatactgtgccataaccttatcccatgaataaggctgttttgttgtatatacaactgtgaacaggtgcccttagaaagctatcaagctcaatattttattacttttataattaaaacatgttttatctagttttactttgtttkcatctaacttatggaaagggtaaaatatttgggagttgaaacatgctaaacaataaactcaaatcttcagtttcttcagcaaaatctgcagaggacccatgtgagacaggcttgccataaaaaccctccaaaggggaaatcatttagagcactgcagctgctatacctaagacaacataagtatttcacagacagcatagattctagtgaggtaagacagaaaataaacacataagcaaacaaatacaatgatttccctttctagataattcctactatgattactagactatcatagtaaattctacggagaaaacaaattaagataatatgatagagcaagaccaagaagtragggcctttagctaggagattagaagaaatttccctgaggagatatctgaactgactctgaatggcgaaaagctggcagccacaggaggatcttagggaagagtatctcaggcagaaagaacaccaagttcctgagaggggaagaagagtagcatgtatgagagattgcaggaaggccagttgtgaaagatcgtggaggagtttgaaaggtagggmgaggccagatcacaaaaagtcttttagaataaaatatggagaacaattctgagcaccacaataagccattgttttcatcagggaagggataaagccacatttatgctttaaaaaggcaaccctggcttctggtagagaatgaaatgggagagaatgaccatcatatttatttatgatggcaagaaggagagaggtacagagtaaagtctcatatgtgcttcaaagacaacaggagtttctactggagaagactgttcggaaacagcaatggggagcaaaaatgacatttacctatattcaggcatgtatatgggtatggattttttctaaaacaaacgtacaaaaaaccagacatcacagcctcaacaacagagtgagaccctgtctctacaatgaataaaaaattagccggcatggtggtgtgcacctgtggtcccagctacttggaaggctgaggtgggaggatcacttgagcccaagaggtcaaggctacagtgaattgtgattacgccactgcactccagcctgggtgacagagtgagaccctgtctcaaaaaaaaaaaaaatctaagagggctgtaagagacatggttttttaaaaatgttataatttttaattgacaaaattgtacatatttatggtatacaacataatgtgttgatatatgtatacattgtagaatgactaaatcaagctgttaacatatccatttcctcacatactttttgtggtaagaacacttaaaatctactctcttagcaaatgtcaagtataacacattattaactacgatcaccatgttatacaatagatctcctgaaagtattcctcycatctaactgcaattttgtatgctttgagcaacatctgagatacagtatttttttaaaaaattgagatagaatctcactccattacccaggctggagtgcagggtgcaacctcggctcgctgcaactccacctcccgggttcaagcgattcttgtgcctcagccacccaagcagctgggattacaggcgtgcrccacaatacccagctaatttttgtatttttagtagagacagggttttgccatcttgcccaggctggtcttgaactcctggcctcaagtgatttgccctccccggcttcccaaattgctggggttacaggcatgagacaccgcacccaggcttgagatacagtattttaaaagacaggaatattaaagcaagacggtgaagaaaacgtttggagaagttaaagatacaggaaaatttgctgatatgaatttcagacagcatggtgtgttttagggagtaaggagaggtggaaggaacgtccgattaggaattataaaaagcattatgataataagcatccttaagatgaggaattgtctttggatggtgagtaaattaaatgaggatatgacacattttgggattaatctcaaaggatgatgagtaattagttatgtagagtatttagctgaaagatgcatagggccacaggaagctattcatccctgaagctcaagatgaygtgtggtcctacagaatggatgaggccctcttgagagataattctcataggcaattcactggactgtgataactcgagaaagggcctctcaaaccaggacctcaaaggacttgatcctattatttccttgaaaatcttgaactagcgtagtgcccaagatagaggagactatggtccattacccatacatgtataaacagataaggactgcaatctgaaatgatgatataataatatgtgttgagcattatgctccaggctctgtcctaaacattttttcttcataataatcctagaaagtagatattataaatcctatttttaaaatgaataaacttaggcataaaaaaaaaaaaaacaggcagagtaacacagctagtaagtagaggaaccagaattcaaacccaagcattctagtagttgatggcccattgtacttaatgagacctaatcaagggtcccctttctaaaatgatttcggtgagaattatatactttataaaccaattaactcagactgatgtggatttttattattattcctcagtgccaattccaggaaccatatttcagtttattttctatttctcaatttaggaaagagaaatgagagcaaacagataataagaagggagcacatagggaaactaaggaaagttttatcaagactaaggtcctccccctccttaaagccagtagagggaaaagaaaaaaaaaaaaaaagactaagggccaagcatggtggcttacacctgtaatcccagcactttgggaggccgaagtaggaggatcctggaggccaggaactcaagaccagcctggacaacatagtgaggctctgtctctacagaacaattaaaagaatyagtagggcatggtggcatgcctgtagtcctagctacatgggaggctgagttgggakgatcacttgagcccagtagtgagaggttatagtgagctatgcaaccactgaacttcaacctgggcaacagagtgaaaccctgtcyccccsaccccagccccccaaaaaaaacctaaggtcttccaagttcccttaacagtttcagtctttacaaaggctgagaagaaaaggaaaagggaatcaccttctctgctcatcatcagtcctacatgtcattctgggcctcggccacaccaccaaaatataagatgcctaaacaatccatgaaaaaatcacactacagctggcatagaggatttgatgctccctggtgagggtagtgtgagggattttttttctgatcttcttttcaaagggggattaacgctgatgcttttaagcaattgacgtgcacttagagatgtgggtatctagcacaatttacaagggaattgagcaagttcttggttgtttcagtaccataaacgcttgtttgtctagggaccttgtcctccttatttacctctttctaggcaggccctatttctagaaagtcagcctttttgcttctcctaccaaaacttaccctaaggctaaaaggcccaagaacacagggctttagtttgtgaatttagcctcattgaatcataaaagttgagcagaagaaaaattattaaaccctgtcattgatcgactgttgtggggtgggggttggggggaggggggagggatagcattaggaaatatacctaatgctaaatgacgagttaatggatgcagcacaccagcatggcacatgtatacatatgtaactaacctgcacattgtgcacatgtaccctaaaacttaaagtacaataataataaaataaaataaatwaatwaattaaattaaataaatgcagttccaaaagatggtgagaattatcaaactttgcatagtcatttaacagtcaatgtaagacaaataagactaatgcccagactttctccactgaatatagtgagggttcattctatggtagcttgtacaaattactatcaaagttaatatcattaaaccttctacaagtcttgccctagaatttaggttattttacaagagaaacattttagagctgaacaaaaagaacagaaacaaaatgttggagagggaagatggtcagtacgttaaagaaaaaaatgtttaaggaatattcagaaagaagagaaaattgtaaagaatatgaaggaaaacgtgctgaacttaaagtcaagcaaactggaagctaaaactgcctttaattttttgcataytcaggcacagcccttccctttctcaatctcggttttcttttcttataaaactagaacctttgtaacattgcctttctttggttcttgaggctatcacattagggaaagaagactctccaaactgaaaagatgaaagaaagagggagggagaaacggaaaagacaggagaaaggtggtgaatgaaatcagaatattggaaatatagtaaagctgaatattcccctgaaactttcactcctgcatagtgtctaagggggaaaagacatgggatcacttgcaagtgtggccactttatgagcctacctacaggsgaatggaaagtctaataacctgagggaggacactatttctgggaagacttttgggaaattgatggattattgaaactttagactgacttgaataattgttattgttctttagctttacctcaaggatccatgagtaagtttatcttcttgtttcaaactctsgtgttgttgggctcctatgctaggcagaggacttctccctgtcttaactatttcctgtttcctgctatgtcagggtgaaagggcttaagactcataattctccaccttgtccttcattagccatcttaactggatcatgcccacctttctcacatttccccctctctaagacaaggagacctcccaccttgcttaagcaaattattttattcttgcctttgaccacatcctctcacccccttatttcttcagaagtcatttcttctctcttctacatctttaaatattttccttcctttaattgcttctccttaaggtatagaacaggtttgattttcttccatcttaaacagatcctcccttgactatgtccctctctaatcacagcctaccttcaagggaggaaattatgctgtacactctgactgtaggcttaggaaaaagttattgctcacttcgtatctgaactatacactatttctccatgaattgagaataatataataagacctactaaaaaatcacttttaaaataaatttgcttgttaattattttcaatttacagaggactattgcctagcagttaagcatgcagactctagagccaggctaactggagttgtatcccagctccctacttactatttatttgaacataggcaagttatttaatctctcattaaaatttcaagtccgttacataactaatttcaacaaccagttgaaaattaatcaaataaaagaacagagaagaggctgggcaccatggctcacgcccgtaatcatgacaytttaggaggctgaggcaggtggatcacctgaggtcaggagttcgagaccagcctgctgaaaccccgtctctaccaaaaatacaaaattagttgggcgtggtggtatgctcctgtaattccagctactcgggaggctgaggcaggagaattgcttgaacctgggagaggaggttgcagtgagccaggatcgcaacactgccatccaacctgggtgacagagtgagactccatctcaaaaaaaaaaaaagaacagagaagtgagggaagctggaaaaaatgaatggagaagggaggaaaaccaaagaggtaaagtttaaataaaccttctgaaactgatttcaattgattgtcaaaaagaaaaaaaaaagaacacattttctaaatgaagggaagactgtgacaggaatgaggaggagggaagtgaggaaatcggcaaaaaatccaaaacagataatcctgactggacagggttttttttctgatctatgtgcttttcctacaaaagttttcatactgactattacatttgtggttgcatattagggtcacatttcctactagcaaagttgtttcttgttcaaagatggaattaaatatatcatatttcattattttttctaaaaggtatcaaaacttccagatgcttcacaatctgaacaagtttattactcacaggttttaattaaatgtgatccaaccaatacctatccttaaagtaacgaaaaggaagggattcacttgccctatcccaactcaggccrcaaccatatgatactgatttcaaagtgcactgttgttgaagtatagatggtgctcacttaaatctcttctcatctgaaaacrgagctcccaaattagccaccactagcccrgtgccacctatagatgtgttttgtttsgtcaggatggtattaytttaaattttgaatttgaatgcctctgggtagggcatggacttttcaccatctctatcccttataactagcagattcacaatcatgagacctgctgggccccttaatgcaactgagtttgtgatcratccccacagagataatcaggaattctgtctggtatggaaaatgtggtactctctaaaagaactaactctgatgctcccattaggaagaatatccacagagacaatgtccttaatccaaaacacacaatattcagtattttggcaggatawgtacatcgtaagttttttttatcttcttctttactctgtaaggcaacaagtaaataccttccactgccctgcttatttgtcttcagctgggaaacgccacaaaatactcagttcaagaatttcctttcttggcccagtatggaggctcacacctgtaatcccagcactttgggaggccgaggtgaggggatcactcaaggccaggagtttgagaccagcctggccaacatggygaaaccccatctctactaaaaatacaaaaattagcygggcgtggtggcacatgcctgtaatcccagctactcaggaggccgaggcacaagaatgacttcaacccaggaggtgaaggttgcagtgagctgagactgtgccactgcactccagtctgggtgacagagagagattgtctcaaaaaaaaaaaagaaagaaaaattcctttctcctcattatyccatattactttaggtcaggaatggaatatatatgacctgtgttacatttctgctcatgcctttgcctgtggcagaaatcagtaattgatcatgattctctttcctgctcagctcacatgtatcctaaaattcttgtcatctccagatagtcattaataattgatcaaaattaaatatgcataactcaagtatacttgtcactcctaccataggttaatatcttaaatcttaaaaaattaagtatatgaaaactgtccttttaaaattatctttatttggtggtaggagtggcttcaccttctcaagaaactgacagttcagtgattgacggcctaaaataccacatagaaaaacagacatctcttcccaaatgctgagggtagatcctgtcatttctggggaaagctactatttccctccccaaaacagcaaagtaacaaataagsgaaaaataattatacacaaagaaggaaacaaattattcaattaytttaagaaaaaaaattgcaaaattttcaacatcttaaaatatgattggttatttctcaagacagaagcaacagagattaaaatgacataattaaggtactaaggtacacaagaagatagggttgttttaaagattaaaataacagaaattaataaatcaaaaataaaaacagaattaagtgcacattataatrctctgctgtcaggactcagaactttccaaaggacagtcagaaataagaggaaaaattaaagcagaaaaaagtaaaatataaagtagcttactactttgccgaagtgtttcattcatttatagttactgaatatttctttccataacatttctaatacaacttttcatctttcccttctgttattactcctgatttttcactgcaacttcacaatataggtaagacagaggacacaacttctgttttagagatgaggaaattaatgttcaaaacatttagtgacttgcccaaaatcacagagctagagaatagcaaaagtcggactcagctctttaayctcaagactgtttgtaccacacctgaggagggggaggagggaatgggattgtctatctccatgccttctgaaagtctaaatctaagtaatgttacacttttcaatttttattataggtagtataaaatgtttacaaacaactgaagaacytccttgtaagtttcccatatatacaactcagtcctttttttactgacacctaataattgtacaaatttatgggatacatgtgatattttgatacatgcataccatgtgtaatgattttgatmttctataatgtgcctgctaccagaggaatggggaaggtggtgagaaagcacataaagatggaggaaaggagaaaaacttgcaattttactgttctctcttttaccagtgtgaggaatttgagrctgatttcaagatcctctaagtgactgattaattttttcatttaacaaagtggaaattcttataataaaaactagattaattaatgaaattgtgaaaaagattctggggccagggaaaattatctataacctttagaaggatttgacagcaggaagataatgaaaattaagaataagaaaaataactgcagggagtatgattttaacagtctcctaaggaaaaaaggaaaatgcctacttaccttcttgctgcctttccatgtaaatcaaatatgtagtaatgcttgatctgaaactccctgagataaacacccttgagtcatgctctcttcaaactcaccttttttgtttgtattttagccagaactgcaggagccatgagtaagttctttttctgccctttaattctcatgtgctttgctttactaaactgttagaatatgtaagacactcatattcctagatttttttatttctttcacaaattgtccattcctttccccttgtttattccctattcttatcttaataaactggggtgcctctgtaagaaagtactattgcctttaacttttccgaaatcttgagattcaacagcaaagggaaaagagtgaagaacaaaaaatggtcaagtgaaaggaagaaagattcccctgtgagaaaacccagtaacactcaaagaaagaggcttgatggtggccattctacttaagacccaccaagaaaatttcagtgacatgcagtgagtcccagctcactgaccgaggatcccagactgtcactgatgtttgtgtgggatgtatatcccctgttatgaacaaagaataaatctgaaataagtatccagatagaattttaaatgaaactgtagcatatatctctggaagaagcactggttgggaatagagaataaggaataagtgagaggaagttgatttaaaaaggaaaaaaaatggtaaatggaaacaatgacttttatatgatctgagattttgccagccctttatggccttgatgcttaaagtgggtccaagggcctgcatcaacgtcaccctggagttttagatatgcagagtctcagcctattgcccaccccgacctactaaatcagactctgcattttaataagattcccaggtgatttgcgtgcataccaaagtttaagaaccattgctctacaggattttaattctctgccctgagagaggaaataaaaagatgaatgcacttggtccaaatttaaccagcttttccagccctgcagattccccacaccaagagtgaccttaaagccaaagacaagaaagatgaaactcatcagggtttcattcacttcttaacacatttctatccttcatttttgaggatgttcagagcttgagcccctgagacaggactaactctgaaggaaggagaaaaaaagtgatttgataattaaagctcatgktatatcacatcctgtgtctactcctcttggaktatttacacaaatggaacattattaaaataatcaagtcaaactttgagagcaaatactgggtaggtatcataaaagcacatattaggccaagcacagtggctcatacatgtaaycccagcactttgggaggccaaggtgagagaatcacttatagcctatgaggtgtagagaggtgtggtggggtgtgtgtgtgtgtatgtgtatgtgtgtgtgtggtcataaagaagaagactgttactgcattattaacaagtatgtgggtctagtgtctcaattcctttgcccamcactcatacctataaatgtcttaagtcaacctagcagtttctattcccttttacatggcaggccaagttactctgttgaataagggccaaaatcactacagagacagcaattcccactgtctccttcagatgaggctatagattctagctaagcaagttcaaattagccagctggaagacaggcaatggcctgtgtaatctcctgagatacaagcaggacacccgtsrggaaaggggaaggaacrctgcctgaccaaatgtgcgtctccacagttccagctggcagattccaccagtaaccgggatcctccaagatgaagaaagaagcatttataaacttaatttgttcctccactgaagtggaaattttgctcctggtgtctacatttgtgatgttttcccaggaagaatttaaatgcaaacagtattttctcattagttctattttgttttttccatattttaactggaactattagacctataagtgagttccttttctgtttcctctaatgttctttggccttctgtaggatatagggtcctctccacatcctaactgttaccatttctacccctgcaggatttctcactcatacttcttaattgtattcaaatcttctgacaccttctgatgcccaagcaatcagacacaatatcctgaattgctactgagtttaggacaagggaaagccaaataattcatgtttaaaactgtagtttattttaattatttatatttattatttttagttacttaaatttctcatttaagatggatgctgaatgatttgatctggtaggagggttatgcagcttccaggctaagatcatctgcagtcccacagtagttgttctcctctggttgaattgcttcatagtttctttagaaacaatactggtaaaatgaaaattctattaatgtcaaaccacactttcctcctttttgtatttcagtgcaattcacagcccctattcgtaagtatcaagtttgtttttccactctggtccctttgatatctgacctacaaggtcttggggcctgatctgccctgcatttttaaaaataatttcaacttttattttagattccggtggtgcatatgcaggtttgctaatgggtatattgtgtgatgctgaggtttagsrgtgacttgcttttttaacactgtctttctcaactcccctggcattcctattacatagtttccaaagaggccatgcacgaagtgttaagaaatctcacaggctaacatttaaaaatataaaccaaaacagccctctyagaaatagtcataatgatccatcagcaagggaaggtacacctttcaaataaacyatgtcyctaaggaaactaggggcaaggggcaagaaaatgtaagaagaaaaatagaggcataacagattaatatggagtgagtctttcccaaccctctgaagattttcaaccatcactgaaagcaggaggaggcctccattcctgtaggtcccttatattgtgcagggagcctgcctgaggctygccatacaagcaactcttgatcttcccgttgtttctatttatgatactccctagagcgagtgttgggaaatggaaatttccttcacagtggtgaagcatactgrtatctttttctttctccctctttctctctcacagccggagctacaggacctatcagtaagtttgctctctgwttctccacagtgagcattttactttcctgcagtatcttagggatcgctacctggtttccatgttgggatttcaagggtttggagttcacattttcttcaacccttatttttcttcaacctagcatttcagtaagtcatgattagctgtgtgaatgtacacttcaccaataaaaacaaactacaaagtggagaatgaacccttgcagatttccaatggcttctcagcatcacacaagggatttttagatgaggaggcccttatatgtactagtttgccatagcaagaaagtcaccatttctactactcaactgcagctgaacttgacaatagtgatgcagattcctactagggaaagtatacaaattaaagtatataaataaaaagtatatataaaatatatatatagctactgatttcttttctcttttttttttagagctctctcaaaaaaccattggtaagtcatctgattctcaattataatgccttttagtactttacttagaacatcaatctatttttatttcaattattcatgcccaaggactcaaggatcaagtccttctgccacctcataatctcacccagtactccagattggaytcatccaggttctgcaataaaaatatattaactatgaagctgaaatgcaaagtgaaaaatatcctgctagagatggtcctaagctgtttccacttcagcatataatctagctctgtagagccaatacttaataaagacttagaacccagcacctaaacttcctgctgtgctttccatgcaaataatttttccattattagattatcttcactttgtaaaataatgcaaattttaagtttcctttctttattttttttgagatggagtctcgctctgtcatccgggctggagygcagtggcatgatctccaytcactgcaagctccamctcgtgggttcamgccgttctcctgtcttagcctaccgagtagctgggactacaggcacccaccaccaygcccggctaatttttttgtatttttagtagagatggggtttcactctgttagccagaatggtctcgatctcctgacctcgtgatccgcccgcctcagcctcccaaagtgttgggattacaggcgtgagcccccgcgcctggccttcctttcctttctaattgccctgaaaagttctctccagaagagttaggctctattttcagcaacttttagcaacctagtcacattctttgagtgatccctataatgtcttactactgtttttttaaccctcgcgtacattactttrttgcatctaaacaacattcaaatggcaatgagtaaggcagttattatccccatatttagagatgaggaaactgagggtcaggagtcatttctcaaaaaaataagaggatgggttagttaataaaattaagactgaagttttactaactcttcattctttccactatcatttttgggtgttataacaggttattaacaatgaataaaatgaagttctaatattgagattaaagggtagtaaaggcctagaggagaaaaagtgagagaatgagtaacacaaataataacagatacagaatgaagatgcagtttagaragagataaataggagaaaattkaaaaagaacaaaagtaggaagaaaattggaagcagaaagagtaagtgaattggcacataagagaataaagaagggaaatgagtakgttgagaaagagaataaaaataaaggtacaaaaagtcacaaattgaaacyggaaaggaaggaagaaaatatagaaaaactgaagaaacaaaattttgaagtgatcacctatccaaggatttagtaacttatgtcaagagggcaggtatcataagasttctacttcagaatcaaagatacatatttgtagatacaggcaaagcaactattaagttagcataatatctaaatgtgtaactggtttactgctcatagccaagggtatccagatctggaaagccatcttccaggtgttttacacaggaaaaaaaaaattcagagttaaaagttcgaggattattgatcaaaatgtggatatttctcattctgagtgacactgaagtgaaggattattaactgcaatgcccactgggtgaagatatggtctttttagattcaactaaccaygcagacttagaagattaccatagctctcatctgggaacagtctactcagtaggacctaaggsaggaagcacagtttgccagcaagggcattaacagctatccctctgctgtgggagtagtactcgccatgatctatgcaggtgtccacatagccacctaggacctattctgtttggccttctgtcagttgarttgggagctgacctagcttagaaaccccacagrtccaccaggaactaaaatctcctataagaaccccatacacattacctgcagggatcccgtaaggaatatgaccaaatacatgggtcactacactcagggaagcccaaagttatggcttcttaatacatatttacaattctcccagttcagatgcagtctaacatcaaggatcattcttatgtaagcagtgttgctaaataacataacaggctttcggctgggtgcagtaatcccagcactttgggaggctaagaccaggggatcacaaggtcagaagtttgagaccagcctggccaatatggtgaaaccccatctctacttaaaaaaatacaaaaattagctgggtgtggtgtcgtgcgcctgcagtcccagctactcaggaggctaaggcaggagaatcgcttgaacccaggaggcagaggttgcagtgagccgagatcgtgccactgcattccagcctgggcgacagagtaagactccgtctaaaaaaaaaacaacaacaaaaaaaacataacaggctttcgatatttatcaggtcaccaggcgatcagagctagaaaatcaactgaaggccaaattctcattaaaaactgaaggttttggccaggcatgggctcacacctgtaatttctgcactttgggaggctaagrcaggaggatcacttgagaccaggagttcaagatcagcctgagcaacaacagagcaagaccccatctctacaaaaatttttttaattagccaggaatagtggcatgcagctgtagtcctagctactcaagaggctgaggtgggaggatcacttgagcccaggaggtcgmgactgtagtgagctaggattgcaccactgcattccagcctgggtgacagagtgagaccttatctcaaaaaacaaaacaaaacaaaacaaaaaaaamcagaaggttttgttgactctttgctcacagactctaaagctaatcaaagcagcagtcactgctctatcactctccaataagctggaagctgtgagaagaagaaactagattcttacctcctattctaatgtctacctctggaacatattagttgatcagaaataaagattttagtgaaagaacagtcccttgagaaagaaatatcttctactcttactgacrggaagtgtttcacctttccctaccatcagtaatgttaatacctaataacaaagttttgcctttccctagtatcccttaggttggcaaggatcctataaaaaccttcaccttgggctgaaatattgcagtaaatgctaaatatcctttttccttttttctatagttaatatagttggattaagtctccctaatgatctcataactgatatcacttcctctcccctgctctacctctcaaagcctcacttctaggataaaattagtgaaaaatacactctmcaaataactgtactaatatgccaatttgaatttctttttagtgcaaactcyaggacctattggtaagctgcctgtatatatcaacttatctctactggcttcttactatgtctgaaggagactggctccaactgtttaagtatctgggttaaagaagytgaaaatcatatttcttagactttcatttccccatatcgtaactgttaggttttggagggaaggcgagggttaaagaaaagacacagagagagtggcggctgtacagcaaatgtaggctttaygtccagcataagacctacagaagtggggaaccagcctaatgccagtgcccactgctgcttacaggctgggggtacttataggtataggcgggaggggtctgggtagtatggcttgctggccggcaggatattgataagatgttcccatgatgagggggttctggcccttgttcctgcagaatgtagtgttccttgcactttctcccagctgaatatgacagggatgtttctttagttggccctttgtccaccttgtgttcaggtggttaggcagaatgtttctcacagcccgaacccccgtggaatgtttcacttttaccaaggtcttcaaattgctggaggcttacaaaatggtgcagtttggattaacactaaccatctctctgggcaaccaattatattttagaaaatggaaattccattaccttaaaattcataatagataggcattgttctaataatgattatagtggcttgtcagtaatcattagaataacttcctaaggcaaaggtgtaatcgaatctggaaaagaatataagaaatgaacaagaacataaagatagctgagagtgaaacagagtgatctgaggaaaaacactgggggaatatggggaaaggaatacaattaaggatctcatctccaacacctataatgaaaagcaagaatgaagtggttatgctaaaacagggttaataatctcctaaaagaagatctggttcttatggagaggctagagtacagcagcagtgcagtgaaaaatatttaatcctgaatactgagatttagtaattcctgagaaaatcattttcactgcttgcctttggaaaatatcactaatagaggtgttttggggccaggcgcagtggttcacacctgtaatcccagcactttgggaggccaaggatcacctgaggtcaggagttcgagaccagcctggccaacayggtgaaaccccatctctactaaaaatacaaaaaatagccaggcatggtggcgggcacctgtaatccctgctactcaggaggctgaggcacgagaatcccttgaacccagaaggtggaggttgcagtgagccaagatcaccctaccacactccagcctgggcgamagagtgagagactctgtctcaaaaaatagaagtgtgtgtgtgtgtgtgtgtgtgtgtgtgtgtgtgtgtttaatttgtttgtttctattttttagtacaatatcctggayccaatggtaagtaccttatctatccttctccctccaggttccttgatcttctacagtgtctagagggcctgttccctgtctcaaatgccctagatgtgtctcactgccataagagcagttattttacacatgtttttatgcttcctgatttcaacctactgagaattctccagggctattttttttaaaagaaaaagagtaagaaaatgtccccagaaatagtcataatgtcttctataacaatatacaagaattttctaaagtagcagagagagaataataagggcagctttccagttctgaagtgctttgtagtttctaaagggcctactcaaagataatggaggagacaatgaggaggaaatgagaaaagaaaatcaaattttaagaataaatacaaaagggagaaaagacaayaaaatttaacaggaaatactatgcagggtctagtctaacctgagttctccagtcttctctccaaaggcctttctctttcctcatgtcctatccggctcactatctccaaacatccccaacacacgtgcgcgcgcgcacacacacgcacgacagagaggaaaagaaagataggacagagcacctcatggaacaggatataacagtaattgggctgtaatttacaggaactggcagaagcatcacatatggaagagaataaaatgaaagttcatattgtgacgagctagggacaaactagggcatcgaaccaaccccaggacacgggaaattctgaatctagaaattaagggatagcattagaaagtttaagtcaagcaggaagaattatcagagggcaagtcacatatattcaaacaaacattccttcatctagctgagctcctaccatgtatctgatactaagctgagcactgaggataaagtcatgaataagggagagaaagatatggttggtcactgaygccatggagtttacagtcctataagataacttgggaaaacaaacccaaaatgtgtagagggcaggcagcatcccayacarccacactaygaccattaaaactggatwtttactgccctgaattctggttctaactatcctttttgtgaatgaataagagccatttgttattgactattcccctgaatcaagactgcttttctcagtactcacagattgccaagacttatagccttggaagttctcataattattacagggrggataaacataagccagctcacctcagaggawctcactggggctaaaggaagggtcacatctggtccacagttccctaatagccaccatgtgccagagaatctacatggatacatgaattccctttcccttttctccccgcttgactccctctcccttatgtgtaaacaatttaaaaatatgatagtgtataaatgaaaaatatattgctattttattcctttctagctttcccctaagttataagcgatttggagaaagtgcaaaatgaactgattaaaatttaaatgactttaacaaaaattagtggctcscaacagccctagtaaagaagagtaggaagaaagcttttcaagtcaataaaaattattgggtrgaatattcactatttgggtaatgggtacactaaaagcccagacttcaccactatgccatatatgacataagaaatctgtacttgtacctcttaaatataattaattaattaaaaggttagtgaacaagagtgactaaagaaaatgaggccagggccaggcatggtggctcatgcctgtaatctcagcactttgggagcccgaggcaggtggatcacgaggtcagsagttcgagaccagcctgacaaacatggtgaaaccccgtctctactaaaaatacaaaaatttggccaggcaaggtggctcatgcctgtaatcctagcactttgggaggccaaggtgggtggatcacttgaggtcagaagttcaagaccagcctggccaacatggtgaaacttcgtctctattaaaaatacaaaaaattggccaggcatggtagcgcatgcctgtagtcccagctacttgrgaggctgaggcaggagaatcacttgaacttgggaggtggagattgcagtgagccgagatctcaccactgcactccagcctgggtgacagagtgagactctgtctaaaaaaaaaaaatacaaaagttagctgggcgtggtggtgcacgcctgtaatctcagctactcaggaggcagaggcaggagaatcgcttgaacccrggaggtggaggttgcagtgagccgagatcgtgtcactgcccttcagcctgggcgacagarcgagactctgtctcaaaaacacacacamaaaaaaatgaggccgggcgcagtggctcacgcctataatcccagcactctgggaggccccgtgrgccagatcacttaaggtcagtagttcaagaccagcctggccaacatgatgaaaccgcgcctctattaaaaatacaaaaattaggcccggcgcactggtggctcacgcctgtaatccagcactttgggaggccaaggcgggcagatcacgaagtcaggagatggagaccatcctggctaacacagtgaaaccctgtctctactaaaaatacaaaaaaawaawaataataataagtcgggcatggtggcgggtgcctgtagttccaggtactygggaggctgaggcaggagaatggcatgaacccaggagccagagcttgcagtaagccgagatcacgccaccgcactccagcctgggtgacagagcaagactccgtctcaaaaaaaaaaaacctacaaaaatgagccagacttsgtggcaggtacctgtaatcgcttgaacctgggaggcagaggttgcagtgagctgaggtcatgccactgcactccagcctgggcaacagagcaagactctgtctcaaaaagaaaaaaaaaaaaaagaaagaaagaaaataaaagaaaaagaaaatgagactgacaaaagtacatataagtttaagacattatgaacctctagaagtgtttcaagcatttactgttcctaaatgaaatgagaaggaagaacaaagcctcactttaccactttatagccaatctcctgcctcagaccagcagaaacaggtctgaggctacaaagcacaaagtaaggcacgtaaggccggacatgcactgagctgtcagattttagggccccccatatcctctctgcagttaccctctttaagcctatcaagggagaactgaattcacttggttctacacatgttgatttctccattttgtgttccttccgttttttaccaccagatgaaacttcagaaatgactggttaagttccatgtctattgtatgatagctgcctttggcttcctatagggcctggcatacttttcctctytgctcatttctgtcttgtgtgtgtagaaactcacatttcttcatttcttttgcttattcctctatttagctgctgctccactcctataaggaatgaataaaggagaataccaaacccaaaatagagagataaagttcggaaactacccraagtttatagtgacttgtcaacaagggaagggaaggatatttgtatgaataaatgaaagctttcacaggatggcagaaatagggagaagaaaggtaaaggcagcacagtttaaagaaattaccaatccccygcaggatttccagcagtaaccactcactgcaaaaagggaagagatcaatcatctccctttcctgcagcctcctatactaagcagaaggcagaatccccacaaggcatgatggcaggtatattccccagcacagcgctctatgcccytgccctaagaaggatgtttcttccattgccatttctgatatttcctttcaggaaagtagtacgaaaactagctcctctttcagcaggctgtacacgttgatttatctttgtttttcagctacaggatcctcttgtaagtttgaccatttcccttcatgagtgaaactcaattatctccagcagtgtctaacatatcttaagccaaaatgtatgcatccacattgtgatatgataatgttccaatttccttggtcccttatttttccattactcagaacacaaatatatatttttttcagtgtcacgatcagactattacatttagcaataaacagcatgggtgcaaaaaaaaatctacattaaaaccctttgttggaatgctttacactttccacagaacagaaactaaaataacctgttatacaattagtcacaaatacagtcctcgagttttttgcccatacacatgagtatttgtctaaaacatgtcttctttgtaccagctaggccctgccaccactgtgcttggctgagttcacaaatctgttgtaacctgtagcttccctgtcacttctctggctctcctctcctgctaagctttgtttcctaattaaaatcttctgccactgccatagctactgctgctactggaaccacaatagccactttggtttcatggtttggcaaagtattggcctccaccaccatagaggccacagcttctgcctccaaagtttcctcccttcatgggtccaaaatttgaagactgattgttgtaattgccaaaatcattgtagcttccaccacctccaaaattgctcccatcattaccaaatccattatagccatcctcactgccaccatawccaccaccaccacagctgccaccaaagccaccacaaccactgaagtttcctccatgatcaaagttgtcattcccaccgaaaccacctccaygaccaccaccwaagtttccagaaccacttcgacctcttyggctggatggagcactagccatctcttgctttgacagrctttcctaacttcacagttgtggccattcacactgtggtatttctgaatgacagtcttatccacggagtcatggtcatcaaaggttacaaaggcaaakccccttttcttgcaactgcctcggtcagtcatgttttcaatcacttcaatttttccatactactcaaaataatttcttaggtgatttcttcagtgtcttctttaatgccaccagcatatatctttttcacagttaagtgggcacctggtatttgagaatcttctcttgagacagctctctttggttccacagctcttccatccaccttgtgtggccttgcattcacggctgcatccacctcctccacagtggcatatgtgaaaaatccaaagcccctggagcgcttgggtttggatctctcatgaccacactgtccgggagtgtccctcactgctcaaaatggctcctcaggctctcatcagttgtttcaaagctcaaccctccaatgaagagcttcctcagttgttctggctctttaggagactctgacttagataagacggccaggagaagagagactttaatgatgcttcttccgtggcatccatgggcagaaaggcataaataaattattaataagtttctagaacattcactgactcgcataaaaaataaagacctgagaaaaaagtttttacatgactctaaagaatgttaggaactttccatgcagaaggaaaaaaaatgacagaaaaatgatatagatccatttctgctttctagataagtcatctatacaggcaattagtcagttatttatttgtttctctgtggtgcayttatcaaagtccactgatgtctattggaacttgagttgcaacatggaacttgaagttctattttctcagccttttgtttttccattatccagaattcaaccagctgataattagttttctggaaatttctagtgcctttgattwaaaaaaaaatgttcaagcaagtatatcactagtaaatttaccaatagaaaaaaaaatgagtaggaaaagaaacaagaaaggggtaacaaaaagtatctttgcttgtttttcagtcagatcgcatcctcacacaatcagtaagtctatgtgttcattgaattctctcctttaggactcagttggtctctagtggagtccaagagtctttatctgcccatattgggatacaaagggcttgagatatatcttggcctcttgctgtctcattatcaaaacctctctgcattattcatgatgtactggaaagttttaagactatcaatttacaatcccctgcaggatttcaagcagttaccagtcactgcaaaaagggaagagataagtcagagcagagaaaaaaattttacaaaatttcaaagcccatcaacaagagactaccttaaaaagggaaaaaatggtaggagagaaaggagtagataagaagtttctataaccctttttcatttgaacctcctgccatatctggtctcttttttccacatttaaattccaaaacatctaagaaaaatttgtatcaccttttagagactttagaggatttaagcctaaactttaaataacaactttaagttgttatttcctccgtgttttgctttcatgtgacacatcattctctcaccttttaaataactctatggaaaaaatcaaacttactattttattaaaaaataaagggmaggggagaaagtttatcagcaggtcaaaatgatatattacaagggacttaacaaactgaaagacaatttgagcaatggggaaagaaaaaggagataattgtttctggtctagttgcaagctggattcatttcacttgccatcagtatgtccatgttttcaccaccgtaggattctggaatctctcctttccctggtacagctaagatttccaggcttggggtgcatactactttaaccacttactttcctatcatcaaaattccatgaagttattaatgattttttgaaagttcrcattctgctgattcatattaaaaataaatgaataccaaagggaaagttttccctattgttataatgacctaccaagaagaaactctctacatagaaaggaaaatatcatgggagaaaaaacagttgctaagatacctctctgtttttcagctggtccaccttcagcaccccgcggtaagttccatttctttttctactcttttctgttgttgttcttgttgttccctgcaaggcttagagacctgtctctaccctgctcatttctaactgtgtgcagctacctgactcaaagcttccagtttcctctgccttctgctcatccagcttctccctgagaaagaagttatatttacataatttcaaacatatatttactttgtatctcctctagaactatttaagtgctttaattacattacctcatttaatccttagaataattccaccaatccctttgtaagagataagaaactgagccaaatacttactcaagaatacatagtcatagaatcataatttagacccagaaaggtgtccaagtttctcccctacacaaatatacctccctagagggaaccttgtttcyttcaaagaaatcttcaccaatatctamtttggtttttaggtccacccatggcacccataagtaagtataacatctctttttcttctttggttctctatggtccccttcatttcacttctgtcaaagtgatttgagtttcccattcttctcttgcttccttattaccctgcttgccctataatttttttaaaatactaattaaaagygggactaagctagcattcatcaacaataaactgaacaatactaygaaataacaagtaggaggaattttcaggggggtggagagagaaagagagagagrgatgaaatccaaaatgatgtctaaatggagagaaaccttcagtgttctttcaaacattatagtgcaaggatccagtggtcttttcccaacactatgcccaaagctgttcaggtccaataagtggagagggcctttaaggaaactctacctttgacttcgtcattacatcatcactgctaaatcttacatctagttttgcattataaaactaatctaaaaccaaataatctatagggtggtttggaatacctccttcactgcccacccaagtcctcccctcacagactccagcaaaatatattagataatactatgtgttttctatttgagaaaaattaaatggatttctgtttgcttatttttcagtaatttcacagagaaccgcaagtaagtactctacttctcagctggtcatatgtggggacttttcttatcttagttrtttctatttctaagtgcctcatatttctcatattcatttgcttytacattacccaaagtcttcaagattaggactgcaagtcaacctttttgattcgtaactgtagtatttcccattattttagttctaaactcagcttccawggtaacacataccaacagtgactcaatatttaaaccaggtcaagcactaacaatgatgatatttaatayagaattcgtgaaaccgcctttcacactatgtcctacctttccaaaatgcaaatttggttctcatatctcagttacaaatgatttaagcaaacctaacatcgctgggattcctcagcctgaaattaaatcacactaatattaaaaaccaaagttcctgtcaaggttaaaaatgcagatgccaaaagagcccaggcaggtcagtaaatgagtgagatgaggtgaatctcctggraactgtgtaaaactgggaggacacatatagtctgaagagggtagctgctgcctgctccagccaacctcttcatgcaagaattcagattcagagttgccaaarcrtctcacttaatccagatagtaggtaaaattttccaagttttaaacatgacagacatctgggttactctaacagattgcaaacatacttacatactcccctctagttccatctaaacacactctggatacagttttcataataacattttactcatttcaataatgttaggacaaaggcattggtatttgagagaggagaattggagctattaacacagaattagccagtgtctctccaaagtcctcatccacacatctttctgaagcctgagcaaagaggctgatcggctaagtattctcacggcacagataaaaatacagagacaatggttccgacccagggatgaggctgcaaaatccatatgcccatgtttgggaataggccctataattgggcacagggaccaatgcccacctgargtcaggagaagggattactggtctcacagctagaaattacaagccaaaatccaaattgaaggcatagtgtccttttcagagaagtcatcagagagtatgggcaggaaaaagatgtaaaaatccaagacccaatagatatatagggtcttggatcctatatatcatcctagtagaggggatgaaaaaaagcacgcaaaagtaactagggattataccacctgctttttggatagctaagtgttggctggccaatcccattactgggtatagactcaaaggaatataaaccattctatcataaagacacwtgcacagttatgttaaacacagaactattcacaatagcaaatacatggaatcaacctaaatgcccatcaatggtagactgaataaagaaaatgtgatacatatacaccatggaatactacgcagccraaaaaagaatgagatcatgtcctttgctggaacacggatggatctagaggccattacccctagcaaactaatgcaggaacagaaaaccagataccacatgttcttatttataaaygggagctaaatgatgagaacacatggacacacagaggggaaaaatagacactggggcctgtcagagggtggagggtgggagcgggagaggatcaggaaaaataactagatttaatatctgggtagmaaaataatctgtacaacaaacccccatgacacaagtttacctatataacaaccttgcacatgtgtccctgaatttaaaataaaagtttaaaaagtgttacckggcaatatctataaatgaaaaatatacagccaagcttaagcataaaaaaggtgggtaagatttccaaggagcagaaattgaatataggaacacattgcaagaagaagctaaagttaagctcttggtgggaacagtgaggggatgaaaaaatagagatgacagctttgcctcaggaacaaaggtagggtttcaacatctgctcccaaatgacagcaaaagcctcaagatacaacatgcggaaaactgaaattaggcccctctgagtaaagccrgtagcagaaaatatactgcctccccatgcacagaagccaaaatatcttcacccatctgccccaggcatgaaaacagagccacccacacaggtccagagttrgatctgtccagggtgcagagccctgctggaggtgtgctacccatgcartgtgcataatattccaagtcaaaacagctgagatctggttaagtggcagtgtacccaggaagttaggacaatagccaccaagaagagagccacaacccagggtatttatatcatagaatatccatgaaagatagcccccaaggaataagaaactactaaaagttmtgaaatctatgagaaaatccagcaccatgtgagtggtgagtgatacctcacaagccccaacaaattggagaattccaacccagagaaatataactagagcaatctgaagaagactaaaataaggaacctaacagcrctgaacaagtcaaacactaaaggaaaaaaaagaaaaagtcttcaaagatattaatgcattttaaaaatatatgtattcaacaaatatatattggcctattgtaggccaggcattatcctaagcactgraaatatagccatgagcaagacaaagtccttgcacttaaggagtttatatgttgagataaaacaggcaaataatgccaagtaaacatatactaaatgtcaggcagataaattcatgyagaaaaataagaagagtaacagactaaagaaagatggtatagaagggggagtgtgcttcaggcaaaaggaacaagtacaacatgcacaggcctgctatggaggtgcaaaacagccagccaggctagaaagaaggaggcagagcaggaggtagggccagagcgacaaragccagattatgtcgggccctgcagtccttaataaaaarttgcagatttcattctaggtgtcatgagaggcaactgaagggcttgaacagggaaatgatagggcccactttataattttaaaagatcactctattattgtggaggattaactggggtgagagtgagggctcaagagggcaagtaggaagaccagttaagaggcctgaaaytaaggtkagtgtggcaaggagagagtgatcagagtggaagtgggaagaaggtcttcagattttatttattttgggggcaaagccaacagggcctgctgttcgactgaatgtgattttaagggaaaaagaagacmccaagggttactcctagatttggggtctaagaaacttgacgaatgagactatttattcatttaggtagcggagaagagcagatttataggatgctattgtgagttcagttttgcatatgttaggttctagatgcctgggatatttaggactaattaattaaataatctgaccttagcaggcttcaagcatgttttctggaaaatatctcctctctgtcccttaatgatgcattagaacccataattttatcttttttatctttgtaaataacagctttattgagatgatattcacataygacayaattcactcatttaaagtgtggaatttaatgctttttagtatattcactgggttgtgcaaccatcaccacaatgaattttagaacattctcatcaccccccagaaaaactctgtttagcaatcacttcccactatcccccaacccaaaaccctctccacaccatagccccaggcaaccactaatcttctttctgtctctatagattcagctgttctggacatttcatataaatggaatcaaacaataggaggtcttttgtgcctggcttcttccatttagcataaggttcaccaggttcatccacatggtaatatgcagcagtacttcagttctttttatggccaaataatatttcattatgtctttggttggctttttttagctttcctttatttacttgtaaggaaatattatgataagtagtatcaacttgctttctttatttttatttaagttttaagttcagggatacatgtgcagtttgttatataggtaaacttgtgtcatgcaggtttgttgtacagattatttcatcacccaggtattaagcctagaaccccttagttatttttcctgwctgtctacgtcctctcaccctccacccttcaataagccccagtgcctgttgtttccttctgtgtccatgtgttctcatcatttatctcccatttgtaagtgagaacatgtggtatttggttctctcttcctgcattagtttgctaaggataacgccctccagctccatccatgttcctgcaaaggacatgatcttgttcctttttatggctgcatggtattacatggtgtatatgtacattttatttatccagtctatcgttgacgggcatttaggttgattccatgtcattgttactgtgaatagtgctgcaataaacacacgtgtgtttctttatgatagaacaatttttattactttgggcatatagccagaaatgggattgctgggtcgaatggtagctccgttttggggtctttgaggaattgccacactgtttcccacaatggttgaactaatttacgttgccaccaacaaggtaaaactgttcctttttctccacagcctccccagtatctgttattttctgacattttgataatggccattctgcctggtgcgagatggtatctcattgtggttttgacttgcatttctctaacaatcagtgatgttgagcttttcttcatatgtttgtgagctgcatgtacgtcttcttttgaaaagtgcctattccctttttttgccaactttttaatgggattgtttttgtcttgtaaatttgtttaagttccttacaggcgctggatattagacctttgccagatgcatagtttgcaaaaactttctcccattctgtaggttgcctatttactctgttgacagtttcttttgctgggcagaagctctttagttcaattagatcccatctgtcaatttttgcttttgttacagttgcttttgttgtcttcatcatgaaatttttgcccattcctatgtccagaatggtattgcctaggtggtcttccagggtttttatagctttgggttttacacttaaatctttaaaccatcttgagttaattttcgtatgtggtgtaaggaaggagtccagcttcaatcttctgcatatggctggccagttatcccagtatcgtttattgaataggaagccctttccccattgcttgtttttctcagctttgttaaagwtcagatagttgtagtcatgtggccttatttctgggctctstattctgttgcattgatctatgtgtctatttcctactagtgccatactgttttgcttactgtagcctggtagcataccataattttctaatcatgttaaattattaaaaacactcaggccaacccctcttaaaaccctctcctctcctagtggccagtctcaggcacactgactcagaatagggaggagaaatttttttgtatttttagaacatcacagtgttcgccaggatggtcttgatctcctgacctcrtgatccgcctgcctcgacctcccaaagtgctgggattacaggtgtgagccaaggmgcctggcctaccctactcatttctaactctgtgtgcagctacctgactcaaagctcccagtttcctctgccctctgctaatctagcttctccctgagaaggaagcttacatttacatgatttcaaacacatatgtactttgcacctcctatagaattatataggtgctttaattacatwatcccatttaatccttagaatcactccactaacccctttgtaagagataagaaactgacccaaatacttacccaagaatgcartcataaagaattggagcttttaacagagaattagccattgtcatccagagctgtgtgactaccaagattctccccaacacaaatatctctccctagaaggaaacttgctcctttcaaacaaatcttcactgatatctaatttttttaggtcagctggcagcacctataagtaagtattacatgtctttttctactttggttctctttggtccccttcacttcacttctgtcmaagtgatttgtggttcccattattcccttgcttccttattaccctacatggtctatattacagagaatctttttaaacactaattaaaagagggactaagctaggattcatcagtaataaactgaacaatattatgaaataacacgtaagcagaattattgagagatgaaatccataatgatgtttaaatggagagaggctttcagtgttctctcaaacattataatgctattcaaaggaaacagaaagatatggcagtctctacccgagactatacccaaagctgttgggtccagtaaatgaagagggcctttaaggaaaccctacctttgatttcatcacatcatcactgcctaatcttatatctagttttgcattgtaaaactaatctaaaactaatctatagggtggtttggaatgcttccttctttgcccacacaagtcctcccctcacagactccaacaaaatatgttagataatgctatgttttctccatttgagaaaaattaaatggatttctttttgcttattttttagtaatttcgcagagaactgcaagtaagttctttatttctcagctggtcatatgtggagatttatgttagatgtttccacttctaagtatccaaaagattgagactcatatttctcatattcatttgcttctacattacccaaagtcctccagattaggactgcaagacaaactttttgattcataactgtaatatttcccattatttaggtttttttgttttgttttgttttgagacagagtctcactctgtcacacaggctggagtgcagtggcgtgatctaggctcactgcaacctccacctgccgagtccaagcaattctcctgcctgagcctcccaagtggctagcaatacaggtgcaagccaccatgcccagctaattattgtatttttagtagagacagggtttcctcatttggccaggctgttcttgaactcctgacctcaagtgatccgcccgcgttggcctcccaaagtgctgggtttacaggtgtgaaccaccacgcccagccccattattttagttctaaacccaacttccaaggtaacacataccaacagtgactcaatttttaaaccagatcaagcgttgaccatgatgatatttaatatagaattcgtgaaagcacctttcacactgtgtcctagttttccaaaatgcaaatctggttctcatatctcagttacaaatgatttaagcaaacccaatatcagctgagattcctcatcctgaaattaaatcacattaatattaaaacccaaagttcctgtcaaggttaaaaacgcagatgccaaaagagcccaggcaggtcagtaaatgagcgagttgaggtgagtctcctgggaactgtgttaaactgggaggacacgcatagtctgaagaaggtagctgctgcccagctccagccaacctcttcatgcaagaagcatctcacttaatccagatagtaggtaaaattttccaatttttaaacatgaaagacatctatgttattctaacagatttcaaatatgcttatatatcctcctccagttccttctaaacacactctggatatagttttcataataacaacattttattaatttcaataatgttaggacaaagacattggtatttgagtgaagagaaatggaactgtcaacaaagaattataagtgagtgtctctccaaaatccctatccacatacctttctgaagcctgagcaaagaggctgatcagctaagtattctcactgcacagatgaaaatacatactcagtggttgagacccagaaatgaagctggaaattccagatgtctatgtttgcacatgggccatataattgggaacagagaccaaggcccaccaaagttcaggagaagggattattggtctcacagctagaaattacaaggcagaacccaaattgaatgcatagtgtccttttcagaggagtcatcaaagaggatgggcagggaaataatgtaaaaatccaatacccgaggggtagggagaaagaaaaaaggaawgcyaaagtaactagggtttataacacctcatttttggctggctaagtcttggctggaaatatttttaaatgaaaaatgcacagtcatacctaagcataaagaaggagggtaagagtgatttccaaggagcagaaatggaatataggaacacatataaagaaaggaaagctaaagttaagctcttgggaggaatggtgaggggatgaggaaacagaggtagcagctttgcctcaggaacaaaggtagggtttcaacacctgatcctagatggtggacaaagcctcaagatacaacatgtagaaaactggaattccaccacttggagtaaagccaggagcagaaaacacrctgcctccccaygcggagaagccaaaatatcttcacccatctgccccaggcatgaaaacaaagccayccacacaggtccagagttagatctgtccagggtgcagagccctgctggaggtgtgctacccatgcagtgtgcataatattccaagttaaaacagctgagatctggttcagwggcagtgtacccaggaagttaggacaatagccaccaagaagggatccacaacccagggtatttatatcatagaatatccatgaaagatagcccccaaggaataagaaactactaaaagttatgaaatctatgagaaaatccagcaccatrtgagtgatacctcacaagtcccaacaaattggagaattccaacccagagaaatataactagagcaatctgaagaagactaaaataagaaacctaacagcattgaacaagtcaaacactaaaggaaaaaaaagaaaaagtcttcaaagatattaatgcaytttaaaaatatatgtattcaacaaatatatattggcctattgtaggccaggcattatcctaagcactggaaatatagccatgagcaagacaaagtccttgcacttaaggagtttatatgttgagataaaacaggcaaataatgccaagtaaacatayastaaatgtcaggcagataaattcatgtagaaaaataagaagagtaacagactaaagaaagatggtatagaagggggagtgtgcttcaggcaaaaggaacaagtacaacatgcacaggcctgctatggaggtgcaaaacagccagccaggctagaaagaaggaggcagagcaggaggtagggccagagcgacaaaagccagattatgtcgggccctgcagtccttaataaaaaattgcagatttcattctaggcatcatgagaagtaactgaagggcttgaacagggaaatgatagggtctactttataattttaaaagatcactctattattgtggaggattaactggrgtgagagtgagggctcaagagggcaagtaggaagaccagttaagaggcctgaaactaaaggtgagtgtggcaakgagaagagtgatcagagtggaagtgggaagaaggtcttcagattttatttattttgggggcaaagccaacagggcctgctgttcgactgaatgtgattttaagggaaaaagaagacaccaagggttactcctagatttggggtctaagaaacttgacraatgaaactatttattgatttaggtagtggagaagagcagatttataggatgctattgtgagttcagttttgtgtatgcttggttctagatgcctggaacatttaggactaattaatyaaataatctgaccttagcaagcttcaagcatgttctctgccatgtgtctccttcctatcatttaatgatgtcttagaacccataattttctagttatgctaaattatttaaaatgcttaagccatcccctttaaaaccctctcctctcctaatggcccgtcycaggcacactgactcagaatggggaggagaaatacaatgtgcttccccttcctgtccactctccttgttgctataattcccaccgttgttataattcccactgttgaggctgagaggatggatttggggcatgcaatctccttcctctgttagttgtaggttcttttctctgagaacctgagactgactgtcctttgatgtcatctagagcagacacccaaatgtcttgyacaatacatattccagttctttggaggaacatacaagaactcgaccatgyctagtccctgatgtgggagtactgactctagtcttgccaattccagagcccctcaactccctctcgagcaatacacttcattgctygtactgcagagatgcccttaccaagtaggccacccacttgagtgacatactagcaagaaggctcaagccaggatgtattttgcactgcccactgaaccctcaggaggctcaagaatccttatcacagaacaaggacactctgcactactgtctctctccaattttattttccttcattcagataggcacaaaacaaatcaacaaatccactattcaaccaggagatgggttgccacacatcctttctcacagatacccccaatcactgtaagcaaatctcaaagtgctactcatttgccttcagaaaaagaaagcgctattcttcctcccctacaacaccattcctttgttaactactcacaactctaaagactcttaaatctcctgccctttacagttgtttgcttatgttgtcttggaaaaagggtgacacttgagataggagagctaatttggccatcatgtcaaggccggcragcagcacctctgcactgcacagcctcaagaatcctttcccttttaattatggagytggcaatgctgcaatccctcctgagggcttgtctcacctcagtttgctgaggagggtaatgggaagttataacctctttttcctcagctttgtgatcctacttgtcaatttgggagtaacaagaaaaatcccactaaacattctgccccccatccaagcatatactctatatcaaaaggcaattaaatatttgagtctgaagatttagggagagattgggtgggaaataaattagacagtaatcagcatataggtaacatttaagacgattggactaaattagataatcaaaggtatatgtaaaaatgaaggggtaaggattaatcagttttagaagtttagaatgagaaaaatctaactatgcatatagagaagtagtgagcagggagaaagaaggagaaccagtaaagggggggtctcgcagcactcaagagaagatagtatttcaatatggaaaaaataaacaacagcatcaaaaacagctaagcaatraatttttggagtaagaactgacaaggaattttgcaaaatgaatgtcataagtaaccttgataagataggagggaagaaatgcctaaatggaggaggtgaaggagataataaaattttaaacggtaaggcagctgatacggcatatgacagctagtayagcatgaaaaggccacgaaaggctggagttctgataggttgtggcttacctattggggaataaaagaaagactatcctttctaaaaagattaaaaatatatatatatatatatgtatatatatttgagagatagtttgaagaaagaacaggcagatttaaaaaagaaccaagctgaaaccttgaaaataagaaagttattagaattgaaacaatgattagataatatataaattctaatgtaactatatgtaaataatatttaaatattattaatcacagtttaaaagagtaaactggaagacagaactgaggaaatctcagttcaaaatagtacatggaaaatattgaaaatctcagctcaaaataayacacagaagatattgaaaatatgaaaaagaagagctgtaaatagaatgaggtcaggtgtaatggaatttgataagagagaattaaaagaataaatgtcaggtaataattttaaatgtaataattaataacattccagaagaaaagagacataaatcctcagatcataatggtccactgaaagctgaaattagataactttaaaacacacagacagatatatacacacacacacacttacatgtgccaaaactcatcgtagtaagctgacagacattaaaaagcaaatcataaagacaaccagagaagcagatcacctgcaaaaaatcatgttaacactagacatctcattagcaataatatgtgccagaatacaacagaacaagaatgaaatccaaacaagaatgagatcctatcatttgcaacaacctggatggaaatgaaggtcattatgttaagtgaaataagccaggcatagaaccacagacttcacatgtccatactcatttgtgggaactaaaaattaaaacattgaactcatggagatagagagtagaatgatggttaccagagcctggggagggtagtcaggagagagaaaaattgggaatggttaataggtacaaaaatagttagatagaatggataagatctaatatttgatagcacaacagggtgactatagtcaaaggaaatttattgtacattttkaaacaaytaaaagaatataattgcaatgtttgtaacacaaagaaatgataaatgcttaaggtgatattcagttaamcctgatgtgattactacacattattacacattgtatgagtgtaccaaaatatttcatgtacctacttgcacctactatatacccataaaaattaaaaataaaaaaattttaaaaagaatacaacagaacaatatcatcaaaagactgaaggaaaattactataaacccataagatacaatcagcaaaattatcatttatgagtgagactgaaatgaagtcattttgtatattcaagaacatagaaactcattaaacacaggtccccartgaaagaattatcaaagggacatacttcagggagtttacttttgagtaaaaactcaaaaagaagttagaaccaagaaacatatgtaagaaaacaaatcaacaaaacatgacagtaaatctaaaatgttgactataaagaaaaaaaagagaaggaagagaagaaggagaaggaaaagcagaaagaggctgagcacagtggttcacacctataagccctgcactttgggaggccagggcaggtggattgcttgagctcaggagttggagaccaggctgggcaccatggtgaaatcctgtctctacaaaaaatacaaacatcaggtgagtgtggtggtgcatgcctgtagtcacagctactcagtaggctgaggtgggaggattgctcgagcctgggaggtcaaagcagcagtaagccrtgatcatgccaccgcactccagcctaggagcaagaccctgtcaaaaaaaaaaaaaaaagcaggaagaaaagaaggagaaggagagagtgaaggagaaatatattagtgtgctttaaaatgagtagacctaaagcattagggaaaaaaaccttagagacaaggctaatgattatgaactaagataatttgacaaaaggtcagatgtactgattaacttttcatcttattaaatatatacatttgaatatttatggcaaaaataaaagacaactattaatataatagaaatgygacatacatcttctgaacccatagggaaaataaaaagaagaaagaaaactatattagtccacaagaaagcaagaaaaaagaaaaagagaaagcaaataaaaagcaaaattttttttttttttttttttgagacggagtctcgctctgtcgcccaggctggagtgcagtggcgggatctcggctcactgcaagctccgcctccygggttcacgccattctcctgcctcagcctcccaagtagctgggactacaggcgcccgccactacgcccggctaattttttgtatttttagtagagacggggtttcaccgttttagccgggatggtctcgayctcctgacctcgtgatccgcccgcctcggcctcccaaagtgctgggattacaggcgtgaaaaagcaaatttttttaaatgagggttaaaaaagtctaaatatgttgcttagcacaatattatacaatagtagattaaactcacagattaaaagctagaaactctcagatgtaattaaaagaattaaatttttttaatttttctattttcctataaaaaaataagaaaaatagctaaactctattaagaaatatacctaaaataaggtgacacacagaaaaatttaaatgaaggaattttaaaacataccaggcaattggccaggtgcggtggctcatgcctgtaattccagcgctttgggaggccaaagcgggtagatcacttgaggtcaggagttcgagacccacctggccaacatggtgaaaccctgtctctactaaaaatacaaaattagccaggcatggtggcacatgcttgtcatcccagctacttgagaggctgaggctggagagtcacttgaacctaggaggcagaggttgcggtgagccgagattgcaccattgcactccagcctaagtgacaagagcgaaattctgtctcaaaaaaaaaaaaaamcaggcaattaacaacaaaacaaaacttgatataattgtgcaaatatcagataaaatataagtgaaagttgtgagcttatagcatagcctttgaaatacataaaacaaaaactgacaaaatagcaaagacatctgtaactaaataaagatattttaataatatttctctcataaaataaacagacaaaaattagtaaggctagagaggctttgacataattttagaaagctttatctagtaatgtacactgaacattccaccaagcaagcacagatggaaaagattaccttgaccaccaattccttcaactagagcaagcctcaactaatttcaaagtacacttcaacataatataaatcacattttctgagcacaaggcaacaaaacagaaataaataacaaaaaatattaacatatacatatttagaaacaaaaaagcatacatccaaataatccacaggttacaaacaaaattgtgagagaaattacagaatatatagaaataagtgagtataaaatcattacttgtcaaaacacttaggatacaaccaaaatatcatttagagagaaattattatggtaaatggttttaatagaaattattcattaataaaaattgatgaactaaacatgagctcaagatgattaaaaaaggaaaaatctcaagagtaggacmcaataataaaaatgtcctacttttattaggcaaaaattaatgaaatgaaaagtatttaaaaatamcagaataattttgattattttgaamcaaaattaaagaaaaggaaaagcactamcaatacaaggaacaaaatagaaatgtggagagaaagcaaaatttcctcaaaatcataagaaaatgcactaaaaaaatggaaatactgcaaaatgaatactttgttagcctagccaaatcatctattttgcctgagcacttgacattaaacatgacagtcagaaaaaccttgtatcatgagataaactgaggatggcaggaggtgaaaaaagaaggaaagaaaaccagaaggaagggaaggagagaaggagggagggagggacagacaacttgctttatatgttcttaaattgaataatagttccatttagcactgcaacctaaaataaaggcttaagttcatatgctttacattgctggcttcctaatggaaacaattttagtgctgatttttacaatattgatacacataaatgtaagtaaccaaacccaggtttggctgcttgcagctgaaaagccagacatgagagacaagggttggtgggatgaaaagcagattatattggagagtcagcaaaccgagaagatggagaaccagcattctaaagtaccacccttctaatgtctttcaggctggctggagggtttctatgggaggggggatatggggaaattatgcgcaggagttagaatcaagagatgactgaggaacacagagatctggatgccagcaagagtcagaggaggttgggaacgtctttgtccttggtcaggtcacaatgctcccgtaaatctttaacaaaacataattagttgtttacataattcccccttagtcgtacagttagtttcaaaaattccatgattgctgtttttgcattttatcttagtgttctaaaattgtcctaacttacatgcaggaatgggtgaaggtcctttaaacaaaaaaagagttcatgttagttattttgctgtttcactgtcatacaaatgtgttatgacccttgccaatatataattatgatggagaattatttttccaccaatgagaataattggcaaactgaccaactttatagattatgccccttaaactcctgctatgtctcttattaagtgagccagttcttctgaagacaggacttgcttgcaagcactgcaacttaaaaaagaaaagaaaaatgtttctcagttccaatttgcctccagtttttattgacaatacagacctttaaaaaacatatgacctggccaggcgtggtggctcatgcctgtaatcccagcactttggaaggccaaggcaggaggattgcctgaggtcaggagttcgagacyagcctggccaacatggcaaaaccccatctctactaaaaatacaaaaattagctgggtgtggtggcacacacctgtaatcccagctacttgggaggctgaggtaggagaatcgggctgcttttcttcatggcccaataacgagatgcagatgaactgagaaagaagacagtttttatttatataagtaggtacagagagaaggcctggaaatttttgccagaccaactgaaaattacaaagttttccagagccaatataccttctaagctatatgtctacgtgtaagtgtgcattcatctaaagacataagtcattaacttcttctaatstgtgactaagatgtgagtcctgaaggctttcctctagagcttcagtaaatttacttaatctaaatgggtccaggtgctggagtgattacccttatctygtctcctgctaaatatggagttccttcagaagacccccaataaacttgtttgtgaaggcctggggagtttcttcagaccccccaataaacttgttttaatcctaaacgggtcctgttaagaattccttcgtaatcttgtcatgcttcaaggcccaggaaaggcctaggcaaactcttggtgggcttgttacattctagcctggctctatcagctttcaacatttaacttaaccactcagtcagtgctgaaacagttgttatggaggcctgcgttagcgagacctgccctgccacagtaaggcaaagagtaagtaaacttagtaatggaaatctagaaggagaatacaatgaatggtgaagaagagaacagatattttgagattagagactgaaataggaaaaaaagtaaaagaagcaaaacttaaaataagtattactaactcttgaagagttttaaattctcataaaaactgaaaagaaaaagaaaaggtgctaaactcaactacattttaattacaaataaactttctgtactgtaaaaaaaatacagtgagagctggtataatggtagagatttgaaaggaagagaaaacatgaaaagacaaaaaagacgatgaagagakaacrtaaattagtaacctttaactattagccagtctcctgaaagaatgtgacctagtttaagaatgtttaaaaaaatattttatttcattagaaaaagtggccttcactyatataacccatcatacstgccattcaaaatggcctggatatttaagttattaaagtggagttaaaattgacttaataagagatagcatattcctagaagatttaatgtttcccaaaggtctgttttctggtgttccaagtggattttcaataggaactcaatacataatttaaaaaaaaactgatttgttttattttatttttagcaattggtccaatagcaaccagtaagctcctactgtttttctcagtttcctctggtcttttgtagcatctcgattcctttatttgcactgacacttttgttgtttttggtttctattttggtttagtttgggtctttctttctttctttcttttgttcattcgctcrttctttcttcttccttcctttctttctttcttcttcctgtctttgtcttttaaataagtcaaaggcccacagaaacaagaaaccacatagaaaggaccaaaatcaatttgttcttctggttagagagttaagttgcaaaagagaagcmagaggaaataatgctgggaaaatatgctgggaagactatggaaataatacactaagaagtttgtatcacagtctgaagccacagggtcacaagatgaaactccaaaagataaaaggtagaaataataaaaacwagaagatgtagcaaatgggagtagaagaagggacagactgcaaaatgcaaacagagaaaacactaaaatagaattcaagataaaaaagaaagattgatctttgccttttcctccataaagtttattacatctaaacttggaccactagtgctgcagagattaagccttttctgacttcccctccttgaaagaattgggacttgcctctcataacaatcaggcawatcacagaaatttattttgtgtaggtctaaatacaccaattttttcaaaagattaccagagtacattaaaaacatgacctaactatatcctatctacaagaaagtcacctcaaatttaacaataaaagtaaaaagaatgaaaaatatatgccatgaaacattaattttttcaaaaaaaaaggcagatgtggctacattaatatcacgtaaagtggacctaaatgcaaagaaatttaccagggacaaaagagggacattatatcatgataaaaatatcaatgcatcaagaagacaaagaaattctacatatgtatgaaccaaacaacagtgcttcaaaacacactgggaaaaaaaaaaacacgtactagaactgaagagaaacagaaaaacccacaactacagttggaaagtttaatgcctcattctcagcaattgctataactactagatggaacatgaaataggtgagagaattagccaggcaatatctgaggggggaatatttcaatcagagaagacaacaagtaaaccaccctagggtaggaacatttccagactatttgaggaaaagcaagatagcaagtaccatatagctggaacagaatgaaaagtgacataaaaagaagctataagagagatttggagggacagatcttccagggccatctttgaaagccactgttgtgattttgacttttgttaaaccaagatggggaaccattggtggctcttaagcaggagtcttgctgacactttaaaagggtcccgctaactgctgtactgggaactgactgggaggcaagggtgaaagcagagagctcaattagagagacaacaataagttggaccacataaaggtggtaaaaactgtcaggttcttataacacactaagggatctgttgtctcatcatatttcattgtattctgctagaagtctttatggtacccyagaaaaaacaactagggaattgggagtaggaaagaactgtacttctgttccaaaaatgctgccattaacctattttcttgttttgattttcaggaatacctcaagttcacactagtaagttcctaatatatttttattacattagtttcttgtagggctggrgtgagcaaattttttctacaaatgtttttaatgttttatgtttgtttttgtttgctgggtttttgtgttttttggtttgtttggtgtttttggttttgttttgttctgagacagggtcttgctctgtcacctagcctggagtgcagtggtgtgatcatagttcactacaacctccactcctgggctcaagcaattctcctgcctcagcctcctgagtagctgggactacagatgtgtgccaccatgcttggctaacttttttttattttttgtagaaactgagtcttgctatgttgcctaggctggtctcaaagtcctggcctcaaacratccccttgccttagcctcctaaagtgctgggattacaggtataagccaccatgcccagccaaatattttaaattttataagccttaaagtctctgtcacaactactcaaccctgctgttgtagcacaaaaacagtcatagacaatatataaaagaatgarcatgggtatgtcccaataaaatactattttagacattgaaatttgaatttcatacaattttcatgtgccacaaaatattattattattattattattattattattattattattatttcaactatttaaatatgtaaaatccattcttacctcacaggacatgcaaaaatagcatgtcctagatgctatttttatttggaaaactagatttatatggaaaaactagatttattccatgggctgtattttgccaactcccatttttaaataccctaactccacatatgtatctctggtaaacaatcctggtatatgtttcttacagtttcatgctttcttattattctgtgcttttttttttttttaaaacagcgtttcactcacccaggctagagtgcactggtgtgatcatggcccactgcagccttgacttcctaagcaatcctcccacctcagctttctgagcagctgggactacaggtgcttgccaccatacccagctaattttttctttttttttttgcagagatggggatctcattatgttgcccaggctggtcttgaactcctaggctcaagccatccgcctgcctcacagccttccaaagtgctgggattacaggcatgagccacggcgccagcctattttgtgctttctatgttaggtttatcaagtaacatcaacacaagagatatacctatatttcagtacttggtaacaactgtatcttaaatatttcgtaccaggccaggcatggtggcttacacctgtaatcccagcactttgagaagccaaagcaggtggatcgctggagctcagggttccagaccagcctgggcaacgtgatgaaactccgtctctacaaaaaaatacaaaaattagctgggtgtggtagcacgcacctgtagtcccagctactcaggaggctgaaactggaggatcgcttgaaccccggaagtggaagctgcagtgagccatgttcatgccactgcactgcagcctgggagactgagaccctgtctcaaaaaaatatattaaaaaaaaattcgtatcamtgtcaaaaaataatgttagcacacatcttctaagcaagaccattatatgtcctatattttataaattgtaatcttgacattctagacaaaattgmtaatgatcaatgataagtaaaggtgatttaaagtagcttatcacaaggtctttgtaaactacactgggcaaagagaagggggaagggaaatgaagtttcttcacatttaaataaatgaaatttagttgttaatgacacagatcccactcaatgcagaggtttggggactgggaagaagggaatgcccagtacctactgawgtgtttgcctttrtctctttcagtggacagttctggaaaaatcagtaagtttggatcatttccttgccttasctatttctgtgcctaggacctttaagttcttyttcccaaatgttcttgtgttacgagttcctctaccttacagcagtcaatatttcttcaataagtgatttcctcatatttcaattttaattcttcttatctattttccttttgtaacaaagtataatggtcttgtgtttgattctagttatttactaccaaagattattggtagcatatattcccagctaatctatcacaacagagcctatttcctctgtgctataatctggcaactaataatttttactaaaaragaaaatcctctaagattgacaaaaagaatatgtgtcaggactagatgtgattttggtaattraycaacaatatacatttttcaaacggaccagaacagtgagcaaaaaactgttttgcagaagacatatgaaagacttatcaaagaacaaagaaaggcaggaaatacaatagtttgaatttcagtagaagtgattttacctacccaagatttcaaatgcctatattaattaaatggcatcctaaagataaccctctgtgtggagtgcgatatggagcattggccagcaacactcctgaggatgaaacagagttttgtgctccctccaagtcctgtttctaagttcacctaggaaggatactattggaaggtgggtttctcttgagttagaaaatcctcactgatctttcttttgtgttttgtttttagcactgactcctgtgggtaagttccatatctattctcaactctgatattttacattgcttttaattcttttgtgacctgtctgtttctactcccaaaatagaggcctgtgcttctaaggccaatttgaatgttcctatcttccagaaacttccaaggttcccccccgccctccacttttctttttgagacaggatctcactatgttgcccaggttggtcttgaattcctgggctcaagtgatcctcctgcctcagcctcccaaagtgctgggattgcaggtgtgagcaactgtgccaggccccaagtttttaaataactacaatttaagagattgctgtagagaagatgaagctcatatgaaagggtgccacaatctctggccatcttctaggctctgaaaaagaatctcctccctgattctcaggaaaacataatgaaaggaagattggtttctgaattccattagttatttgctgggaatttagaacttttttttagttataggtgaagtccctctgaatcatattaatgggggaaaaaaactagttaaaaacaaaataccatctcctttctattgccttctaaataactacctttgaaagacagtaggtattgagcattgactatgtatttgtgcactgtgctaggcacttacaaaagtaacatctcttattcttaccatatgcctgcctggtaggtattattattccccattttacagattaggaaactaactcaggtatttacccaaggttaaagagttggtaaacattggtgtcaggatttaaacccaggatgtcctatctccaaaatacacactcttcccactcttcccatactaacacattgcctcctatactgaatcacaaatgcattttttgtgattagtcaggaaactttatggaatgtttgcaaatacaaatatacatctacagaaaagctggataactaaatgtacacaaaaggatccttttaaaaatagaagaccgcatttaaatcaatgtttgacttttttaactgttttctggattcagatttatctctattgggattacttaatatatgactcagctcttcaagcaaggaaaccatacaaaacaaagtagaataataacttttgtttaattctgtaaacatatgatcaaaagaagcaaataagacttaaacctagtgagacaygtttcaagcatttcaaacattccaaacactgacacaaacacaaaatatgtccttatatttaatcgtgtttaagcctcattcttctttctcagttcacactagaaagagartgggtttggagggaaaggaaggcagggagatgaagttgaaaggggcaattaattaatttttttttttttggacaaagtttcrttcttgtcgcccaagctggagtgcaatggcacgatcttgcctcactgcaacctctgcctcmcgggttcaagtgattctcctgcctcagcctcccaagtagctgggattacaggcatgtgccaccatgcccrgctaattttgtatttttartagagacagggtttcactatgttggtcaggctggtctcgaactcctgacctcaggtgatctgcccacttcagcatcccaaagtgctgggattacaggcgtgagccactgcacccagccggggaaattaatttcttttgattcatggtacaagaaacagtatgcattcagaataattataatgcgccaacatccctcaaatgctctcctcacatagaaaaagtgataggactgtgatcttgtgagtttctcttacaaaaaaaaaaggtgggctctgatgattgatgttgtatgtcaacttgactcagaagaaccctgactaatacaagggctctgagaagggatcacaggccaagtctcttcccagaggtaataaatttttaatgaatactaattttttaagttgccagagaaaaatctgtttaatcttttaaaaaattttttgtaaaagacatattcttattgatatactctttcaaacacagttttcccaattgattgtttttctattttttttaaaaaatagagatggggtctcactatgttgcccaggctggcctcgaactcctggcctcaagcgatcctcccatctcagcctcccaaagtgctaggattacaggtgtgagccactgcatcggccccagttgatatttttagaaaaaggaggttaaggtttaagtcaatgttcaaagaaaggtttaagatagattaaaccaacaaacatcatcatcccagcaaactgagtctcttatttctcacctcctcattcaactaataagtatatgatcttttaaaatgtaattcatagcctgagaactataatgatttatccctctgatactgaatagatcttttacagtctagatccaattgtgctctccctgacaaccactggattaagaacctaagattagtttcctaataaagcccacattctattttctatgttaagtatcatttagatagaattgttaatgtgatagctatttcatgatatcttttagctttaacaaaaattaatccaatttaaaaattttaataattactttttattcagcttgaatatattatgatgatccccaaagtcttgattaaatcttttgattgtattaaaattttgtagtatgggctactgcctgcaataaatgtacttgcagccagggcttccaagtctttatattatgaagatttacactgtatgtgttagatgattatgaggtccaagagaaggaaaagatgtatgaactatcttgaaatctgggagaaggaagaaaagaacttagaatgtggtggaataatgatttgtggcttacttctgcaatgcaaagttgaaataaaagtgaacctcactttatgggatagctagattmctcaaaaataaatcctgtaaatctaatctatgttaattaaattcaagatttaaaagatgacagcaaatatattaaaataagggtatgaagattctattagaagtaactagaggtatttttcagtgtagtgggagaaagaataaaaagttttttaattctgtgaaattaggaaaggtgtarctagaataaacactgggtgcttcaggaaatcctataatacttaattttggtttacaaagcctatataatttagaaggtaaatttaggttaaaatgagtcatgaagtattacacacagtagcaaataattacccccaagggatagtaaaactaaaaatattcatagcttaaggaaaatcagcttatgtgaggagtacattccatgaaattcttaaggttagaaacttcagcggagcatgatcttaccattccacaccaccatacccctaaacaaaacaaaacaaaacagtgtccactggtagcactgtcgaagatcaaaatattctgaactatttttctcaatttagcaatgcttgaaatatattaccactgattttcattaggaaactgaaaattgattgtctagaataaaatgtcagtaaccatattttaatgaagaactctaggtggggacatatacaaaaaggttcagaaaacattactgtaattttcctaatgttatttttatttggatgtcaacagctgaaaataataaaagaaaacactgaactacaacaactcttttgatttataattagtttcttatctaatacaggtgtgcctcatttttataattgataaaattctgaagttatgtgtatgccaatttttcaaacatcaaaccctaaatgtaaaaaacgaaaagtccaataattcacttttaagcaagaaattttcctgtaattggctgggtgtggtggctcacgcctgtaatcccagcactttgggaggccgaggcaggtggatcacctgaggtcaggagttcaagaccagcctgaccaacatggagaaaccccatctctactaaaaatacaaaattagccgggtgtggtggcacatgcctgtaatcccagctacttgggaggctgaggcaggagaatcccttgaactcgggaggcaaaggttgcggtgagccgagatcgtgccattgcactccagcctgggcaacaagagcgaaactccatctcaaaaaaaaaaaaaaaaaaagaaattttcctgtaatacaattaaccactcctgtaaattatttgttggaaactaagaatgccttgtcttgattgaattagagagttttttcctgtactatctcattgggaagtagtaatggccaatatttattgactacttatgtcccatgcactgtaccaagtgcttttatttagataacattatttaatctcataacacctctttgaggtagctactactattgcccccattttacagacagaaagtaaagtttgccaaaggtcacccagctaggcaggtgcggaggcaggatttgaaccagtctgtctccaaaggctatgttactttaacatttgtctacaatatttagtaactctacaaagtgagcagatcaaactaaatataaaaacagtgaatctttgaggattaactgatttaccttaataaacccattaaacccagctagcaggaataataaacctaggtcttctttttttttttttttktttttttgtgtgtgtgtgtgtgagatggagtatcgctctgtcacctagactggagtgcagtggtgcaatcccagcccactgcaacccctgcctcccgggttcaagcgattctcctgcctcagcctcatgagtagctggggttacaggtgtgtgccaccatgcctggctaatttttgtatttttagtagagatcaggtttcaccatgttggccaggctggtctccaactcccaacctcaagtgatccgcccactttggcctcccaaggtgctgggattacaagtgtgagccactgcccccagcccaagtcttctgattcagcttttatattcagtattctttctactatagtaaatattaaatattagattttctcaaagcaagacatscctctgctccacrgcaagaacccacacaattccttggtggctcagatatttcttttacttaattcagggaaccatattacttaaaaaaaamaaaagcaaataaaaaatacctagcagaagccaataaattcaggtttgttaaatcacamaggaattgagacgtaacagctgatttacctgaacatgatcaaaggacctgaaatttttgcagagtttgcagatattgcaagaagtagtctacagtaatgatcaaaactgaacactggagtctgactactcagattcaaatcccagctccaccacctactgattacataaccttattcatattcatttaagcattctgtgcctcagtttcttcatctgtaaaatgaggttaataataccctacctggttgttgtgagtatcaaatgatttaatacataaagtgcttagagcagtgagtacttggtatgtggtaagcacttaataattatcagctagtactgttattacttttgcataataagatatgcttttattcaatatggaaagcatttttgagtttcctttttctgtcttgagaaatataattattgcttcctcccacaatttttccttaaaacaaattctatttcttttcagaatacatcctctgttagccactaagcattattcattagccataatccactgaacaaatgtcagttcatttacagtacattttaccttttctctcattaatcttccaaattattgaaaatagtccagaattttatcgatacttttataattttaygtacagagaaccatyattttagataasttgagattcagaaaaattttagtttgtcagttttaagacaaaaaaggaaccagtatcaaggggaaaaaaatagaaataaagagaaaatacttgatatctaaatcacgcccttttgttgtatgctcagttatattaacaggttacatggatgaagaacttgcaaaaaaaycttgttccaaaatccagattctaaaatgtggaggcactgcaaggtctcagaatagccgagaagaaaacaaggaagcactaaagaatgacatcatatttacgaattctgtagaatcctkgaaatcagcacacataaaggagycagaaagagaaggaaaaggcactgatttagagaaagacaaaataggaatggaggtcaaggtagacagtgacgctggaataccaaaaagacaggaaacccaactaaaaatcagtgagatgagtrtaccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtsagtctggtgtctcaaagggacaggaagcccaggtaaagmagagggagtcagttgtactgaaaggacaggaagcccaggtagagaagagtgagttgaaggtaccaaaaggacaagaaggccaagtagagaagactgagrcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaatttcctttgacaagtatgtctatgatagcctttccaaccaatcaaccagtaactcctcatggcaagcctaatgtttgcaaggcactggtctagcaataaggggtgtacagaaaaacacaagtcaaagctcctgcaatcaagtagcttataacatatatagtgatatatgtatacatggcaattttttaagtaaaatctaagttacaaaaagtttagatggacaacataatccatcatgggatgagaaagtagaggtggtaacttcatggggaagggagtagtggtatacaatatgtcacagcagatggataaggtgttgatatgctgagtgaattacaaagagtaaaagaaaggtaaagggttaaaggctgtcgtgccatgctccaggtgcagtaggcaattttgctgttacggaagattcatgggaggcatcctggggtataattttgaaaaggagaatataaaaggatttgaaaaacaagccaggaatttatattttactcttcaggcagctggaagcattctacaatgtttgagacacagagtgaaatgaataaggttgtatcattttaaaaataaggttgtatcatgtgattgtgaaaaataagatagaaaaagaaacatcatagatagtaaatctaattaagaagtacttggagtaagtaatggaaagagaataaataggaaaaaaatcaaagaagaatcattacttcatgatgactgactgcataggagtaaggaaaagtgaaaaaaacaatggtttcaaaacttttgaaactaggtaacaaacaaactaggaactaatttgggggacagggagggaacaacaaattgttttaaggggataagcaataacatttgtcattcaagagatatctggaattagatgagtacaggtaacaattgaagcaataagagtgagttcttcaaaggaggaagtacaggactaacgaaagcagaagtccaaggactgagtttgttatatgtaatatattgaagaaatttaactaagggataggaagatagaaggaaaacctgtatagtggaatgttccaataattaaggaagatgagagttttgagaaaaaaatgactgagacttcaaggaaaataaggactgaaagaacactgtagttgctatttggagctgactaatgaacttctaaagagcactttccaaagaaaggaagctaggagaaggaaggtaagcaggaagaatatagagatacaagtaagtagttgtgggatgtgcctttcaaacatccaacagagttaacttattttagtctattttaaaataatcatttttagaaattttatttttatactgttcaatactgtgctggttagcccacaccctgaatatacatttagttcaatcatgggatgtggataaactaaatgccttcaggagagaaagactcaagtgtgcaggaagttgcagaattcccctgggaagacaaatatgaggaaacaatgagaattactttcaaatagtgaaagttcataagggattagaatattttgtatagccccaaagaaatgagatcagtgaatggaaggtacaaagtaacaaattttatcttagtaataaggagaagtggaggtccaaagagtttaagcaagagtttaaggctcattcagtgagaatgccatagaggagactcaggaaacagctgagtaattggaataagttatctttatggtcccttccaaatagacttcctgagagtctataattctagttatcaaattctttggactaactagatgtcttccaaggaagcttttcatactgatatgctattctttggaggcgtttgatgaaaaaaggagagaaaccagacattagtctctgcccaaagtataaaatgtttcataaatgtttcaggctacccaatcacaaccttaaaagagtatctccataacttctagcacaatctaatccactgtatggctgtctactgtgttctcacagccctgccgcaggtatggaagcctatgttaattttagaagtcacagaatcctcaggtctttgatgagctgcacaggtttagcaaaactgagttgccagagagagagagagtgagagagaagaagacagatattaaacatggattttaatattgtaagttgcttttgtcatctgtggaaaatacacatttagagattttaccagcctttgttggcatgtcttttacatacattatgctgttatcagggaacatttttgaccagaaagattttcacatagttaaaagtattagattttcatcattctcatgtcatttttcctatagcccctctggtccatgtgacagctaactagtaggttgtttgtttgcttgtttgtttttcctcactcttcacccaggctggagtgcagtggcatgatcttggctcactgcaacctcctcctcctgggttcaagcgattctcatgcctcagcctcctaagtagctgggattacaggagtgcaccaccaagcccagctaattagtgtatttttagtagagatggggtttcaccatgttgtccaggctggtctcaaactcctgacctcaggtgatccaccgcctcagcctcccaaagtgctgggattacaggcgtgagccactgtgcccagccactactaggttttagaagggtatgactaattcaacttctctcagatttctggtaagaagcagggaccttgtcaaggcaattactaaaaaacagtagataggcttcagcaacccagctcagctgactccatatctgtgtgtatgtcccactgaagcaagaattcagaagagatagatctatagaaacctccctgtatcttctccataacttctaacttggggtcaaaacatttgcactcccactaggtctttgaaggcaagtaaatcatacaatagaatactccaactataaaaattctgtggaccattttctaaaggccactgaaaaactgacaaatttaaagcaattgttaaccctcctgtaaagatacacatgtggaaatcttaaaggaccccaaacaaaggaagggagaaaggacaagctatcaaaatgacaccatgtttaacaaaatgatgaaaattttaagaaaatacataaatatatacttctaagatagtggcaatataaaagyaggaatgtgaaacttaccttaagaaatcaatagtaaattttgttttgcaaataaactaatacaaatgtcaaatgtcctgttcacaagaatggaatagaagtcaattcaattagtcatttttcatttaggagcagaacataggaaagaaaagcagaaaggtgagtttagagataatgaagctgaatgagaaacacaaaatattaggaaacaaacaatttatgtaaaatcagttaatgcggctcctatcccaattaaagactccctgagttagtagtgcattaaaaatgcaatttcctggctgggtgtggggctcatgtctgtaattccagcactttgggaggccgaggagggtagatcatgagatcagaagttcaagaccagcctggccaacatggggaaacccgtctctactaaaaatacaaaaattagccaggcgtggtggtgcacacctgtagtcccagctactcaggaggctgaggcaggagaattgcttgaacccgggaggcagaggttacagtgagccgagatcgtgccactgcactccagcctgggcgacagagtgagactctgtctcaaaaaataaaaataaaaaaatgcaatttcccattttcccctaaatatctctcaccctaggttataactgacatatcaaggaagtgaatacagggaaccgagaaaggggacaagatatagaaggaaaaaacaggatccaaaggaataaaagaataagctgaaaaattgatcaaaatattcagttttatatttgatgagattcctttactctcccccttaaaaacaatcaggaataggaaaaaaacaactagtgttcctacactctacttgagaagttccaattgtggttttgaagaaatacaagcctgtaatcttagtgtttcaggaataaagacactcttatctatcatcatccagaagcttgagcacttgccaagaccgggaagtcaaacctgagatgccacactacagattatacacgttgtaagctaggtctcaataaattttctattcaaatctttattaagtttctctcttcaaaaattaaaaactcacagtgttaagtttctatgaatctctccacatcttaatccatgtttatataaaaatatatgcaaatatgagtatatgtaggaatytttttctaaaaatagggtcaaactatatacataattctgcaacttgtcttcttcgcctaacaatacatcatgggcaacacatcaatctaacattttaatagcacagcatccagtagtgtgaatgaattactgcttattcaaccatttccttaaagatagacatttagcttgtttccaaccttttgcctttggctaaatgattctgccattgccaaatgatactgcaatacacatctctatatatgatcaggattttatttctctaggatagatttccagaagtagaactgccagatcaaaagaaatgtgtattttaatgttaatagatattacctaattccttttccccaaatttgtaataattcatattcctacaggaagatatgagagtcctatcttccccatacttgcactggtgctggaagcggtagctatttttaatctttgtctattgagaaaagtggtatctaactgtttctttaattgtattttcctgactactagtgagactgaacattttttcataagtttaatcgtattttgaattttctctcctgtgatttaattgcttttcaaactggtggtttgccctttgtcttactcagttttatgtgtttttgcatattaagtttttatctgccatttgtgttgaaaatgttttcccaatctactcattctttctctacatccaattcatcaacctgtaccctaaaattatatcttgaatctgactactactcatctccttcatcaagaagtccaaaccatcgccatacctcacctgcattgctgtgcctgcttccaaactgagcttcccaatcccactccccactcccaacggaatcgtgctttcaaaatataaatcagatgaagtcacttctctactcaaaactctccaaagaccaacccccatcagcgtaaaaattgcaaagttgtttttttgtttctttgtttgttagtttgagatagggtctcgagctgttgcccaggctggagtgcactggcatgatcacagctcactgcaacctcaacctcccaggctcaagcaatccttccatttggcctcctgagtagttgggactacaaatgcacgccaccatgcccaactaattttttattttttaggtttgctagagatgaggtcttatgttgcccaggctggtctcaaactcctgggctcaagcaaacctcccgcctcagcctcccaaagtgctgggattaggctgagccaccaggcccagcttcatgaaagttcttatcctggccttgaaggccttacagtatctagcttctggcttctcctctagcctcatcacccactctccatctcccttccattgatgcagccacactggcctcctcatttctcctcatgcctgccaagcatgttcttgcttcagaatcagcctgaacactccccctcaaacatatgcactactcaattattttaagaaatatgcttaaatttgactaccctaagtaaaacagtaccccccattctctatctctttgccctgatgtatctttattaccagcatttatcacctgacatcatatatttatttttgtttattgactttctgccccacaagaatgtaaactctaagggactttgttcactgctgaatctccatgcttagaaaagtgcctcgcacatagtagatgctcatcaaagatttgttaactgacatgaagtagattaaatgaaggt

SEQ ID NO: 10600 - DNA, 24882 bp, Homo sapiens
  misc_feature (1)...(24882): n = A,T,C or G, or insertion/deletion polymorphism (see Tables 1-2)
ggataaaagaacccaagtatgagtttgcagcacaatgggaaaggaaagccttggagacaaagagagagggggcgacatagtgttgatgaagaggagcagccattgtaggttgtaggtcggggtcagaggaagcgtgaggtggttgttgaggagaattggcaagttcttgggatttccaggctttatgagtatttccagtgagtctgcacaggtggatgtatgattctagagggccacctttatgagactattctgtgcagattctttgttgggctgcccagctgtttgttggcctagcgcagcccaacgcaacccagccatagtctctgctttggccaatggcctggttgctgggagaaggatgggggaggcccagatgatttgtacagggcccctagatgacccactgcacctgtccccactcgcccccaggtacttgatatttcctaatcctgtctgccttgagcctggtatctcctacaagctgcatctgaagctggtacggacagggggaagtgcccagcctgagactccctactctggacctggcctgctcattgactcggtgaataatctcctcttgcccacaccaaccaagatggcagggcccgtggtgtgggacttgagggatagcaggggtctgtggcagaagaggcaggcccatggtggtgccagggtgggcaggcttgtggcagtgctaaggcaagtgctctggcaatgcctacgtggtcccaggtctgaactgcgatcttccttgctcactccttcagctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgcgtgagtgtctgtgatgtgggttgatggggcagaggtggggacccagcctgacttggcccaaccctcctccccacagcatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaaggtactcttctgccccttgttccctcctatgcttctctctccttcccattactgttctctctcctccttctggacctgctgctggtttcctcaaactaagtcttggaccctctactctcaacctgggtcagttgtagttctcttccatttcctgaccttcccacctagactcccactactcacactcccctgagaccctcccccacccacactcccctcagaccccctcccctggctctggctcagctctgccttgctcctagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgagactggagcagctatgagtgggttggttggtgggcaggcttcccagggatgacacatttcttcttcctcctccctgcaggtgcattgctggtttccacrgggacccacggctgccatatgggggccagtgccggccctgtccctgtcctgaaggccctgggagccaacggcactttgctacttcttgccaccaggatgaatattcccagcagattgtgtgccactgccgggcaggctatacgggtgagtggatgggggcaggcrtgggatcagggtgagttggctgggctgagcactcacagcttcctcttaaccgtgggcagggctgcgatgtgaagcttgtgcccctgggcactttggggacccatcaaggccaggtggccggtgccaactgtgtragtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgtgagtatgagtgtgggagggcatggctgaattggggttctgcttcttggcctcctcttgactactgtgctcatcttggttggcacaggctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgaggtatgggaccctcctgcagatccctggttagatggggccaggtgtctgtcttatctccagggcttagcctcttatagaggctctgaccctgccttgttcccaccccagttcacagggcagtgccactgccgtgccggctttggagggcggacttgttctgagtgccargagctccactggggagaccctgggttgcagtgccatggtgagggagccagcggggccagggtagatggaggacttcccagaatgccccacagtgaccctaactctgtgctctgctctttcttgcagcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcrcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggtgcggaagggcctaagaatacatggtgggatggggcagaggcccagtggaccagggctgaagcctctctaaacacccccctctccatcattgcaggcgtgaaattggggaggccactgagcacctgactcagctcgaggcagacctgacagatgtkcaagatgagaacttcaatgccaaccatgcactaagtggtctggagcgagataggcttgcacttaatctcacactgcggcagctcgaccagcatcttgacttgctcaaacattcaaacttcctgggtgagttgttagccaactaggcaggtggaccagggtcagtcttcagctgactgtctgcctctgcccaatttaggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgaggttgaagtgttgggtggggcaggtgggtgtagatgttcctctcacagggccctgacttgttctgtgcctggcaggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccgtgagcctcccacgtgtcccaggccatgtggttgtcccctttggcaactcccggtgtctgtatctcccttggttcatacttgagcctcagggactacactggattagtgtttatgatcccttgactggctcctgagttattgcccatatgtggtcccaggtccatgttcttgagtctgagccccttgtatagtccctgtccttgtgattatatccttatgcctggtaacaaacccctatcccatgtacatgtcctgagtccataccccaaaactgtatcctcatgcccatgctggagaatctatgttcttaagttcttgctgtgtccctatagaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggygggcaaggtctgaccccatccctggcccctatccctgacacctggttttgatacctccaggttctgattcccccttctccccaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtgaggtcttcctaggacatcagtgggacaaggttatgggcatgaaccgtagatctgtgtaacctttggctcacccatggcaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcaggtgggttgaggcagagccagctggagaaggtaggggtggaagatgggcctccactgagctaccacgctaacctaaccctctacatctgcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacagggtaagaaatggggcaccagagacacaagactgcgggaaaccccccctaaactgacacctgcccttcctagaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaacccccactgtgttgtctggactctgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggtgagtggagcaggctgcaactcgctggcttggccgcagcggggaggccgcaacgcgcggccgcggcggcctgttcaaggtcacggyccgtgccagtccctacccctagtgccccgcagcgtgccagcccactgatgccggcagggccgttacgctatgcctgtggccagcctcccacctgggagaggactggcggccagcgagggcaacttcgtgggagaggtggtggcgggctcggggttcagaggctgaagctgggtcgcagctcgaccggggcgctgatctgtggtcagtaaccccgcgctgccatttcaggccggctcgggtctctaaacagccccttacccgcctcgacgtccctggggcatgggggagggacgcgaccttcggctggggcctgggtgcaagaaggaggcgncggtggcaggtgtcattaaagatccagcccaccagtaccacatctgacctgtagaagggtatcctgccatccctccttcctcctttacacacttaggggaacacagactagtcattatctgtcctgctactggttcaggccaggcttgaggctgccaggagtcctggatctgtggtcctccccagcctcatctcagtatctagtttcaagaccttcattttggaggaggaaacagtccagaatccactggtgggtctgtgggaaactgtagtggtccttgtggctcagagctcatgagtgaaggcatctgggaaggaaggtgataatttctgttccagtctcaaactggatgcccatcctgccttagtactggagcagggttgctgctgaagaggtagcgtgacatctagatacacttttcagtccctttctgcttgggacagcagctggggagaggactttctcttgaaatgaagaaggaccaagcagtacataggagcaggttcttgccaagggtgggagctggcaggaggcaggtggagtgccttagccccaggactttttctgggcaatggtagaacctgggttgagcctgtttacagccacagagcctggttctcctgcggcttgtctcctgtcctgccttcctcctccaccttctatttctccagtggtgactaagcagccagtgagagtgaaggaaaagtgagcaccctgctcggagtgccagccctgtgggctggagccgtggctcctctccagattggtggagtagcctggtcccaggccatgacttccttgacctggtgccccctcagtgaggctttcacctgtgtgggactgttatggtgggtatctatgaggcttggccagaagtggttgctgctacttgcattatttattacctcttcagaatatcctgagagtgtccaggggtacttaagagatgagaagatacagctctgtagcattagtgtcctgtgttgctgagccctgggtgtagctaaagagcaagttgttgggtcttggcagtgatcactggcttctttccattaggctgtccgttccttgctggagaatttggccacaaagagytgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaagsatggagatcctaggaaaggtgggagtggcattcccagagtaattgtggccttctctgcctcccatcttattggtatacagattggggtttgggagatgactttcttgttcttctctctgtcctggtttgatgatgagagaagaaggacccatgataacctcagtagagcctcagctttgaagcctgagtacttggctaagatccagaagatggtgctgttggggggcttgccttctttcctttttaaacttttttcttttttttgaacctgttctttttttccttttttttttgagatggagtctcattctgtagcccaggctggagtgcagtggtgcaatattggctcactgcaacgtccacctcctggttcaggtgattgtcctgcctcagcctcccaagtagctgggattacaggtgcatgccaccacgcaaggctaattttttttttttttttgagacaatgtctcactctgtcatccaggctagagtgtagtggcrtcttggctcactgcgggctctgcctcccgggttcaagtgattctgctgcctcagcctcccaagtagcctcagcctcccaagtagctgggattacaggtatgcaccaccacactcagctaatttttgtatttttagtagagacggggtttcaccatgttggccagactggtcacaaactcctgacctcaggtgatccacccacctcggcctctcaaagtgctgggattgcaggcgtgaaccaccgtgcctgtcccttttttttttttttttttaaaggcagggtctcactcttgcacagattggagtgcagtgcaggtgtgatcgtagcttactgcatcctcaaagtcctgggctcaagcagtcctcctacctcagcctcctcaccatgcttgactaatttttcttattttttttttagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggtcagtaacgaatgggctttttgttgctagggaaggggagggggcacttgcaatttggctcccatctgaagcagtttcattaggctgggtctctgttacctgcttatcaccatcaggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtgtgtccatctgccctgagcacagtagtatgtttgaatcttctgatatctcctatcctacctcatggaccctgctctgtccccaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggtgagttctagtagtacagggttgggtagggataccagtgtagtcgacagggcctgactgctgtatctttggcagaagaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggtgagagctgggcacctgtttgggtgttaggagatggggggaaagggtgtgcactggagtgggagccacctggcagacccagggctgattctttccacaatcttgccattaataggttgaggctgatgaacagctttgcataccaccgctgaactcccaaacctgyctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatggtaaaggtgggggtgggcaggcagagccctaggttgggttgcaaagtttgtaggtggatagagagtagcaataggctggaacctgtcctggttggggctgagccatggtctcaatatagagcccgagtcgatggtgaacctggcgtttgtcaagaatgactcgtatgagaagggcccggattcmgtggtggtgcacgtgtacgtgaaggagatctgcagggacacctcaagagtacttttccgtgagcaggacttcacgctcatcttccagaccaggtgggtgggtagatgatggggcaaacaatgcctcaggtgggacagtatgtctcatgctcttcctcttgtccttcctcctatcctgctgtgcctctgcagggatggaaacttcctgaggctgcacccgggctgtgggccccacaccaccttccgttggcaggtgaagctcaggtgggtggtgcccggccccaccactgtgcctgtcctaccccgtgggctccatctccctggctcatctatcctgatgctcattcctcctaagtccctgagttcagccttttcccacaggaatctgattgagccagagcagtgcaccttctgtttcacggcttctcgcatcgacatctgccttcgtaagaggcagagtcagcgctgggggggcctggaggccccggctgcacgaggtctgcacacgagctcccttcattgcccagttccacgtgaccaggacccaaacccctgtcacatgctgctaaccaccagccctctcattccccctttttaaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcggtgagaattctggggtgggaaggacgaagaatggaggctggagagtcttggggctgttctctcatgtcgtctttgctcctgcagcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatggtgagggcagggcctggagcctgggttatgggcagagagagtgcctttgttcctcacacctttgctcggctactattcctagaccgctcctttgaggctgagatcaactacaacaacccactagggactggtgggcgtctggccattggctttgccgtgctgcttcgggcgctgtggaagggcacccaccatgccttccagccttccaagttgaaggtgatctgtgaccactgtcacccttggctggagggggcggggagggccagccagctgggtgtgcagtgggtgctagggcttcatgttcacaccttggctcctgtatccaggccattgtggcgagtaaggccagccagttcacaggctatgcacagcatgatgcccaggagttcatggctttcctgctggatgggctgcacgaggacctgaatcgcattcagaacaagccctacacagagaccgtgrattcagatgggcggcccgatgaggtcagggttagggacagagggtgggcatgtctcatgagcatcccagccccyggtactctttggttctcaccactctgcctctcaggtggtagctgaggaagcatggcagcggcacaagatgaggaatgactctttcatcgtggacctatttcaggggcagtacaagtcgaagctggtgtgccctgtgtgtgccaaggtgtgatgggctcccctggaaagagaccccctagttcagctcagctattctggtcacattaggttcagaggcatgtgcatcttaaggtgctacagggcaaggtttgggcaaagaagctggcagggaggccttaggattctatttgggctgaagagcccactcagggtaggcttcctgactgagggaaaagtgatgttagagctcaaaggtgttgtagcagggttgtgggcacatggggtgcaagtgtgaggccaattcgtaaagtggctaagctgagtagggctttgagtgccagaaagaaggattgttatttcctggtggtcctcctgccctgtctagtgtcctgaagcctgagagtttgctggttggctgtgggggccctgagagccatcagaagccccggaatgggctctctgagcatgagcatcttatctcccactctgtgtgcagctacccagtgccacctctacatccacaggtctccatcacttttgacccgtttctttatctgccggtgcccttgccacaaaagcaaaaggttctccctgtcttttattttgcccgagagccccacagcaagcccatcaaggtgaggagtaagcccctaccctctgggctgttctagagaacgtggcccacctccctcactgactgccctttttgccacagttcctggtgagcgtcagcaaggagaactccactgcgagcgaagtattggactccctctctcagagtgttcatgtgaagcctgagaacctgcgtttggcggaggtatctttgtccttccttgggctatcacatgtgtggatgtgtgtgtgtactcaccacagacgtgtgtacagtcattggcatctacagacatacacatgggctgggcacagtggctcatgcctgtagtcccagcactttgtgaggccgaggtgggcagatcacttgagcccaggagtttgggaccagcctgggcaacttggtgaaacactgtctctacaagaaataaaattagctgggcatggtggtacgtgttatagtcccagctacttgggaggctgaggcaagaggctcacttgagcccgggatgtggaggttgcagtgagcagagattgcaccacagcactccagcctgggtgacagagtgagactctgtctcaaaaataaataaataaatagataaaaaaataaaaatagggccaggcgyggtggctcatgcctgtaatcccagctctttgggaggccaaggctgatggatcacaaggtcaggagatccagaccaccctggcttacatggtgaaaccccacctctactaaaaatacaggaaaagttagccgggcgtggtggcacatgtctgtagtcccagctgctcaggaggctgaggcaggagaatcgcttgaacctgggaggcagaggttgcagtgagccgagatcgcgccactgcactccagcctgggtgacagagtgagactctgtctcaaaaataaaataaaataaaataaaaatagacatacacatgagtatgcctgtgactgtacaaaaacaggcgatgtgctgttattttttctgtgcaacagaagtgccctcagttcctagccattatcagggtttattcccctttgtggtggtggatcccaactgcatttccctttttagacaaggagcttgagctgcaggactatccctatgttcgctctgcctctccctctatcctgctgctctctccttttatcccagttgtgtgtgctagctctccccaggggttcctagcctttagcctgacagtgttggttttcttaggggtaagagtggggaggaggctctttgaatgtggaccctccatgataatatgttacagtcttataaggctatgctagttatagcagggcagagtccctcagtgtggagagctggtgtggttgatatctgcctcacacctggtctttcaggccctctgatgcaccaggctccttatggcattgggcactgagacaggtgccagcagaggcataagcctatttggrcctacagacctcaccactgcccacatagacccaaggcagggccaagccttcttaaactctggggcagggctagggaaagggcttatcctcacgtgggatctgtgtgttctctgtccccaggtaattaagaatcgttttcatcgtgtgttcctaccctcccactcactggacactgtgtccccatctgatacgctcctctgctttgagctgctatcctcaragttggctaaggagcgggtagtggtgctagaggtgcaacaggtgagtgggggccaacctgatggcacagcgccctggtgggtggggcacttcttcctggtcttgctgagccagacgacccaccctagcgcccccaggtgcccagcgtccccatctccaagtgtgcagcctgccagcggaagcaacagtcggaggatgaaaagctgaagcgctgtacccggtgctaccgtgtgggctactgcaaccagtgaggacccccatggtctcccctaccctttctttccaccttccatgtgccaccctgctccttcccttcacaccaaggcacatatgcttaagctttctacttgccaccctactttaccaggctctgggggaggcagggctggcgtacccagttcccagggactatgactagcccccagtatggagtcataggagatggggctaagggcctatccttgtcttcctcttcccgtcaggctctgccagaaaacccactggcctgaccacaagggcctctgccgacctgagaacatyggctaccccttcctggtcagtgtacctgcctcacgcctcacttatgcccgcctcgctcagttgctagagggctatgcccggtaagtgcccagtggttggactagagtggtgtaggtgggggcagaggtgctagatgggctggtcaggagtcttacttgcgttgttctctgttgccaggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcrccagtggaatttcttctgagatgctggccagtgggcccattgaggttggctccttgccagctggcgagagggtgtcccgacccgaaggtaagatccagtgaaaggctctrgaagctggggaggaggataygggaggatggagggggctgttgtttagggcctggtgggcctggtgaggccctgatgggcagggaagctttgattatcatgttctcacacagctgctgtgcctgggtaccagcatccaagtgaagctwtgaatgcccacacaccccagttcttcatctataaaattgattcatccaaccgagagcagcggctagaggacaaaggtgtctgaggctgtgggtgggagccatggggtgggttgagctggctgttctccacagctgcatgacctctytccctgcgaatctccaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtgagaacagagcagcaagtagataagggggcaggatggagaagagagagacttgctggtcctgacccaatctctgtccccaccaggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggtaagcagtggaccttggtaactgtgggtggggtgtgaggaccaggatgggcatcctgagcgcctgttgcctgtctcacccctccctgactggacctgacctgcaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggtgagggcacacacagccagcaggataggtggtaggggtggtggtgcagactttgttcacactcttcccaccctgctgtaggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggtgaggcatgtgggaggctttacagaatactgggggacagttcacagactggggccgggttgggggatatagcttcctctcctccagccacaggcccattgagccttgggattcatgagaattgcagagttctcttaacatcaaagctttagccagaggcatccccatgccttggggacactaacaaacatacaagtacactaacatgctgccactggcaagcacattggcacctacttggcacaggtcaggcaactgctctgaacctcactgggcactatgctgtgaatgaactatacctgacactctcctagatttcctctgcacattccccacatgctggcccacacaccctcacttgtgatgtccctgagttctagtgtgcactcaagacaaggcctatttgggctggccatggcctctggtggctgttatactctttgaggtaagcatctgtctttgctgagccttcaggatcttctctttagtgacatggtgtgccataggcccagttagtgggcgtaggcacatctcttttctggactggccgtctcctttctggctccatcctctcttgagccttctctgtcaagcttagagaaatccttgcagaagactggtcaggatctgggtatgggtgggaaggagcaaggagattgctctgggattggcagtcctgttctctatgaatcggtgtcctttggggaggcctggactgaaatactaaccagataactcccctcccacctccatgcggagctgcatgtggattgagagctgtttagggtaggccaaaatgctgtcaagattctcttacccttgtgctcttactctggacagccctgaggttggctgcctgccttcctccttgctgtttgatctagaatgcagggtgttagccccagtcaccccaggtgggactgtcatggctaagggtctcagggacactgggtcctccccacccccggggtgctgatggccgtttccacataccctaggcttcccggatttggcaggagctggaggctgaggaggagccggtgcctgaggggtctgggcccctgggtccctgggggccccaagactgggtgggccccctaccacgtggccctaccacaccagatgagggctgcctccggtactttgtcctgggcaccgtggcggctttggtggccctcgtgctcaacgtgttctatcctctggtatcccagagtcgctggagatgagctcgcctgcaggcagctgctgtgagctggcctacctgcctgccccaggccatgcctgcctttgttgtggggaacacctctgggctttgggcctcagcttatgcatctggtgggagagggtggggaggttgtggcccctgcaggggcagagtatcctagggtgtgtatccatctggctgtctgtccattcatcctgctgctctgacccttggcctcaggcttggccctgcccaagctacttcctgtacttaaaagtgttaataaaaccagactattcaggcccaatctcgtctctctgtctcaacgccgctgctgtctgcgcctgccttgggaccctcccttgggtgccagggctccaagccagcacccccgggatgccaggcggcatgctgggcagcccccaacccctgtcctcgtattctgttgcagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcagtgggaagctgaggggtatgatttgggtgtggagacctctcaggttgggacttcttgtcagcttggacccctgaccagtgggctttggcttctccagccgcctccagtgctgcgtgatttgattctgwtgtaccttcaattcttctgacccgcattataaacattataattttattctaaaaattgtaattttttttgcattttggaagtgactgctgctgtttaaatatattttaaaaataaataataagtaagtagacttagtgactgtgatccaccacatgctggggccacctcccctccccatcatttgcggtgtgtatgtgtgtgtatgtgtgtttatatatgagagaccctgaaagtgccctagtctgaagggagatgatggggtcccagctcatgtcctatgggtcatgaagcccccagtgctatcagctctttggagcctacctgctgctctttcatcccactggttctggatcctacataagaggcagcttggtaggcatcgtcaggatctcaatatagccaagggacagaggagtatatgaagcactggagctgacagcgtggagtaaaaggtgcattcaccagagcagcctggggctgacaagtcagggaggacttgggggacagaagtactgggagatcttcctcctcctctcctgtcctcagctttttctttgctgtaacttgaacactaactgcatccctgcaggtaacagagcaggaggaaaactgctgtggggcagatcttgctgccctgaaaagaggacaagcagagaggaccagagtgaatcttgtctgacttctattggagggagggtgctggggcctgccagcctgaagagtcttcccttaagagttcctgaagccttccttctttggccaggcatggggggctcacacttgtaatccccgcactttgagaggccgaggcgagtgggtcatgaggtcaggagttcgagaccagcctggccaagatggtgaaaccccgtctctactaaaaatacaaaaattaggtgcagtggcgggcacctgtaatcccagctacttgggaggctgaggcaggagaatcgcttgaacctgggaggcggaggttgcagggagccgagatcgcgccactgcactctagcctgggcgacagagcaagactccgtctcaaaaaaaaaaaaaaaaaaaaagttgctgaaactggccaagtgtggtggcttatgcctgtaatcccagcactttggggcgaggtgggaggatagcttgagcctaggagttcaggaccagcctgggcaacatagtgagaccctgtctttaccaaaaatataaaaattagctggctcttatggtatgcacttgtagtcccaaatatttcagaggctgagatgggaggatcgtttgagcccaggaggttgctggaccctacctctgtccattccacgactgggccttgctggctgctgcctggtttttccacttggtcatctttgtcttgacttttcctggaagcagtgccaggggcttatgcaggcaagctaacctccagactgggcccatacaatttaacatttctgctttgtgcaagtcgtagacatctagggcactagctggatatcgactggtatgctaccacttgtggcattcttggtgacactggtggggctactgcctcattctatgacttgtagccatggcgtccacagtgtaccatgaagtaaccagggaagggagtgcagatcttgatctcattgagggagccatcactagacctgtaggacttggtgatggtgctacagtgaatctattggcagcatcaggtactgaggaaatagtggcagtggcaggcactctgcatggctttgctcaccatgggcacctttatggtgggctgggtacttgcagcttcaaatttggtgcacggctggtgtggctatggctctgcttcttggtacctgtccttagcaccactggtctgcatcccctgcttaattcctgcacctggcctttctcatgcagtacactgcagggctaggcatctggctggggccacggggccatggagatgtgggaagccccaggacagcattggacctggatagcgatacagcatgtggccctggtctgcacctggcatgtgatcattaggtggtatccagatgtaggcccagacttggaggttggtcattaataatgggatgtgggcacaaaagacacagaatatagataaagactagtcaggatcctgcctattccttgaaggtccagaagtatgagcatcaccaattcctgcaagagctccaatctcaaatttggggatttccaccatcccaccaccagctgctcattctctgcaaccccctacctcagtcccttactaccttagtcccttttctcacacacacacaaagtctctgttctgtttcagccagcaggtcctggaagtccagtgagactgtggaaagatccccaagcacaacagctataatcatgaagctataaccatctcatttgtcccaccctctcacaagctcaataaaatatcctctcaaaggcctgcagagggatttcaaggtctaatttgcttgtggttttcctgataatgctttggcaagagggtaagtgtgggatgagatttttttttcttttctttttttttttttgagacagtcttactctgttgaccaggctggagtgcagtggcacaatctcggctcactgcaacttccgcctcccaggttcaagcgattctccagcctcagcctcctgagtagctgggattacaggcgtgcgccatcacgcccggctaatttttgtatttttagtagagacagggtttcaccatgttggcgaggctgatctcgaactcctggcctcaagtgatccgcccgcctcggcctcccaaagtgctgggattaaaggcctgagccactgcgcccggccaagattttaaaccaaatcatcatagaacttatgtgaggtccctcctggcccagacccgtcccttccctttcctggccagctgtgtccaagtgggcacctgaaaaccggcggacttatggggcccctggatcggtcattccacacattctctacgatggagtctggatgagggatttcctgggcttcatttgttcaactgtttccatgacaactccaaagctgtggcgtcaaaagcgtgacagggactcgcatttgcccccgaggacaattactatattgagatggagttaccagggctgaagtagaaaagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgmtcttcactagcytcggcctgagcgagcagaaggcccgcgagacgctcaagaactcggctctgagcgcgcagctgcgcgaggccgctactcaggtgcgagcccctctgcccccggcctggtttgcagaccatgctgcaacgcagcgcggggcggggtccagatcccgacctgccccgtttgtcccgccctttcctctcactgagcgcggggcttctctcttgacccctctgacctcaggctcagcagaccctgggttccaccattgacaaagctaccgggatcctgttatatggcttggcctcccgactcagggatacccggcgtctctccttccttgtaagctacatagccagtaagaagatccacactgagccccagctaagcggtgagacccctacctgtcctgccagttcgcaccaatgcctcccttcagccaagacccctgtcttccctttttgccaagtcctccagtttctttctagacacctagttctgcacaggcactgaggcatggaaggggtggcctatggtgagactgacacgggaactgtcagggtctgaggggggatccactctcgacacgtgcttctttcttccctgtgttctctagggtggtggtgccagggcttaacttttcaggaggccagactatccttggagtttcatgagattaggaccctgtctgtccacttcttggagcagagatgccacaaactcacgggctctttcttctcagctgcccttgagtatgtgcggagtcaccccttggaccccatcgacactgtggacttcgagcgggaatgtggcgtgggtgtcattgtgaccccagagcagattgaggaggctgtgagtctttccccaggcatcgtctgcctccccagtcctggccatggaaaggagtggctcagtttccctcctcaggaagacccagagtgagggtgtgggttcccagaatatctctaaaggtggctttcctgaaccacatggtttggctttctgcaggtggaggctgctattaacaggcaycggccccagctcctggtggaacgttaccatttcaacatggggctgctgatgggtgagcagggcctggaacggggctatattgttctctctggtcatgccttttcttctgggcacgagtgagaaggaggtgggggaaggaacaggagtgacttaaagtggtctggctgggctcaggctctggttctggtggtcagccaggacctttccttgggaaagaggtggggggagtactcttttttgcctttctgcagctccttgtgcctatgcttctaggagaggctcgggctgtgctgaagtgggcagatggcaaaatgatcaagaatgaagtggacatgcaggtgagcgtgcttcactaagctgaagctggcaaagactctggcatgaacagagcctggaatccactaagggataaaaggcaggaagagggctgggcatggtggctcacgcttctgatcccagcactttgggaggctgaggcaggaggattacttgagcccaggagttcaagaccagcctgagcaacatattgagaactcctctctacagaaaatttaaaaattagccagacatggtggtgtatacctgtagtcccagcaatttgtggggctgtggtgggaagattgcttgaatctaagagatcaaggctgcagtaagctctgattgcaccactgcactccatcctggagtacagaatgagaccctgtctcaaaatcaacaacaataaaaaaaggtgggagggggctgggcatggtggctcacacctgtaatcccaacactattgggaggctgaggtgggcagatcacctgaggtcaggagtttgagaacagcctggccaacatggtgaaaccccatctctacaaaaagtacaaaaattagctgggtgtggtggcgggcacatgcagtcccaggtactcagaagggctgaggtaggaaaatcgcttgaatccaggaggcggaggttgcagtgagcggagactgtgccattgcattccagcctgggcaacatgagcaagactccagtctgggcaacaagagcaagagcattttaagctagcagacccacatgagaagagatgggatgggctaggtaggttttttcagtcagtgctggtagataggccaggaagccttgggttggtgggtaggattagtcaggggctccttgaaagaggatactcctgcctctgcctgattctggtctctgctcaggtcctccaccttctgggccccaagttggaggctgatctggagaagaagttcaaggtagggatgggcatggccctgagtccctgagggtgaggtgaggtatggtgagacttcaggctggggaaggaagtgtctgaccacagggatcccaagaccctatccaagagaaaatttgatgccattttctgaagcacctggggcttctttcaggtggcaaaagctcggctagaagaaacagaccggaggacggcaaaggatgtggtggagaatggtgagaagcttgagactcctgtcacagcattcagctccctgacttctgaacctcctcagaagagtccttacaggctcctcaggcccttggcttactcagtaccctgacttctgtctcaagactgggattcctggtgtttcttttgttccctttgccc

SEQ ID NO: 10601 - DNA, 149591 bp, Homo sapiens
cttttgtttcctcaccaaacagaaaacagtagttgaacctaaaataaaacacttatggttatgtggtttatattttatattttagttttctatcttacctttactcccccttttctgttgccttctctaatctctgttacttttccttccttaccggcaaatatccatatagtgaaagaagtttactttctacagcagtcataaagaggtcagcaacttggtgtaactgtgttgatctacacatacaaaaatattttcctggagttacaccaaatcatgttacttctatacaattcctttcctgtatattcattcctaaacccatggccaaaacagactgcaaaagagccatatcattcttactatggattagagttctagaaaacaaagtcctgtgtgtgtgtatgaaagaaaaatgtatatatgaaagatatttaatatattaaatgtaggtttcatttaaaaagtagatgttgctttcaaaaaggagaatgtgagaaaattaatatttaccactttaaagctttcgctgacctagggaagtggtagtagtagtattgataggagtgaattcttaggtgatgctgggaattagctgtgtcaaatgcatatagcacaaaaatcgccattactgaacaatgatcttttttctgtatctcttattatccttgatttattgcagtatgccgtttacttcctatccagctcacattctgtggtccaccctttcaatacctctttcagtactctaggcacccgaaagccctgtagtttccctactttatagacatccaccctgctagccattctctctctgcctgcacccaaactctaagtgcaactgggaggaatatacatacattctatcttcagaatcaccattctcagcttggcgttcagtacaacttggcaattctctcatccttctctggtcaactcacttccccactttctgcaaagatcagttatacttcctccattttcttttaaaattgcttctgtgtttcagtagatggcctcacctacttcacaaagagaggctgtcagagaggaattaagtcgacttccttccagcacatctacaaacttacctgcactcatcctttcctctttcccatctgataaaaaaggagaaggtagctctctatgtagtgtcacctggatctggatcctatctcttcttgtcccctcttgaaccttggcctatggattatttcccatatcttctttttttttttttcagcctttctactggcatcttttcattgacattaaatatattcaaacatcttctatcttttctcttttatagcaaaacgttctcagaaatcatatgcttttgtactctttttcttcattccttctatttacacagcaattcttgcaattcagcctttgtcccactattccatgaaaatgctctcatgagtcattcgccgcctcagtcaggtaaacctaatacatacgattgtccctcctacttctttgtcagtcatctttgtaggttcctcctatccaattaaaaatgagttcctcagtgctaggttctgggtctcttcttgacttgttctacatcttcttccaaaaatgtgttctctgagtcagcagcataggtatcacgtcagaacttagaaatacaaactcttggtctccattcctaggcctactgaagaaaaaactctgggagtagggtctagaaatctgtgttaagccttccaggcaattctatctactctaaagtttgggaattattgccctagacaatttgatctatatagtcttttgccagtgattactaatacatctctgcagtccatgtgtctctcccaagatccaactgccagcttgacatggatatatcattggtgcctcctatgcaacgtgtctccaacagagccactcatacactattcccttttctcctaaccagttcttcctctagtaatccctttttcaaatgatatttaccctattgcccaagccagtaacccagaagcagctttaactcttcccacttccttaattcccacccccaattcaataaccaaacctcttaaacatacctcaaatctatccacccttttcaatccttactactaccaccctagaccaacctagcatcatctattatctggcccactgcaaaagcttaatcagtctcccacaatcactcttgtcatccctttaaaccttttcatatcactcacttgcttaaaatccttttatcacttctcacaatccaaaggttcaagaataagattcttaacaaggtctccaattctctacatcaggggtccctaaccttcaggccatgcagcaggaggtgagcagtaggcaagcgagggaagcttcatttgtatttacagccactcccatcacttgcattactacctgagctctgcctcctgtcacatcactggtggaattagattctcataggaatgcgaatcctatgtgaactgtgcatgtgtgtgatctacgttgtgtgctcctcatgagaatctaatgcctgatgatctgtcacagtataccccatcatccccagatgaaaccgtctagctgcaggaaagcaagctcaaggttcccactgattctacattatggtgagttgtccaattattttattatatattaccatgtagtaataagagaaataaagtgcacaataaatgtaatgcacttgaatcatcctgaaaccatgtcttcaatgaaactggtccctggtgccaaaaaggttgtggaccattgctctacatgattaataatacatataaagcagttacaacagtacctgacacatagttgacactcattaaatgttacctagtatcttaggccattctcactctctctgttatagctatctgacttatttcaagtcctccaatatactctttcttaccttagcacttcagtagaaagtgtgccacccccacctccatcttaagtcacctctcaagtttcagtttttcctgcacattccctcaacaaaactagaagtttcactgttacatagcccaaaaacattctgtacttatttgtaatattaatcacactgttaattatgtaaataatctttctttctcattagaatgtaagttccatgaaggcaggcagtggattggtcttgcctactgttgtaacccctgtctggcagagttcctggaaaacagcaaataactgtaaatgttggccaagtaaatacttgttatctacttccaatttcataaaactttctcttcccttgagttctgttatactcaacttttctgtttttcctcttctatctctgactactctttctttggcttatcttctttgttgcttttggtattgtccaagtatttgtccttggctatcttcttagttctgctagcagtttcttcttggtaatcttatacacatcaggttttcaactatcatctctgggtagatgatttaatatgttttaccccaacttcaatctctttttttttttttttttttttgagacatggtcttgctctgtcacccaggttggagtgcactgagatcatggctcactgcagcctcgaactcctgggctcaagtgatcctcctgcctcagcctcccaagcagctaggactacaggcatgcaccaccgtaaccatgcccaggtaattttgttgttttttaagtagagccagggtcttgctatgttgctcttatctggtctcaaacaatcctcctgttgtggcttcccaaagtgctgggattacaagtgcgagccaaatctcttaaatttgaatcccatgtttccaaatgcttagtgtatgtgtctatgtgattccttaatggcatctcaaattcagttacaactaaaattgagattctgattatcttcccgaaaagttccttgtcctgctcttactttcaataaatgacacaactttcttttagtcaggtttgagaccaaagtctttccttcactgagtctttccctactccttatattcaaataatcagaattcctgtggattctgacggcaatatttttcacacttgtcctacttttcacttccactgctactactgaaattcaggttttattagcttacttgaactatggcaataacctcgttattttccttgacttcaacattgttgccatatgaattttcctgaaacccagttttcttctttttcattaaaataaaaaaaaaaattcttgctgagaagttagggctttctaccaccttcgaaataaagaccaaatttcttggcctagcatttaagaagattcagtaactggcacaaaaattatcattcatcatccccagatctgccttatagctagctgaccctgccactcttattttttttgtccaggaagctctttacctatttttatatatctacatcctatcaagaccctattcaaatacttctcatgaagatttgactgacagctgctgtgcccctctccattccaaaccctattaatagtctctccattcaaggatatctcatagtgctttttcatggtattgcaactttctcccttgaagcatttttttttttttttggcacaagtgttatgtcccctacaaaactctgagtactttaagggcagagtctatatttatctttttgcctatctctttgccactttgcaaagtacaacaaaataatggctatagaattactggaattaagtgatcaaagtatagtggtcttatctctccttctacacaattgtagccatttccaaggtcccttcagcaaaaatcacaaaagtaactcacccctgcccccacaaaaaaaactccaaacatcaaaaaagcaaaagcaaagcaatcacctctttcacgactggggacttgtagtacaatgttcctatctgtaaaattctcacaatctttcgcctgtcttgcttaattcattaatcccactggtctgtaaacttgatgacagcaggaacttgttttgttcactgttatttccctagtgcttgaaacttaataagggctcaaaaatatttatcgaatgaacgaactaggttttttgcgtaaatgtcaccttataaggcttctgtgatctctccagtctaaattgggcattcatatataaatataagtatgtgctttctcctagatccatttttcaccctacctggcaatctcaaaagaagtccaaagttgatcatatgcacgtgccccagatgaaggaaacagaaactgttcacatagagtgcagtattatcgttgccatttcataatggctctaaaaaactttgttcttcatgacttcgcaagctcttgcaaccccttccaataaacattattttaaagatgctgcctttttcattcctccactgagttcttggttctggataacactgataccttagggacacctggaatcgcaggagaaaaggctccgattccaaaccaatcaagtggctgaaagctgacagcaaacacttagaaaaggaatgtcaatcctttgatcaaagcatcacacatcgaagtcctagaatgggggatggtccttgacaggggagccaaaagatgagagacaatgagggagctacgtagagaagtcactaaaaccctccgacaaagtccgaggcaggattccaagtcccttgtccctagacctagaaatatgctcggtccgcatgtcccggcccgcaactccctcggaggaagcacagtcctcactgaaaggggagagcagtcagtctagggcacgcaaccgcccgtaaattatgattccccttgaggagcgaggaaactaataccccacgtagctactctcccacctcgctcctggcgcgggggtctcgagcctccaggaggccaggagcagagtcgctcagcataactcaccgttccgccccgccctgccgatccgtctgttcccggtggtcccttcggaaacggttcccgcactggccggctccgaaagcaggaaaacaaaggttcccacagtaggggcgggggaaacgtttggcagtgcgacagtaggaagtgacgttacttccctttttccggtccgccggattatgaatgacggccggcgcgagtattttccacataaggtggctgtcgtttttctcctggcgtctgtggaggcgagtggtctgcgggcagcagctcccagaggcagccttggaattccagctcggactgggcgggaaggcgcaggcggcccaggtcgccgacacgctcacgcaccctccctgcctggccgcgcctctgcgaccaggtaaagagggcgctcgggccgccggcttctcagcctccgcgaccccctaagaactggtcttttcttcgggggtctgcagggctgaggatgcgggggaagggtgggaaggacaagggcgtggtatcatcgtcctgatttttctcccgccctggggccgcctcaaactcctttttggccactcctgctgaaggtgcgggttgagggctctgggcttctcggtagtacgcgtttcccagtttccccctagccagtccctcatgtcttcctctgctgatggagaaatggggcagcttccagttggaggcgttggttggggtggtttgatatttgctgttaagtgttacttcaagacctcttgggtcacactaacttctcttctctctttggcattgagttttccattccagcccttcctgattgcagaaagcagttctatgtgaatactacttaacatttactccaaaggacttgcttcatttggggccatttgcttatgttttgtcatcacagcagtatctcttgggtttttaacttctatagaaagtttaatttgcatgaaagttgctttggtttcaaaaacgtttgctaatacacgtacttcccatcccaactttctacctggttttgggatgagatgacttgtttttttcccctttattcttaatgccaggatcccattccttgtcataaattcttgaatatcaagaaaatgccagctttagtaatatattgtgtgctacattattgataaagaaggtggtgtatttctattttayctaagcttatctgtaaaaacaatgtttacaggagaaaatgcaaaagctagcaagaactagtgatgtgataattttaaacatgtaaacatagtcatttaaatccatgataataaactgttataacacaactaagtgattcgctgtcatatttaataaacattaagctatgcgggtttttttttctttttttttaactgcctgatggggagcatacaccactgagaggattgctttaagcacactcattactaaaaattgtgtttgtattacacctgaaagtatcgttttgtgaggtctcacttcaaaaataagactgaaaaggtcaatgagatttgagaatcatcatttctttttattttatatactttgcacttctacgtgtttttgctttaatttaaacacagctcaaacttgagcttctgtagtagtgggcccatcaattttttttttttttttttttttttgagctggagtcctgctctgtcgcctggggatggattgcaatggcaacatccgcctcccgggctcaagcaattctcctgcctcagcctcccgagtagttgggattacaggcgcccacaatcacactcggctccttttttttttttttttttttcagtcgaggaggggtttcaccatgttggccaggctggtctcaaactcctgacctcaaatgatccgcccgcctcggcttcccaaaggggtgggattacaggcgtgagccaccgcgcccggcctgtttttgtttttttaaacttgttttacttgtagcttttgtttcatcatctgtgatttttaaataaaaataaatactgagtatccaattagcttttctaacaaagaataaatacttggaatgcagatattgaaaccatttagattaaaacaagcacaggtattgtttgctgtgaaaattcagtarttttatttcatacttggtaacatgttagccatttgcgctgtcgatcactgttaattatgaggtcgggtttagctgaaggcattatgactccatggcaacagatgattccctgattctccagagagattacacacttcgtttgtggctaaggttactgtaagcttttcacttaaaaacttttcctacttctttaccagataagaaaacagctaattttaatcactggcttttgttctctaggacttaactgcatcccatattacgtatttaatgagcttgaaaaaatctcagtgtttttcttatcgtttttgaccctaaatatttaaggtaattggctgctatctatctgttgaggggcatgtttttttgttttgttttgttttggttaaatctatattattgtaataaaatagggtacaattttcagccaaatactgttgttttatgaaaagcataaaacacaagataagttataaaattcaaaatgttgaacatatgatgtaggagagaatttaggcaggtttaaattttaatctttaagaaaagtaagtgtttgtgatttttcatacttataaactgtgttgaacttcttattttgtacaataggttgatatgcacatggattaagggtttcacgtttatattttaccatttcatgattccctggctttcagcctcagtaacaaatatgttttttttcagtatttggttgggaaaaacttttcaatcaatataaatcctttacctttcatggaaagaagcttgaaaatataaaccataatttgggttttgcccatcaaggtttgcatattttaatagtgccagttgataaggaatttggttataaattataaagaaataatagtagctagtatttatttaaggacttaatatgtgacaagcttttttctgtatggcacactacatggtaggtacagttattattgtctccattttattatataagtgaggaaacagatatgcagaaaagttttttatagctactaagaatcagaaccagtatatttgcacccaggtggtctggctcaacagtctcggctctaatctattactttataattcttgttttataaatattcttgctaggcacatgtatggaatctagttaagattcttagttcctttgccctggatataagtatacataaaaacttctgtgcttgctttatttatgagtttggttagattccatttatacttttcccgattcacctcacaaaggtgatcttatttcttcattttaatttatacttagttggtccttaaaatagagttattaatttggaaaagaaagaatggtgtcatgaagaatgagatacacattgtaccaagactaaagttattaataatactctcagacagtgatttctgacattcatatatgtacattcattccttgaactaaagtttcagttcattaagcactggagatgttatagtgttaggtgataagagctatgaagaaaaagggaagctaggtaagaggctagggtgtgctttttcaattcaggcagtcaggagaggctgttctgagttaatatttatgcagaaaaatcaatgaaatgagggagcaagccctgtgaatctcttggagaaaagcattctaggcaaagcaatagcaagtacaaatattctcaagtggcaccttccaaaaacagcaaggacagctatggctggaagggagtgaagaaggataagagatgaggtcagaaagggatagctagggtcacagtaggcctataggccataataggaaatttggattttattttgagtgtgctgaagagccattggatggttttgagcacgagacatctgatttatgtttttaaggatcaccctgttgttggagaatggactgttttatggaaagtggaggaaaatagttaataggcttttgcagtagtccttgtaagcactggcgatgacttagattaaggtggtagtggtagaggtgctgaggagttggatttagcatatacttcaaaggtagagatggcagggtatgagagagagaaaaaaagaagttgagtgggacttttgagtttttggcctaagcatctgggtaattggtgttgccattttaccaggaagtagaacacgaagggaaggggagcaggtttagaaaaacatccacatggagatgtcaagtagaatatagtagtctggagttagaggagaagatacggctgggatatacatgtaagagtcagatcatatttaaagctatggcactggagatcacccagaacagtgctgtcatattgtgagttgtgccccattaatgagtcaggaaatcaatgtaatgagtaacaaccagcatttaaaaaaacaagcacagagtaaaaaatatcagatttatcccatattgtaggataagtattgcttcatgacatttttgtttctattttattcagtgtattgtgtgttacattataaaatatatacctaattgtgtggcatgctcaaaagtttgaaagccagtattcgaaggatggagtgtggattgagcagagagcaaaacactgagctgtgggtcactgagacatctgcagagtagccaatgaaaggaatcaggaaagaattgccaaagaatttaatccagtgcagaaacttgtcaaataacccagcctttggaatggaagtttatatcaaggattactgaaaccagcatacttgcttagaataacataatatctgacaattttcactttggtaaaattgcttcaatttatgaaattttatttataaatagtactgttatattagaacaatacctattcttaaatgtctctaaataagatcttttatgaatttaattaatacttttggactgatgtacaattctcatctctataatggaaataaaatacttttaaggattgtgagcattagaagtaatgcacatgttctgtgtgcttagcacatagtaggtggacaataaaatgtatgtaatatttaaaactttatttacctaacatttgttgagctcctatcaaattgtagtcacaaagataacttatttgaaaaaacaaaaaacaaaacacaggttaatcatttgcagcagttatgcactttttggtcttcattatataatatataatttatctaatatataatgttatgtatacataatgccatagatcttgacttgaattttgatcacaaaattttcaagctttattttttctggactgtggagaagtatgcttgtttttaatatgtttactgtttatctctcattctctgtgttttatcaaggctaagatatattcattagaatgaaagtgaaaaaaaaaaaccagatctgaatgcctaaatattaaacctatgactaattccaccatttaaaaatatattagaacattcctgagtaatgaaatcaaagacataatcttttctttttacccatttattcattcggcaagattcccaagcaaattggcacgtccaggaaagagatgcacactctatttaatatcctgaagtttgtggttttgtctgctactttctcactccctctctgcagagtggcacctgtcaaagctgagaaagagtaaattactctatttctgtgcttggcaggaatgtaatatggagtaacaagagctgtgccgcagaagccctggagacagaagttgattctatagtacctaccttcttaaagctcgtgacagaaaattagcgaactaaggcattctgaagctagaaaagaaaaaagaggaaggatttttttttttttgcctgtgatatttgcatacttggagcaaatactggttctactctctaaaaaggcacagtgcaagccaaaaacatcacatttgtacaggtttacaaatatttaatatttattttaaaaattatattagtacataatagggagacattattcaaggagagtaatttttttttttattctaagatcattaagtaacatttttaatctcccagggggaaaaccaacatctatattaaaaaaaatacgttaagaatcaacagtactttgttgcattttctctcaggcatctcattaatttttagatatcaccatgggcaggttattgctattctgttttgctgacatttagcattttattaagtgctaacagtgagaagagtttatagaatatgtctaaaatcctattttcatattcttatgtgccttacaacgtggcaaatataggcatactttttaaaagaatatttctacatatcttaaaagctattaaatagcatggctttgtttccagttttttaaaaagtgttaggatgagcctcgtaattactattttttagactgttgggcaaatgatgaaatcagtcatgttttctttcaaaactgctttcttgaaacacttaggggtgagtcttctttttactctcctactgtcaggagagtgagtccagagcaaactcctcaaaaagactgttaattcctggaaagtgtggttggtcctttttgccctagtgttgttacagatctcactttgtttgactgtttttaaggacttatagcataaaggtgttatattaataatgaaaatatttccagagctctattcagctttataaaaaaactctttgaactttgatctttaataaatacctttttgttttaaaattatctctcagtgacaaaaatttttaaaaaataagctcagggagaaaatggcatctgtaagttaaaaagttgttgcttttacagtatataaaataattttcccccagataatcttttaagaagtaacaaatcatggtatatatctgttatattttaatagaagaaatataaaataaagcagtagtgattatttgtattattaagaaacttagataatactttactgactatatttattttttataatggattacaagttccttagttttaaaaaatgaagaactaagaagcttaaagtgtttaggtcttgtttcagatttttttaaaaaagggatttaaaatattaaagaaaatttagtatgatgaaggttttctaaaattaagtgtacactaacattttgaatacacttaaaagacaagaggtgcatgtgtactttttaacagcttttaaagtaattttccttctaatatgtcatgtttctggtacgtatttccatggtgaatacttttaaagagtgccatctagtgtcagttttggaawtgtaatttatgtattagaacattaggaatttttgacccgggaaatgtataaacataaaaagacaggacaattgataaaaaccttaaggaatatgacttgaaaatagccatgaagaatctgacctcaagactgtgtgtgtttgcacctttaaccagtatgtatatttatctctgctttcatttgtcaaatactgcttgcttatatatataataaacctataaagcagtgaacaaaaaatttttactcatggaacattctagttagaggagacaaataataacatatagtatatcaccatagcaataagcgctaggaagaaaaaacatagatggaaatagaaaggtttttttcagggagcgtggggattggggtttgtgatttaaattgagtagtcagggaggatctcagtaagaagttgccattgaataaataaatacctgaaggaagtgaggaagtgttctaggtactggaaacaccaaatgcaaaggccctgatgtgagaatgtacctagtgttttagcaagggtccccaacccctgggcccaggactagtatccatctgtggcctgttaggaaccccacctcaaagtgggaggtgagtggcaggtgagccagcattactgcctgaatggcgcctcctgtcagatcagcagcggcatcagattctcataggagctccaaccctcttaactgcacgcaggagggatctaggttgcactctccttatgagaatctaatgcctgatgatctgaggtgaaacagtttcatctggaaaccatccccatccccccaccaacctcccatggaaaaactgtctttcatgaaactggtccgtggtgccaagaatgttggagatggctgttttagaggaataacaatctactttggctggagcagtgagcaatgaagaaagttaatgagacaaactctgagacataaaggaggattagatcaaggagatttttgtaggctgttgcagaaactttggcttttctctaaggagggtgggaagaccttggagggtttggttatgggggtgtgaaggaaaagaatggtgtaacctgagatgggaagacacataaggagcaggtttgaggggtgggagagaataaggaactggattttggacaggttaactttaagatagctatcagtatccatgttatggggaaatttaaatatttttatattatgattcagcackcagcagctatcacttacttgaggagaatccacttctcctgaaagaacgartatcccctccctattattttgtagggtcgtaaaaargaagcagtatggaaggaccagcactgtcaaaacttctcaaggatattatccccagacagctctcagtatttttggttaatttatttccccttctatttatctcctgttctcacatatagtgagaccccaaaatacttgattgggagggctctattgcaaagcactggggtttgctcattttaaaggagctgggtgtaatatttcctctaatgctagttaattgcacagggtggaatttttttcttttggaagtcatttagtcagtcttcagaaacaarccttrtagcattattatctactgcaaatttttactgatttctagaacaggcttttgaaacattcatcttttattttrgcttctaaatgattatattctaagaccataatcacttcaatttatactttaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagactwgcttgaaagcctgtgctgaagtaagtataatgtcttttttctgttatttgaagctacacagtgataacataattacctgaccatttaatattttaacttcctattaggaataaaagtttatttattttaaaaaaccccagtaaccaatgaaataaagtagccctttgatatagtttgaatatttatcccctccaaatttcatgttgaaatgtgatccccaatgttgttggaggtgggacctggtaggaggtgtttgggtcgtgggggcagatgcctcgtaaatggcttggtgctctcactggggtaatgagtgagttcttgctctattagttcatgagagatctagctgttgaaaagcgcctggtacctcttccttgctctctcttgcaccctctctccccatgtgacatgcctgcactccctttgccttctaccatgactaaaagcttcctgaggtcctgatcagaagcagatgcttcttatatagcctgcagaaccatgagccaaataaacctctttcctttataaattactcagcctcacctattcctttacagcaatgcaaatgggctaatataccctttacgtgtgtcaatatttcagtgcagtattgaaaaataagaatttaagtcttaatttataaagtttggagacatttttagaaaataactcttttttctttattttagttatgttgatttttaaatggaatgtttacatataaataggagctcaaatagcaatgctttggaagccctgcttattgtgggggctaggaggagggtaggacaggggaggtatattgtaaaggctttgggaagtaatgatttatttagtaaggggaatacaggaatgctaaacttcttttgcttaatgtttttacttctgaagcactgtgatgtgtctcctgatacaacataaaagcctagcccagggatgattgagctcaaaacttatttcccaataagacagttattttttctaaagttatattgaaattaaaaaatmttttcatttcttgttttgtttttgttttgtaggttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaarctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaaggtttcatctggactgtacacattactatgagtttcagtctatgaaattgcctaggtttgaatttctgttttactttttattgtcaatatgctgctaggaaagttattaatatctttctccattttcttatctgtaaaatggtgataataatagtacctatctaaaaggaaaaatgtaaggaacaaattaaagtttgtgtgaagtatggagaacagtgcttggcacatagtaagctctcaatcaaagttagtaattactatgacttttaatgtgaagttgctaaaatgttaacaattgttattattaatttcaagtttctgttgtgattactttctaatagtagaaggtccaagtcggctctgtggtgcaatggatactccgttggacgtctactattagagggtgcagttaaaaaaaaaaaaactaaaaatcttgtcagctaaattttataatgaattgttagtcacttaaattaatcttatgttaggtattatcaaactgaaaatattttattctgacctgtgtgcttttctctgttctctctgagagtaaagtagctggctctgttattatgtgctgggggagaatagatagaacgttttctgagtaggaagatctctctctctctctctctgtctgtcttacatacacacactcacacacgcacacacgtgtgcacacacacattccctctgtggaggaaaaaagaacagggtgaaaataataccagagtgaacataggaagcttagctctctgcagccttccaattggttttcaagagctgcattgctttttgcttttgtttgggtttttttcttggaagcatttcccccttttccctactaaggaatcagatattagatttcattctcattatatatcaccaacaattcaggtatctctatggacagaagagactgctatcgaaaatctatgtatttgaaggctttgcttcacaagtaaactcggcagtattcatcaattgtcattttcttaaagaacatttctcttttcctcaaaattgaaccaaatttggcaaccaaaacaatataaaaagagagagatccaggaattgtttagatgttgattgctattttaaatgccagatgtcatatgtcttcacagagtccatggagttgagtgggaagaagacattgatttttaaattttttcctagtcagatgattcctaggttctcttctccatgatccctctcttctattaccaagttccgtcattagagcagtcatttgatacattatgaagtacttggtcttctgtcttcttgacttctttggataactgtgtttccagtttcaccagaattgaatgaaagtggcatatccattcctttattgaagaaatttattaaaattatttgaatacataaactaattctcaaaatattttccttcgttcctttgtatttttactggatttttttttcttttttttttgagatggagtctcgctctgtcacctaggctgtgtgcagtggtgtaatcgcagctcactgcaacctccgcttcctgggttgaagcaattctcctgcctcagcctcccaagtagctgggattataggtgcacgccaccatgcctggctaatttttgtattttttaagtagagatggggtttcaccatgttggccaggctgctttcgaactcctgaccttgtgatccgcccacctcatgttttccagaattcatccttctttgataaacccttgatatttgttatatttttctctttaaatcatcttgggtaataaagtagtcattttaattcatatagtggttatgttggcaagcctttttgcttgcattaacatacattgaggtgaatggagtggccatccaaatgatcagaatcaggatcaagttcaacatccgtaatcaaggtcaagttaccagaaacataaaactgaatctagggacagaatatttagtcgcaggaataaagtcaaggacataaaagtaagagtcaattttgctaaatcaaggtttgaattactaagggtcaaaattagaagaactagggaaaatacccagttctgctaaacagaataaaaccaaagatggaaaacaataacaagtagaatcgatgaggtgttttttttgtttttttttaatttgtcagagacaaacatggaaatgctaaggtattatatataaacctgctgcaagctcttccttttcagaaaatactttattactttacaaagttaacccctgatggctcagcacctcataaggaaaggggcctgacgataccctctcctctgaaaagtcttagaaatagatttaaaaggaataaattaatatgtacactcatgtttccccccattcaatttatttgctagaattttctagtagatagcgtatcaacattatgggagaaatagcaatgaatagctatactagggcaaaatcctactgttccaatactagaagattgtatattatttttcagttgctactagtaagcaagtacactttgacagaaatatttaaaacattattgtacgcctataagacagaaagttgcattttatcattttataaaatcttgtaatttgaccacttatgatttaattttctacattttaacttctaatgctttgaattgagtttaaatacacacatacacacacacacacagacatctttattagcttaggtaaaatcattcctcttttagaaattgattttttagcaaaactaaatacctcttcctgtgttcccatcggcataaagttgggaacctcactttttgctggcatattgcaaaaatggttgatgccacttatttagtggtaaatttgtattttctgtgtctattcctattcattaggtcctcaagagcttttagctttaactcactagttctaatttataagtaaaaaacagagagctgggattatattttcatttagataggttgtttactgttttttctctgcttacactgctcacctaaacatctgtgagtatattttcaaaaaaggaagtatgactaaggaaatgatataaaataagaacaaatattttatatagtaagtgattgtaaaggaatgcaaaggaggagatattttgaatagatgcaacatcttgcttctctttttattctgacaaatttttctgccctttattgacaattaactacagagttactaaaattttatttttgctttgatagctatgctttttttttaaacctttgttttaaaaatagatcatcttttttttttcttgtccttaaagaactctgtgatatttataatggttttgatcttatgagccaggtaactatttggtaatcattccttatgaagaaatttaattttcatttcacagagttttcattagcaacttccttaaatatatcttcatgagtgtaatgaatgtggttcagtaccttctgagctatctggatattagtagagtggcctggcatgttgataaatggagtgacctgtcagagtaaacctcctcaatttcttgtaaacatgaattattgttatttaattgcaacttcatttcaaaagaaaggaaagatgccacgtacatctaacaaataaaaataagtcactagaacgaagagtacaggaaagatgaggaaaagagaaaatttcttgtgtgattatcatgtctaaagatccattcccttagcacctaatctatttccaagcaattcacaattcttgagagaattaataaactttttggctctcagggtaccttagagagtatttttcaaactttttttttactttaactcagtaaatacagatggccttccatatccattggttctgtattcatgtattcaaccaaccgcagatttaaaatatttggaaaaaaaattgcatctgtactgaacatgtactgacttttttcttgtcgtgatcccctaaacaatacagaataacaattatttgcacagtgtttatattgtattaggtattagaagtaatctaggatttaaagtataggagaggatgtgtataggttatatgcaaatactataccattttatatcaaggacatgagtatgagtatctgtggatttgggtttctgatacaggtcttggaaccaatcctccatggatactgagggacaactgtaatacattttacaagttggataattatagaaataaatgtatatctttaaataatatgtaaaaaaatatataaataattacaaaataacttataggatgtgtactctgatattttctatttcattttttaaaaacctactatgttgatttcacaacccctaaatgagtgataaatagcaacttgaaaaatactgactgaggggattactctctgaaggtaacaaatggattctttatcatttgttcattcactcaacagggtattatttgcaaggcagtgttttaagtgcttcagtattcaaagagagttacagtccttgttcttataatcaattacttgtgctcatttaatcttaaagtccacttaaaatacagtataatatatatgtatgaattttttattttctgtcctttctgtctcatgctctgatattattgtgaaatatatctgtagagatttcctgtgacttgacctttttatttaaaggtcataatctgttcataatctgttcataatcataagtcataatgtgtttgagacatcataatggtttctacggaaacatttgttgcctctcaaagaagcaagaacactctaaattttcaagaaaatagaatttggtggtagtgctagggagaaagcatctgaccaagagaaaacaaaaatatatgagtttgtatcaggaagaacaatttaaaatttttctaatttgaaaaaataaaagtcttactttaagtgctgctttataaaaaaaaaattctatagtgctagttatcttttttagttttaaatatttacaattttctcttttatctttttactattttctttagtaaaatgttctccttacctcattgtgtaatttttaaaaatatggttctgaaagatgcttcttacattattggtaaggaatatcatttagattatgcctaatagttcacacatacagagaaggtagtttcacaaacacaaaaaaatggaactttagatcattattaatagtacaagctctccatttttacacttctgcagtgagctacaaaatttctatgagacccctcaaaatacatcaatgattgcagactacagatattaaattgtgataatttaaacgtgttacattatttgtgttgaggaatttaatacttattttaattctttccccattaaacagttaaactaatttgcataagtatatattaaggattttaggtttttgatataatgttgtccaattaactctctatatgcagtgtgttaagaacttatcaagtatatagagggtcaggaacagaggaatgtgttcatggccatgaattatagatgaaagggtttccagattggaatgcagttgattatagaggagttcttagagaggggtaaaaacatactaccaatgaaagatgtagacaattgaatataagatgtaaagttttccaaaatgattttcagttgtactgtttatagacatttgcaaatgccattgttatttatattgattctttttggaattattgtattcttctttttctattgatggttgttttccattgtatagctgtaccacagtttatccattcatctactgaagggcatcttggttaattccaagttttggcaattatgaataaagatgctattaacatctatctgtgttcaggtttttgtgtggacataaatgttcaactcatttgaagcacaattactggattgtatggtaagagtatatttacctttgtaaggaactaccaaactgtctttcaaagtggctgtactatttttcattcccaccagcagtaaatgagagttcctgttgttccacatgcgcaccatcatttggagttgtcagtgttttgggtttttgccattctgataggtggcatttccttgttttaacttgtaattctctaatgatatatgatgctgagcattttttttatatacttagttgccatctgtgtatcttttttggttgtctactcagatcttttgctcattttaattgtgttgttcattttctcgttgctgagttgctccaatttttatgctatgaaatgaatcataaaaacgtataagacacatcactaaagaagatacacaaatggcaaataatcacatgaaaagttgctcaacatcattaatcatagggaaatgcaaattaaaattacaatgagacactactatatacccacaagaatgactaaaatcaaacagactgataataccaaggtttgacaagttgtgaggagatactggaacctccatggattgctagtgggaattgtaaaatggaagggcaaccatggagaagattttaatttctttaaaagttaaatatacagttaccataaaacctagcaatttgactcttggattttcaaagaaatgaaacacagtgccacataaacactgctacattataatgtatagcaacattatttataataaccaacaactggaaacatgcaaatatctatcaaccagtgaatgagtaagcaaaatatagtatatccacacaatgactactagtcataataaaaagaaacaaacgattggtcaatgtaactatatggattaacttcaaaagcataatactaagtgatagaagaaaaccacattttatgattccatttgtatgaaattctagaaaaggcaaaattataaacacagaaagccgatcagtggttgtctgcaactgactgtggtagcagagattgagtgtaaatggttacaagggaaatttcgggggtgacgtaagtgttctaaaactagatggttgataactggatacatttactacaactcattgtttgaactatacacttaaatgtgtgaatgttgtggtttgtaaagttacctcaacacagctattataaacaaaatatatataataatgtgttttattattttcctacctaggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggtacttaattattaacattttctttgaaaaattctatgtgataatattgctgagcattctactccaacttgtaatcatttgttgacattatttttgttataaattttatttgtagctttcttcactctttaccagttaatatttctgctactcttttcatttatgtgaagtatactaaattgaaaacttttagtattatgtatttttggagccaagtaagtcacaatatatacttttaaaaagcccttttctcaaaacttttttttttttttttgtatattcaggatattgaccaaggtagcatcatacctggtcaagtatactattttaacataatctttttctgttgtaaagttttggtctcagccttttttagtttggataatgattgcaagttaaatataaagataaggctgggtgtagtagcttacacctgtgatcccagcactttgagagactgaggcaggtggatcacttgaggtcaggagttcgagaccagtctgggcaacatggcaaaaccccatctctactaaaattacaaaaattagctgggtgtggtggcacgtgcctgtggtcccagctattcaggaggctaaggcaccagaatagcttgaacttcggagggcggaggtttcagtgggccgagattgtacygctgtactccagcttgggcaacaaagtgagactctgtctcggaaaaaaaaaaaaaagaaatataaagattaatatctcaatttacattccaaggttttgtttaaatttgtaattttggaattctttgaattttatttttactttaatctttgattttaatgtttttgttacataaaagcctgggtgacagagtgaaaccctgtttcaaaaaaaaaaaagaatgcatatgctttattttttttctccttggggcatagtttgttttcagtagtactaattgcaaagttttcaacaatgggctttcctttccctaacatttgaaatgatctgcaaaaatattttgcttttaataggtgatgtgaggatttatttgaatagagaattcatgaagtaagttatccatcgagttacactggaaaaatattcattatatttccctatttgggttaggaagtatttgagttcggtagctaacagagtttactgatttagaaatggacaggaagactttggtaaggataccaatcccttaactcttcagctaagctctgtggcctattgattaagcaatgaaacatgattatatagttgattttagaagttattgaggcatgtctagattttgatgtgtcttgattatattactacactgccaagggacctctggttcacctctcgagtgaatatgcaactacttttggaaatgatgaaaatatcttaaaatagatagtggcaatgattgaacaattgtgaatattataaaaaccactgaattggatactttaaaaggataaattatatggtattaatatatatattttatctcaatatagttgtgttttttaaaaagaccctaaagtaagaatgagtttagtgaaatgagaaatagcaagaaggtcagtgtggctagactgaagaagatagaagagaggtagatgatgtcagagagatgtgtttgtctttctggaggcaaatcagtgctctgggcttgtagatcaatagccatatctctagccctaatgaaagattatttgtactatttccttcgggacacaaattcagctagtttttataatggaaagtaatctcataaactgatacaaagcattcgatgctagagtctcacagatttttatttgaataggttattcctaaagataaaaataacagagccatggagatatctagatatagatatatagatatagatatagatatagatatagactgtgtacctggaatgtgattggaaggggtctgtgaatccatgtgtatgccatgccactgtacgtagatcaaataaacaaatgtacagcttctaagatggagaaggatcctgaaaatgttttaatatattgaaaagtggtcctaattcttgaaaatattgggaaccatttggttacaccagaggaatttttctctagtgacattaaaggcacttataaaagactagtatgagtggtattttggggtatgtgttaaagtggtagcttttaggctgtggcgattttcatatatgtaaagggagactttgatggacatatgcagagttctttttttattatttctatgtggattgtttttgataacattttcatcctcagctgaactttctctttgatatccaatatatttctaggtagcttattgcttctatggattttctagtaataattttaaaatagcattactttttattatcacaatattaaaaaataggaaagtaattgtgatgtcaaaatactcaacacatggtatttttatttaattaaaatatgtattttggggaatagctgatgattattactatttatcctcctccttaccaatatacaaatataattttttagccttcaataatataataagactatattaattccttaatttagaaagaggctatttccttttctaggaaaagggcattgaagtgatgttttctccccacccttgccctacttggactcttgattggaatgttctscctgcagcagtcagcccaaaggaaggtgagttttcttttttctttaagttttattcatactttggatactgtcttcagatatgtcttctaattctctaaatctccctttggctttatctaatattctgattatactatcagttgagttttcattttatttttcttatgaaaattatatatacacacaccacttagatttaatatttctcacatttttctacatttgttttatttgttactgttttttctttgctgacatattttgatttttgttttgttttaattttactttaagttctaaggtacatgagcacaacgtgcaggtttgttacatatgtatacatgtgccatgttggtgtgctgcacccattaactcatcatttacattaggtatatctcctaatgctatccctccccactccccctaccccacaacaggccccggtgtgtgatgttccccttcctgtgtccaagtgttctcattgttcacttctcacctatgagtgagaacatgcggtgtttgctttttctccttgcgatactttactgaggatgatggtttccagcttcacccatgtccctacaaaggacatgaactcatccttttttatggctgcatrgtattccatggtgtatatgtgccacatattcttaatccagtctaacattgatggacatttgggttggttccaagtctttgctattgtgaatagtgccgcaatgaacatacatgtgcttgtgtctttatagcagcatgatttataatcctttgggtatatacccagtaatgggatggctgggtcaaatggtatttctagttctagctccttgaggaatcaccacactgtcttccacaatggttaaactagtttacagtcccaccaacagtgtaaaagtgttcctatttctccacattgtatccagcacctgttgtttcttgactttttaatgatcaccattctaactggtgtgagatggtatctcattgtggttttgatttgcatttctctgatggccagtgatgatgaacattttttcatgtgtctttggctgcataaatgtcttcttttgagaagtgtctgttcatatccttcgcccactttttgatgggcttgtttgtttttttcttgtaaatttgtttgagttcattgtagattctggatattagccctttgtcagatgagtagatggcaaaaaatttctcccattctgtaggttgcctgttcactctgatggtagtttcttttgctgtgcagaagatctttagtttaattagatcccttttgtcaattttggcttttgttcccattgcttttggtgtgttagacatgragtccttgcccatgcctatgtcctgaatggtattgcctaggttttcttctagggtttttatggttttaggtctaagatttaagtcttcaatccatcttgaataatttttgtatggggtgtaaggaagggatcgagtttcagctttctacatatggcttgccagttttcccagcatcatttattaaatggggaatttcttgtttttgtcaggtttgtcaaagatcagatggttgtagatgtgtggtattatttctgagggctctgttctgttccattggtctatatctctgttttggtaccagtaccatgctgttttggttactgtagccttgtagtatagtttgaagtcaggtagtgtgatgtctccagctttgttcttttggcttaggattgtcttggcaatgcgggctcttttttggttccatatgaactttaaagtagttttttccaattttgtgaagaaagtcattggtagcttgatgaggatgacattgaatctataaattaccttgggcagtatggccattttcacaatattgattcttcctatccatgagcatggaatgttcttccatttgtttgtgtcctcttttatttcattgagcaggagtttgtagttctccttgaagaggtccttcacatcccttgtaagttggattcctaggtattttattctctttgaaacaattgtgaatgggagttcactcataatttggctctctgtctgttattggtgtataagaatgcttgtgatttttgcacattgattttgtatcctgtgactttgctgaagttgcttatcagcttaaagagattttggscagagacaatggggttttctaaatacacaatcatgtcatctgcaaacagggacaatttctttctcctgcctgattgccctggccagaacttccaacactatgttgaataggagtgatgagagagggcatccctgtcttgtgccagttttcaaagggaatgcttccagtttttgcccattcagtatgatattggctgtgggtttgtcataaatagctcttattattttgagaaacatcccatcaatacctaatttattgagagtttttagcatgaagggctgttgaattttgccaaaggccttttctgcatctattgagataatcatgtggtttttgtctttggttctgtttatatgctggattacgtttattgatttgcatatgttgaaccagccttgcatcccagggattaagcctacttgatcatggtggataagctctttgatgtgctgctggattcgggttgccagtattttattgaggatttttgcatcaatgttcatcagggatattggtctaaaattctttttttgttgtgtttctgccaggctttggtatcaggatgatgctggcctcataaaatgagttagggaggattccctcttttgctattgattggaatagtttcagaaggaatggtaccagctcctccttgtacctctggtagaattcggctgtgaatccgtctggtcctggactttttttggttggtaggctattaattattgcctcaatttcagagcctgttattggtctattcagggattcaacatcttcctggtttaatctttggagggtgtatgtgtccagtaatttgtccatttcttctagattttctagtttatttgcatagaggtgtttatagtattctctgatggtaatttgtatttcttgggatcggtggtgatatcacctttatcattttttattgcatctagttgattcttctctcttgtcttctttattagtcttgccagcagtctatcaattttgttgatcttttcaaaaaaccagctcctggattcattgatwttttgaagggttttttgtgtctctatctccttcagttctgctctgatctcagttatttcttgccttctgctagcttttgaatgtgtttgctcttgcttctctagttcttttaattgtgatgttaggatgtcaattttagatctttcctgctttctcctgtgggcatttagtggtataaatttccctctacacactgctttaaatgtgtcccagagattctgttatgttgtgtctttgttcttattggtttcaaagaacatctttattctgccttcatttcgttatgtacccagtagtcattcaggagcaggttgttcagtttccatgtagttgagcggttttgaatgagtttcttaatgctgagttctagtttgattgcactgtggtctgagacagtttgttataatttctgttcttttacatttgctgaggagtgctttacttccaactatgtggtcaattttggaataagtgtggtgtggtgctgagaaaaatgtatattctgttgatttgggatggagagttctgtagatgtgtatttggttygcttggtgtggagctgagttcaattcctggctatccttgtgaactttctctctcgttgatctgtctaatgttgacagtggggtgttaaaatctcccattattattgtgtgggagtctaagtctctttgtaggtctctaaggacttgctttatgaatctgggtgttcctgtattgggtgcatatatatttaggatagttagctcttcttgttgaattgatccatttaccattatgtaatggccttcttagttcttttgatctttgttggtttaaagtctgttttaacagagactaggattgcaaaccctgccttctattgttttctgtttgcttggtagatcttcctccatccctttattttgagcctatgtgtgtctctgcacgtcagatggctctcctgaatagagcacactgatgggtgttgactctttatccaatttgccagtctgtgtcttttaattggagtatttagcccatttacgttaaggttaatattgttatgtgtgaatttgatcctgtcattatgatgttagctggttattttgctcgttagttgatgcagtttcttcctagcctggatgttctttacaatttggcatgtttttgcagtagctggtagcggtttttcctttccatgtttagtgcttccttcaggagctcttttagggcaggcctggtggtgacaaaatctctcagcatttgcttgtctgtaacggattttatttctccttcacttatgaagcttagtttggctggatatgaaattctgggttgaaaattcttttctttaagaatgttgaatattggcccccactctcttctggcttgtaggatttctgctgagagatcagctgttagtctgatgggcttccttttgtgggtaccccgacctttctctctggctgcccttaacattttttccttcatttcaactttggtgaatctgacaattatgtgtcttggagttgctcttctcgaggaacatctttgtggcattctccgtatttcctgaatttgaatgttggcctgccttgctaggttggggaagttctcctggataatatcctgcagcgtgttttccaacttggttccattctccccgtcactttcaggtaaaccaatcagccatggatttggtcttttcacatagtcccatatttcttggaggctttgttcatttctttttactcttttttctctaaacttctcttcttgcttcatttcattcatttgatcttcagtcactgattccctttcttccattttatcgaatcggctactgaagcttgtgcattcatcatgtagttctcttgccatggttttcagctccatcaggtcatttaaggacttctctactctggttattctagttagccattcgtctaatctttttgcaacgtttttagcttctttgcaatgggttcctcctttagctcagagaagtttgattgtctgaagccttcttctttcaactcgtcaaagtcattctctgtccatctttgttctattgctgggtaggagctgcattcctttggagggggagaggtgctctgatttttagaattttcagcttttctgctctgttttttccccayctttgtggttttatctccctttggtctttgatgatggtgacgtacagatggggttttggtgtggatgtcctgtctgtttgttagttttccttctaacagtcaggaccctcagctgcagrtctgttggagtttgctggaggtccactccagatcctgtttgcctgggtatcagcagtgtaggctgcagaacagcgaatattgttgaacagcaaatgttgctgcctgatcattcctctggaagcttcgtctcagaggggtacccggcygtgttaggtgtcattctgcccctactggggagtgcctcccagttaggctactcggggggtcagggacccacttgaggaggcaatctgtcagttctcagatctcaaactctgtgctgggagaaccactactctcttcaaagctgtacagggacatttaagtctgcagaggtttctgcagagggttccgctgtgccctgcccccagagttggagactacagaggcaggcaggcctccttgagctgcagtgggctccacccagttcaagcttccaggccgctttgtttacctactcaagcctcagcaatggcgggcaccccttccccagcctcgctgctgccttgcagttctatctcagactgctgtgctagcaatgagcaaggctccgttggcgtgggaccatctgagccaggcacgggatataatctcctggtgtgccgtttgctaagaccattggaaaagcactgtattagggtgggagtgacccaattttccgggtgctgtgtgtcaccgcttcccttggctaggaaagggaattccctgaccccttgcacttcctgggtgaggcgatgcctcaccctgctttggctcacactcaatgggcagcacccactgtcctgcccccactgtccgacaagccccagtgagatgaacccggtacatcagttggaaatgcagaaatcactccgtgtgatttcttctgcgtcactcatgctgggagctgtagactgaagctgttcctattcggccatcttggaactgcccctgacatattttgaaaaaaaaaattccaggtaacatgtcatactttaggactcatattttaaaaatatcgatatcttaaataatcacaatgccattatcatacctaataaaaattaacaaactttaatgatcttctaatgcccaatttataatccattttctccaattgtttaaaatgttgtttgagaaatattgttttattgtttggttttaagctaaatgattatatttttctttgctggaaataattattggtttgtttttgtttctttataattttttaaacatagttattttatattttatattttgtgtttctaatagttaatagttattttatattttgtacttgttatttctaatacttaatgttcatagaggtataatcctgctgtttgttttgtctgttgactttatttctggtaccttattttcctgtgagttttgtaattttagactgtgaattcatttggggttacctcaatctgtggtaatcttgtggggcttggattaagggtaaattcctacagaaagggattatatttgcttatacctactaggacttaagaccacttagcattggtttttcagcttcagatttctttaaaaaatgtttaaatttaattatatttgttattttttcattgacacatagtaattgtgcatatttttggggaacagtatgatattttgatacatgtatgcaatgcataatgatcaagttagtgtaattagcatattcatcatctcaaacatttatcattcctttgtgttaggaacagtcaaaatctgctcttccagctgtttgaactgttattaattataatcaccaaacagtgctgtagaacccaggaacatatttttcttatctagctgtaattttatatccattaaccaacttctggctatacaccctttccagtccctagtaactactattctactctctaattctatgagaccaactttttttaccttccatttggaagtgagaacatgtgatatttgtctttctgtgcctggtttattttatttaacataatttcctccaagctcatccatgttgctgtgaatgacaagatttatttcatttttatggctggatagttggatagtactccatcatatatatgtaccacattttctttatctcttcttctgttgatggacacttaggttgattccatatcttgcctattgtgaatagtgctgcaataaacatgtaagggcagatatctcttcactatactgatttcttttctwttggatatatatccagcaagggaattgctagatcctatagtagttctaatttcatttttgagaaaactccatactgtgtttcataatggctgtactagtttacattcctaccaacagtatataagtttccctttctttgcatcctcaccatgttattttttgactttttaataatagacgttctaactgggatgagaagatattgtgcatttgatttgcattttcctgatgactacttatttatttttgctgtttagttgtttgaattccctgtgtattcaggatattaatcttttgttggatgaatagtttgcaaatattttttctctttctgctggttgtgtcttcactttgttgattgtttcctttgctgtataggtttttagttcaatataattctatttgtctgtttttgcttttgttgtctatgctttttacggtcttattcataaaaacttgcccagtccaatgtctagaagcattctccttatattttcttctagtagttttatagttttgggtcttacatttaagtctttagtccattttgagtggattttggtgtatgatgaaagataaggtctacatatggatatccagtttttctagtaccatttattgaagagactgtcctttccccagtgaatgtccttgacacttctgtaaaaacatgagttggctataaatgagtggagatacgctttggatatttgtcctctgtaaatctcaagttgaaatttgaacccaaatgttgaaagtgggatctcaaggcaggtgtttggttcatggaggcagattccttatgattggctttgtgacatcctcatggtaatgtgtgagttctcactcttagttcccatgagaaccagttgttgaaaaaagcctggtacctcctctactctctctctcttgctcccccttgctatgtgatgcctgctcccttttgccttctgccatgagtggaagcttcctaagacccttaccagaagcagatgctgaccttatgcttcttgtacagcctgcagaattgtgaaccaaataaacctcttttctttataaattacccagccccagatattcctttatagcaatatacaaatggtcaaagacaagtggattcatttctgggttctcttttctgttccttggtctatgtgtctgtttttaataccagtgccacactattttggttattataactttgcagtatatttgaaaataggttgtatgaggccttcagctttgttccttttgctcaggattgctttggctgttcagactcttctgtggttatacatgaattttaggattttttttctatttttgtgaggattgtcattagtatttttgtagagattacactgaatctatagatcacttttggtactatgattgtttttaacatattcttctaaagcatgaacatggatatatttatttttttgtgtgtcctcttcaatttcttttatcagtgttttatagtttttctctaaaagtctttcacttctttagttaaattcatttttttttcttgtttgtcttgtttgttgttcctgtatattgatgctacagaattttgcatgttgattttgtatcctgcagtttggctgaaattgtttatcagttctaagagtttcttgatagagctctttggtaggtttttctatatgtaagattgtgtcatctgcaaatagggacaatttgacttcttccttgccaatttggatgccctttatttctcttgcctaattgctctggctaggacttagtaggattcagtaaggtgaataggagtggtgagaatgggcatccttgtcttgttccaattcttagaggaaaagctttcagttttccccattcagtatgatgttagctatgggtttgacataagacctttattatgttgaggtatgttccttttatacccagtttgttgagaatttttatcacaaaggatgttgaattttatcaactgcattttgtgtatctattgagataatcacataagttttgtccctcattctgttgatataatgtatctgatttattgatttgcatatgttgaattatccttatattcctgggataaattccacttgatcatggtaatgagtgttgtaatgtgctgttggattttctgtttgctagtattttgttgaggatttttgcatcactctttatcagggatattggcctatagttttctttttctgttgtataagtttttttgttgttgctgtattcttgtctagtttttgtatcatggtagtgctagcctcatagatgagttttgaagaattccctcctcttcaattttctggaagagtttgagaagaactggtattagatcttctttgaatgtttggtataattcagctgtgaagccatcaggtcctaagcttttctttgatgggagactttttattactaattccatcttgttactcataattggtctatttctaggaggtaggacactgcttcaataggcactgggaagacatgactgcagttggtggccaatgtactgtttttcgaagagactgtgtaccttttcagctcagacacagaggggtatgactgcttttgttggtcaaagccccatttacctgggatgtcttgtgttgcttcagttctggtccagagaggcatggtgtagcaaagactgggagaggtttttataacagctttttcagggcatcattttccttagaggcagtgtgcagcttcggctcagtcccctaggagcaggtgcaaccatgactgagggatggaacggttctgccagaacaccgtttctccaggaatgagtgtgtagcttcagctctagctgtgagtgggggctaggaggagtgcatgaaacagctccactactgcttgagcccacaggaaatggtacaagaggtggtcacaggtaggcttggggatgtcagggcattggacaggggtggtttggcagcagcttagcctcagaaatgaagggatattgtgggtactcacctccaagcaacactccaacattagttccagtttgcagatggcattgtgcagtagccacgtaggccccagggtgcaagacatagtgtcagctccttctctgtgggatgacagctatgcggactacaggcagctccctcagctgggcttaagtacaccgatcaacactttgaacaactatagtcctcactccagtaggactcactactggagtgaggactatagttttgcttgccttttgctagcctttccccacggggagagttcctcctaattcccatctgatccctgctggggaatgggcgggtggagaccaggtgtttccttcagttctctgtacggctatcctgaattcctgtgttcacctgagtttctgttacttctttgatgtactccagcgctctcctttagtcattttcattatgatgtagttatttattagttgtttaggctgtttttgtggtgggggcgtgggatgcttgggcatatggagtgctaggggcttcttaagcacagattctttaaacgttttttcatctaaaactgagacttaaacagacaagttaccttttatcatcttcctttgttgttgggtagaacttttttcatgcgtcttttcagagggaatatagcttttgaaggtttctgctttcaggtagtgatttttgttccaactctccaacatgctgggatgaaggactggcctctttttgtcctactgttaaagtctgggtccctattattagcaaataccctcrgggcagccatagtgtcagttcaagactattacacaaattttcagcaatccccccaactttttaccccctcacattcttaaggccctataaattttccttattctgagaaacccrcctagacatgtaaaggatgcttgtttaattttaaataccattttaggtgttttttagatagagaattctttataatagctcaatttcttcacttattcacttattcttaagttttatatttagccatatataattcttaatttttaatcctctttgaagtagttgccttcccttttcatattctttttttctgtgatgctacctaatattgcctgtatctcaygggtcatttctattctgttaatcaaggaaataatttagaattctctcagtatggaagaagatcatgttggagaattaagatttctgccccaaagatattttataaaaataaaattgaatttttggtgttttattaattgtatacaaagatagtaaagaatttgttagtgttttaattttacatattttctgacacttcaaaaatttaaatgtttttatggtacttacaattgaattttggctgtatacacttaagttgtaatatagattttgaagaagctaaacttagaatttactaaatttaaaaatccaattttcattaatatttatgtttatcaagaaatgaaaacagagttttctaaatgccacatgttttgctttatccataattcatcgacttggagacaaaataatattttcacttattagtatgagcaatcaattacatcagctaccaactgaaggagatctcacattaaacattcatggctggtcgtttttctggttagaagttcatatctaacagagttcatggaatatattactcattacatccctataattggatcatcttgttttcataatattatgacaaagaagcaactytaacagcagggctacagggtatactcacattacattcactgtttcttaaaaggtttatagtctgttaaagtaaggcagaattgtggcattttaagtttgttgttttcagttctggtaatttcaaacattgcatgataataagatctttgtgaaataaaattatgtaggggtatggaggatcactgtgaaaacattctcaagattcatgtttctgtactgtcaggagaaatctctaatacaatctgtattaagattttattggtacttggttcatttggatgtctcaacgactgactctttatgctgaattcatttaattacatcaagattttggtgcatattataataaccattctttttactaataaaggctgtattaatcctcatgatataagctattttttaggcctatccaatctgccatcctctgctcttacccatttctctccccacatcttatctaccattccttgaactttttactgtttttcttttatacaacctatatttactatttacatgtctttccttttttcttccagccttgaatattcttcttcccactccccttgctagttgaaattatacttgtctcttaaggatcaattcaaacgctgcttccttcattaagtcttctctatggagtcaacctgcctgaaatttagttagctacctagctagataacccatggccagatactcaacttctccgtgccttggttgcatcatctgcggaatggagatcatagtgtataccttatggaattgttggtacagtcggtgcattaatatggaaagcaattagcacagtgcctaggaaactgcaaatgttaaatatttgctcatatggaagtgagaattaattactgcctcttgatatcctattagtactttctctttttttgttgttgtttttacttttttttttttttttatttcttagagacatggtctcactctgtcacccaggctgaagtgcagtggctcaatcatagctcattgcagcctctaactattgagtgcaagcaatcctcccaccttatcttcccaattagctaggactacaggtgcatgccatcataccwggctaattttttagttttgtgtagagacggaggtcacactgtgttgcctaggctggaccttttgtaatttctctctctttttttttttttttgagacagagtcttgctctgttgcccaggctagagtgcagtgccgcgatctcagctcactgcaagcgccgcctcccggtttgacgccwttctcctgcctcagcctccsgagtagctgggactacaggcgcccgccaccacgccyggctaatttttttgtatttttagtagagacggggtttcaccatgttagccaggatggtctcgatctcctgacctcatgatctgccccccttggcctcccaaagtactgggattacaggcatgacccaccgcgcccagcctgtaatttcttatactttgtattttgtacttgtattatgcttctgatacgctataattatttatgtacatgttttttttcttcaatagactgtgaactcttcgaatgtaggactcctagagctagatactcaattattttttattaaattgaatgacttgaaactacagatcctttatttaaacttcccaaatttctgctttatctaggcaactctttaaattcttttatctcatgtagatttcaaaggctgaaataattgagattttttagtttgaagaaaagagaactgaggatttaatgtacattattattatatttttaatggactgtttgggagtaagttgcagacattgttcactttcactcctaaatacttaaatatttcctaaaaacaggacattcttttttttttttttttttttttttttatggagtctggctctgtcgtccaggctggagtgcggtggcacgatcttggcttactgcaagctccccctcccagattcacgctgttctcctgcctcagcctctcgagtagctgggactacaggcgcccgccaccacgcccggctaattttttttgtatttttagtagagatggggtttcaccgtgctagccaggatggtctcaatctcctgacctcgtgatcgcccgccttggcctcccaaagtgttgggattacaggcgtgagccaccatgcctcgccaaaacaggacattcttttacatcgttatagtatagttatcaaacaggatatttaatttagtacacattattatgtaacctatagtctggcagattttggcacatttagttgcattaaggtgaaacagtttacagcctttgtctttcataacatggtcatttttggaatagttcaggccatatttttatagaatgtctctcaatttggatttgtctgatgttccctcatgagtagattccagttatgcattttgggcaggaatatcacagatgcgatgttttatccttttcagtgcagcctatcaggaggcacattatgtcagattgcacacagtgctatttggttaagctttattgaattaataagtaatttgtagagagatactttcagactgtgtaataccttgtttcttttcaaccttgcactcactagtttatattcattggatgcttcttgcctatgatagttacaaaatggtgattttcaagtctgtcatccttctatatttattagttgccactcttctgtaagaaagttttttcttctctttttatttctttatttaccatcagtatcaactcataaatttttattttattaagtgacttataattcaacactattattgttagttttaatgctcaagttatcccaggttgtgagtggcaacctgacttttgaccccttggaaatgcccccaaccattctatggcaacttccttcatttctggcataacaacatattacaggcttatcttatcatttacctgccccagccctagagtcagctgtttctctaaggagtcctgactccctttactagagaagagcatttagaaattaagattagagcagtaagtatgctcattgttaatgaactgttacagcttctaggtcatctcagtagggacctgtatgtatagatctataggaaatagatgtatgcatgcattcatgtacacatacaaacacatatacaactatacacatcaatatctactgatacatctatatcttttatccatctatctatatatatgtatactaaaaatcatgagtttatacagatacatctaattcaaatctaacaatacaggattcttcctgctttttccaaattcagtatctgtttctgccttttccaacagtaaaaataatagcctttaacatcattattgcatttgctcattttgtcagtctctcaatatatggatagtactttcagaattactatacccacatctgtgtgaaaaatatacctactgagttgaattccagatggtttacctttattttcatctttgaagtgaggatgtatagtcaaagttctcatgcagatacttgtgctattctgtacaaaatgaattctatgaagaatgaaaggttttagttagtattaatcatgttacgtaacaaaaagatttggctatgaccatcaatactcagtagtaggatagtcttctacttcactgagaacatccaggcaattgcatactcttttactatttggcctcaaatacccatgtgatttccttctctgtgtgatgaacaaggttaactagtgtttgagcctgaggactccttttgttaagtccagagtcaccctctgtttttgccttgtgaatttttgtcctctgagtataaaagagggttatgktcttttgccttaagacctagaacaaagctggcctaagccacttaatccatgcattatttcactgtggccctctctgttctccagtagttcttaggtaggtggttcctatagtagaggttgctactagcacataataactatataaatcatgtaggagggaagatagtcagaagcatgaccttacataagataaagaagacaaaaagataggtgcttaggtgttgttccagttataatctcttttgttcacatatttgatgtcttagaaatatggccccattaaatgtacctgagaatttagttttgcttttaagctacatgaaagtaccatcttctagggagagtgatatggggagagtgcataaaaaccttaaacattaccacccattcaccctcatcccttgccacctactttagagtacaattgacccttgaataacatgggggttagggtcgctgactccccatgcagttgaaaatctgcatataacttttgactccccaaaaacttaatagcctactgttgactggaagtctcaccaataacctaaacagttgattgacacatattttatatgttatatgtattataataaagtaagcttgagaaaaggtgataaaaatcataaggaagagaaaatatatttactatttattaggtggaaatggctcatcatcaaggtgtacattctcatcatcttcattttaggtaagttaaggatgaggaggaagtggaggggttggtcttgcagtcttgggggtggcagagcatttcaaacctgtgggtcaagtgtatatacttctcagctgcgataaaaggaaaaaatttaatgcaagagttttatcagaaggagatattatagtgtcttctttctagaaggctttaaagctagcagatgacattgcttgggataataatttatgaaatcttagaacaagaattatgaactggtatattctaactctttgtgtagatcactgattgaattgatgtttctaggaagtatgaatttttttaattctagtggcagattatcctcttagtagcaagatattcttatcaacctttatgtgtagttattattgttgactaaagttttaaatgtaaaggcttatccttatgaggatcatttatataaatactctggtttttttcccatttattttctgtaaaatatttggagttgaaaagaatgaactgacccttaacattaggaaaaaatataaaacaaggtagtgatgtataactaataaaaattggcttcaataaaaagtctgtgtgctctagtccctacttctttgttgtatgtttctataaaccaacagcagcaccccttctttcttctcccagcagaagtgatttggggaagcaagggaagagtgtggtcaaggtctttggaaagaggcagatacaaggtgaagaatgaaagggctaaaggcagccttttcccctattattgattcttaactaggttcttaccaactcttgagtgtatggtaaatatgtaggcacattatttattgctattcttgccagaaggcaagggatgctaaaagttcaccaaacaaagaatggtctgatccgcaatgtcagtaatgctctcctttgcagggaatccaaaacacaaaagctttttctaaggccggtaggcaggacatgcagatgctgctttgtcctaaatcattacttttcaaactaggatatctatcagaatcatttggaaggcttgttaaatcagattgcagggccctaccccacagtttctcttacaggtctggggtagagccctagaattgcatttctaagaaatatctctgtgatactgcttctgctgctttggaaaccacaccatgtgaagtattaccctagggaaccaatataatgcatgcactggctacttgatttcactctttgccacccagataacatgaacagtatcaaacctgtccaaatatttctttaaaacttaattctttttctgtttttagcaaagagtaagtcatatataagagcttgtgcatatctctgtgccatttgctaactataagaatgtctattttagaccagttatactgacaaatataagtggaagtgaaagtatcctgataatgtaaataaaaataatggtctcctttaagaaaattttattttttgtaaaatactcatcttgggttcttattatttctactttaccacactagatgagactcaaaactagcacgtttgttttcttaacttttaaaaaattattcaggttgacagtgtaaacagtttgttgttgttgttgtttatattaaataactttagattttaaggctattacattttgaactttttggcatttaaaatactaaaagtggccaggcatggtggctcactcatgtaatcccagcactttgggaagctgaggcgggtggatcacttgaggtcaggagttcaagaccagcctgtccaataaggtaaaaccccgtctcaacctaaaatacaaaaattagctgtgcgtggtggtacgtgcctgtagtcccagctacttgagaggctgaggtgaaagaattgcttgaacctgggaggcggaggttggggtgagtcaagatcatgccactgtattctagcctgggcgacagagtgagactccatctcaagaaaaagaaaaaaaaatactaaaagtgtatcaatagcatgagatcaaagaggtgggttttgttctgttttgttttgttttttcactttctgggaaaaatttttctaacttaaatgtttttcatttctctaagttatatttagctttgaaattcaaaacctgcccatatttgactcagaacrctaccaatttttgagtattttctcttctattaagagtgaaattctcaatacgcattttgttgctttgtcaaaatgttatttaaagtgtttatttaaacttatttttaatctgaaattaaatgcctctaaacaattctatatataaatatgggcacaatttatattaaatggtttaaaatataacaagattgccaagaacatgtttgctatttgcttaataatactctttggatttagtgccaaaatattagtgtatatcagtatagaaattgaaatagatatatattacatacgatatgtattatatattgtatatatgagtgatatatagagcaaaacatgtgttaaatttatttctttttctgggagaaagttagagaagtcagccagagtaataggaaaaataatttaaactggcaaagagatggataaaattttactgggcaaaattgtccattatgacattaaacattccttatattaacatgtttttttaaaatagaatactaattaattatgcttggcaatcaagaggtgttactgttgataggaatattttataataggttttaatgaaaaccataactaatctggtgagtttttaaaaataaaaaagtaatgtaccatataatctttattggtgaggaatgtaacaaggaggtagagaactagtagaaaggtatctttatttttcagtgttaccatcttcttatgaaatattaaaaggtttaattagaaaaaaagacgtaaaatgcacaattttattataattgtatgataataatacacttattatttaaattttaaaaggtttttaaaaatttcacgtgaagtaacacataaaataatttaatcaaatcctcctgaaatgtatctgtaagtacaacatagtttttatcaaaatctgaagactttttgtagctgtagacaagcttattctaaattttatatggaaaaaaaattttgaaaaagagcaacagaatcactctagtgagtgttaagacttactatatagctatagtaattrgagagatagacatacagaacaataaaacagaataataaaacaataaaacagaatagagaagcataaaatgcataaaagcaactcaatggaagaaggatagtcttttcagcaaccattgctctatcaattgaacatccataggcaaaaaaaaaaaaaaaatctctacctaaattgcacacttatattaaagttaacccaaaatagatcatggaattaaatataaaattttaaactataaaactttagaagaaaatatacacaaaatgctttgggacctaagcaaagagtaggcaatgtgttcttatatgtgacaccaagagaatgatccattttgtaaaaattggtaaatgggacttcatcaaaattaaaaacctttgccctgccaaagactattaaaaggatgaccaaacaagctatagactgaaataaaatatttgcaaaccacaaatattcacaaatttgacaaagaacttggatcaagatatataaagagttctcaaatctcaacagttaaacaaataaatagaagtccaattagaaaatgggcaaaagacatgaacagacatttcaccacagagcatataagatggcacatgcatatatgaaaatttcttctattttatcaattaatatcagggaaatgtaaatttaaactataatgagatattactacacacctatcggaatgtctcgaattgaaaagtaacaacactgaggccgggcgtggtggctcacgcctgtaatcccagcactttgagaggccgaggcgggcggatgacctgaggtcaggagttcgataccagcctcaacatggagaaaccctgtctctactaaaaatacaaaattagccgggcatggtggtgcatgcctgtaatcctagctactcgggaggctgaggcaggagaattgcttgaatctgggaggcggaggttgctgtgagccgagattgcgccattgcactccagtctgggcaaccagagcgaaactccgtctcaaaaaaaaaaaaaaaaaaagaaaagtaacaacactgaatgctgacaaggatgcagagaaactggatcacacatacattgctggtaggaatttaaaatggtacagccactctagaaaatattttgtcagtttcttacaaaactgaacatgcaactagcataagactcagtaattgcacttttggggattcattccagaaaaataacaacttatattaacatgaaaatctgcacaagaatgtttatagcaatgttattcttagtggccccctaactggaaataacccaaatatccttcaataggtgagtaattctggtatatatgtgcaatggaatactattcagcagtaacaaagaatggactattaatacttgcaacaagttgaatagatctcaagggcattgtgcttaatgaaaaaaatagtctgaaaaggttacctatactgtatgtttgcctttatataacattatcaaaatgataaagctagaaagattgggaatagattaatatttgacagggatcaagaatggcagtagcaaagtgtcccttgtggagaggggtttgttacacaactttatacatggaatcaagttgcataaaaggatacatatactgacaagtgcatgcatgtaaaaactggtgagaactcaggtgtgtagttaacagtattgcactaataatgatttcctagttttgctattgtactaaaattatttaagatgtcaccattggggaagctgggtgaggggttcatgggagtctcatactattattgcaacttcctgtgagtctaaaattgtttcaaaataaaaaaattaaaaataatttaagcagaaatatttggaaaaatcagggaaattaagaatattgaaatacttctcagctcaccttttttcaaacagaagaattggggagatggattgtaaatcaaatgatagtttaatacaaggcaagagctgcaaagacatctgaatatattttctttgtaattaatagtaatgcagtactagtatacacagataaacattgactttcacctttgacagacagtcagacttcacaggttgctattcctaagctcacagagaaatggagaaagtcaaattgatgtagcataatttgagtttctttatcaacattgcttcaaaacagtgattaatatagtctaggagtagctcaataattaagcctggctgatagtttatcctaggctccctgaaaacttcaagacatcttgaggatgttatggtgttatagatgttatgttcatggagaaggagaagtaggggaaattctttcatactgaaagcttaatagtatccaatttcaattatacatctccattcaaaataactgaaaactgaaactaagtatcttattttgagtgtaaaaaatgactgagtgaatgagatcattttgaactttaaatttagcttagatatgtgaaaggcacagttgtataacatactattacctaaatcccgtgggactactttgctgtaagcaaggcctgaaagagtagcaagattaaattcaagttttatactttagagtcctcaacaaaaataagcacatgccctgtatctaacatagagacagcagttctttagctaggacagctttggtaaaatgggctcacagctttagtgcctcattgccacataatgtatggcttactgggtttctctctctctttttctgtttgtgagccrtgaaaccagattgtcttcttaggaaaatacaatgccttttttaaaactgtactaactgtagcatgtgattaaaagagaaaggttaaaagtcttttttcttcttggaattagatttgctgtaattcttctcattattatgttatgctttgttctcctctgtagggttagacttcaagaaccctatttatagaccatgtttttaagtactttacaaacagagaccataatgactgattatcaataaaggttttaatggccaatatcaagggtgtattatatacaatcttctagaagtattgctttttaaaacaaaatgcaattatttgatgcgaggaaacatctatgtgatcatacaaatttatctgaggtttattttatttaggtcatatgtagggtataaaaattgtctgggtttttttgtgtctataggaaatgaatgaattgaatgtttattgaataatcaaggagatttgggtttggttttgacttcactaagttgtttgtcatagcactaggcaagtttgaaaattaccatggtttattttagaaatattatgagtttactagtaagaaacttcaaattatccattcaaaggtatacttaagtattaataatactatttttaagtattaatatgtttcagagatcattttgcttcaaaggctaaaacaggatttatgtgaataatgaaatactggtttctgaaaacctttaccagccaagggttcaattctctcgtcaattagtattgaaatgtagttgtgtggggccattttaatttagcaagacttcctggtgaatttttctggagcacttcccagttccactatatttctagcagcatctgcattatcttagggtagaaatatgtacccatttcaagataagacttttcctaagcactttatatttttttctttatgagtttttccattgatcacaaatcctggataccataataaaaggctgtgatgttttagaatgaggcagctttacatgaaaatttgtaaatatttgacataaattattaatgggtaaatttttagcaagaaaccactttaagtagaacaaaacttactgttgagagtcatccagaagcaatgagggacaggaaaaaataatgttttctctgaaacaaagatagttgcaataaagcatttagttccagctttcagcatgatttctaataaagataaaagaatgaacaatggaaaacattcacagagttatttgtagttatatataaattatatatacagttggatgtattcatgaaccaccctaggattaaaaatatttgaaaaaaatttgcatctgtactgtacatgtacagactttyttcttgtcatgatgccctaaacaacacagtagaacagctatttacatagcatttacattgtattaggtattacaaataatctagagatgacagtatatgggaggatgtgcatagattatgtacaaatattatgccatttgtatcagggacttgagcattcgtagattttagtatctgtgggaggtcatagaatcaatccttcactgatactaagggatgactgtagtttatacataaactatacatacctgctgtgaaagccctgaagttgatttctgtttatagttaatgcaaaactagctctttattaattccattttgtacatctgcaaaaaggcattttcttgaataatttatctcttggattacctttccagacttcttttaaatatctcacggtaagtaatattgtttttaagcttaaaaatcctcgacgttgctaaactttcaagattttttttttttaatcttaaatgcttataggagttggagggaaaactaatgatgtagatccctgtttttctgctaatgggaattaattagtactattcattacgattgaaattggcattctctgtgctattccagacagttatgataaaaatcagctcaactatacaaggaactattttattccatgctttgaaccagctcctcttagcacccaagcccattcattatttttatctaattaggccaacttacattggagagatacctgaagcaaggaaatttccttaatagctatgcaataacaatagctcacaggcacttaaacaatacagttgtctaagattgaatcatcagaagaaggggaaaaaaagttatccttaaccatagggtaaaaatgtagtcataaatagacaaccatcattatttaaatggcataaatatacaatattagttatcaatagtataatgtttatagatgtgaattttgtatgcttatttgtggaaaattgttaaatttatttttatgttgaaatttgtagtcacatttgaaagttgactgtattctgtacacaaaaatgcaaacatgcttcctaggaaaaaatagaaattttgcatatgattacacagcaaatattttctaaaactagggcaaagtcttaattcccaggacaactccttatcttaaaaacaaattattttatatgacacttttactctcacttgtctgttgaaatgagaaaataaaagtatttttgtggcagtgtgcacatctaataaacaagacattaaaatgtttggaggggctggaaatagggtcacggcctacccctttttaacaacttcattgactaaatacttccatgtcctagggaaataattcacattttgatatttttcagcaaaacaagaaaaggagagaaaacttagctgtaaaaggcaatattacagaaaatgacttagaaagttgctttctgactgggtgcagtgattcattcctgtaatcccagcactttgggaggctgagacaggaggatcacttgtgtccaggagttcaagaccagcctgagcaacatagtgagacctcatttctccaaaaaaaaaaaaaaaaaaaaaaaaaaaaaaaaaaaaaaaaaaattagctggtgtggtattgcgcacctgtagttcctgctactagggaggctgagcagaaggattgcttgagcctgggaggttgaagctgcagtgggccatgatcacaccactgcacacagcctgggtaacagtgagaccctgtcaaggtaggaaggtagaaaggtaggaaggaaggagagagggcaacagagtgagaccctgtctaggaaggaaagaaggaagggagggagagaggtagggaggtaaggagggaagggagggagctctaggtgactctcaggcttaagagccagaggaataaattccctgacctatatcccctttactatctgatctcctgctgtggcttctttgagatagaggaaaaaccaaagtgtttttcatactctaactcaacacattacttctgatactgaatgcatgaagggatttccccacacataagaaattcctccaattcaattctgacatcatctgcctggagatagtgttagatctcacatgttaaggattcagttccacaaaactgccccccacttcagatgccaatcaccaggctaggttgtgacatgtacccatgtcacatggtgtatcacatggagagtttttaagcttaaaaacaatattacttactgtgagatatttaaaagaagtctggaaaggtaatccaagagataaattattcaagaaaatgcctttttgcagatgtacaaaatggaattaataaagagctagttttgcattaactataaacagaaatcaacttcagggctttcacagcaggtatgtatagtttatgtataaactacagtcatctctcatggtgtatcaccatgtgatatgggtacatggttcccaccactggccatggttcccatgacaccctcctaaggttcaactaattttcaaaaatagctcacagaattcagggaaacacttgaattacatttactggtttattaataaaagatgtaataaaggatacagatgaacaacagatgaagaaatacacagggcaaggtctgaaaaggtcctgagcacaggagtttctgtccctgtggagttgaggtgtgccacccttctggcacatggctgtgttcaccagtgcagaagttctcagaaccccctgcttcagggatttttatggagggtttaaccacataaacatgattgattattaattcaatttccatcccctctcccctctccagagaatgggagctgagtctgaagttctcagattataatcatgtcttggtctttctggtgactaccccttgttcagaagtccacccaagagttgcctcattagaacgcaagacactcctatcaccttgaaaatcccaaggaatttaggaaatttgtgtcaggcactggtagcagagacctatgcacatacacacacacacacacacacacacacacacgtatatacatatatacgcatacatatatgtatatatatgtgtgtgtgtgtgtgtatatatatatatatatataatatgtcttattatttcaccgattttcactgaccaaaaccatccatatgccagatggcaaggaagccagttgagtagccaaygcagatcaaccttcaaagcagagagcaggttaaattgaaggggcaaatactctgcagatatctgacagagtaattgtggaaattcagagccaggagagacattagagatcacctaaaatcagaaaatttgaggtacctcgtgagagtaagttacatgcattgtgtaatttacagttaagacacactgtccgtcaatcagcagagttgagaactctagatctacatgcattatagttcataattatgtcacagtcaccacttacagcatctatgcaaatcgcttgttgtgtgtgaagttacactgatcagcattgctattgcctacaaaattaataaaatttgaaatttattaacctaagggactggagtttggccatattagaggaaatgttttggaagagtagtttgtcccacataacttatttcagttcgtactataattctctgaaaattactttcagtgaccatacctgttatagaaaattgctgtttaaggtgattatcttagacagggggaagaattataataaccctttattggagtcattgcttatgaggcttaaaatttgattaattcatttgattaaaaggagcatataaaactttaatatattaagaatttcccattctcaaaatgaattctacctattgttgttggaatatgtttccttttaacattttcctaccttattgttttcactaatctgttaataccatctggccaattatatcaagtaattttacacttgttgaatgttcctgtgggtggagactatgaagcatctcttcaaactctgttcacattctggaaatcattggtcaaaacactcactctgaaatcaaagattttacttgtgaacagcaaattttgtatatttctcacacaaatgttatttttgcattctggggtctcttcatcctttctcatatagcttgtgttatataggttcttgctaagatattttatatctctgtatcaaaaagtagaaatcatcaatgtcagctgagcttttctgctacaattgtgattattatatttaattgtaaatgctgcattgtacccaacctatttcacaaggagatatattcccttgattctatattaaaaagaagccattgttaggtttgaatgcctatagaatatgaaggttatagtcaaaaaaagactatttcaatataaatgaaccatttcctcctttttaaaaagcagtaaactaattagccaaaatatgttgtagctttacaaatgcttttactaggcctttagacatgttcctactatactatctttttattatacagtgagatagaacttgccatttaatgtcaaaccatcaaagaattcagctacttcacatggttatagtgtttgcttttaaaacaattaattttaagaatttgaaacataatacaagtacccctaatataaccgctgatttttaatggttccataatacctcaccaaacagatttaatatattttgctgaactaactgcagttgaatataaagttgccctcaacttatcattatcgcagataacactacagtgaaaacatcctacacatagctttttctatacttttggttattccccgtgatacagctttttgaatatttatccccacccaaatctcatgttgaattgtaatccccagtgctggaggtggggcctggtgggaggcgtttgggtcataggggcagatccctcatgtcttggtgctgtcttcacactagtgagttctcacgagatatggtggtttaaaagtgtgtagcacctctcccgtcactcgctctctcttgctcccattcttgtcatgtaatatgcctgcttcccctttgccttctgccataaatggaagcttcctgaggcttccccagaggcagatgctgctgtgcttcctgtacagcctgcagaactgcaagccaattaaatctcttttcttataaattacccattctcaggtatttctttatagtagtgcaagaatggcctcatacactctgaaagggcgataatagggttaaaggatgtgaaatttttgctactaatattacatattgctaaactgatttccagtagggcttaactagtttattttaccatcagcaatgttaaagaacctctgcttcattccaccttcagtgacattaattcgttcaattttttataagttttacaggctgatagggaaaactcattgttttattttgtattattttatcatcacaaggttagatatttgcaggtatttggtttaatatctgacatcattttttgtcaatttgaatgaattctttaacaaaatgaatatattaatctttatttgctgaaggtatttctgcagaatataatttgcttttttaatttcagttaccaacatgttcttaaagctgagacatttcacaggttttgtgttttagttccactttgtatacaactgtagcagaagtaggcagtttctgttagttcttaagagtatgacagtctcaggttaaacaacatagagcctgagctctatgagtcagctagtaatggtacaatcagaaatctcagaatttgtttagaaaagtctttttaaaatgtcagcctctctacattgtgctaacggaattcccaagaatatttattattattattattattaaaagaataacctacatctaggaggcagcatgaaggtggtgatgatagttcaagtgaacccagtttgagagatgaagctcaagggactaagaggaggctgttggtccatttgtctcttactcctggagggttaaatgttagttgtgtttagtttcaacaaaggagatgcccttaccaactggatcctccttaaacagactgagctacttgagggcatcaactgttcatgtttgtaacttttatgcctagctgagtcaccagcaaaaagaaggcagaratttaatgaatactgaaatgaaataatgaatgaattgtagggaaaaatagtatgggaggtaactggagttataaactataatattgaatgtgaccaccatgagtcatcaaaggaggaaaataatttaaaatttttaattatccctaagatctgatttttacaaatttttaccaaaattagaatatctgtaaatatccatgtggacttaaacaaaaaattgacttttttgattaatataatacaatgatactcattttttaatggaatagctagtgaaatacaatacagtaccttagttcctcaaagccaatgtttcaagataattcagtcttatataattgtgacctaaagcaataaaacattggtagttatttcgcagtcctctttagtaggctggctcactggatctgagaaacagtgcaaagacaggaaacctatgtgttctctaccttcgcaatgtttagaagaccagtccaaaaaactgtgccttatgcagcttagtaatttggtcagttaatgacatgaacatttggctaagatttgagaaaaaaaaaataggcaaaaaaaaaamcaaaaaagagagaattcaagtataaaatacagtgaattccaagttagtaagggctgcctcaaggacaagagagaaagccctctaatattaaactgtgggagaatctgcttcagccgcagggtttttctatttggaagcctgtgggagcaggtaacttcaataatctatattgttttggaatagatgccttttataacttttctttttaagaaaacatgcttaaaagcataattttttttctcttaatcctctcttttctgagactttgatcttaccagctagattttaccaactgcattgcattttaaaaatataatttatctgtttgttaagggattactaagttggaaagactgaggcagtagatgctgtgaaaggccagaaaggagggggattgatccttggttgggaaatggtccaagcaggtcaaccaggtcttgaatttggccttgaatcaaagtaaaccttagattaaaaaggaagaagaatgtaaagtatcttagtgagagggagcagcataaatgaaaatggactagagagaattaatgtggaaagggaatttcaagtgaatgtcagaaaaatagtttatgaagtaatgccagctattgatggattggtatagttgagaacagctcactgagaagctttaatgttaaaatctatttttttaaataattaaagccaaattttacagtgtttaagtgggaggtgttatggggcattgttttcttttgatatcaaaaccattttccatgatctcagaactcctggacaaagaacctctaataattttgtatatctcattatccttttttaattttttttttttttttttttttttgagatggagtcttgctctgtcactcaggctggaatgcagtggtgtagtctcggctcactggaaccccagcctcccgggttcaagtaattctgctgcttcagcctcccaagtagctgggattataggagcccgccaccatatctggctaatttttgtatttttagtaaatatgaagtttcaccatattggccaggctggtctcgaactcctgacctcaagtgatccagccgcctcagcctcccaaagtgccaggattataggcttcagccaccactcggactcaatatgcttttaaatgtaattttctaaaaacagcttttggagagaacagaggcatcaatactgttacagtctattagttatctggccctatggacattagtaagtaacattctagagtatgagtgtcagagaccagtggtttgtctattaaaatagtagaattatcttacttgataattcttgagaaggctgtgactcagtttactaaatttactatatttattaaatataaagcaatgtttggctccttgattctgcacacctttatttgactctgcctgttttctttcacataaggactacagcattttttactgactcctccttgaccatcatttttttcataatataataaaaacctggcatttccgtgaagttgacttactggcttgtattgctatttacttctgggatgtagtaatatagggatatactatggaaagaaacttaacaaaaaacagagaaaattatctgtagttgtcaagggctcattaacctttctgtgccttaaatcgaagccacatttttgtgtctgtgtagcttgtcatcctcaataaaatctgcttgaatttgaaaattctatttctagagctgctttttatttgctcattactgacatccctcatttactcttctcagggagggactggatattggtgggtctccccacctcaactctcccgaagggagaaaattccctaggtgttttgagtgacacagcaacacattctttggctttgttgtcaaattggaagtgtgtgaatcctcagtccctcaggccagatttcaagtgttttcccaaaggaacttctcatatggaaaatagtcagtcttcctttgcataatttttatacctaataaatgattcagattggggctgtcagccgtatggtgggcaccctaactgaaggaggcatatgagtggcagattataataataggttatatattttggtcatcagcctgaaatcctaaatgaatatattctaactcatttagtttctccccaaagctttgtaaggatattcttagcatttaattatatcaaacaaaactatagtttatttggagtcagttatttgttctgggttaattaacacatctgatttaaaagtgataaacacttaaaataaatggaaaatgattcctgggtagataggtctaagtggatgcagttttgtacctgacctggttcatgtgtctgacctattactacttcaaggaatgtagtagcaggtgttgatatttttccaaacggcagattggtcatgtttggtgggatatgcttagtgcagtgtgaaattgacatttcagagctccaggttgctatttacagtgactggtttctattgatgaactttttgcttcttttatttacagacccacataagcttttaaaagttgattctcagttttaaattgattcatgcttttctttcagataaggtagtttgaatttccctgaatagttttattcttgagtataatatcttttgggggatggtgttcatttcactctttcctacatgtttctgaataaaataaatttagattttgaaaggtcagttagtccagctgctttcaatttgaagagacttaattctccccagacaagcacaatgtatctcacttaaaaaatatattttagagataagtagcttaagaataactgtacctattgaatacctagcatgatatctccctcatttacctaataaacaagacacacattaggaaccaacatcaaaatgtttttgtaccatatgaaagctgtcacagtttctctttttattgtaaatggctcatcaacttggaaatttcacataagtagatcagaatttaagagtgcagaggatattagtatcctcctagaaatttgtctgttatgaacccctttattatttcatatttccaccatgaaagatatctctataaggatgaagcaaagcagaaataagtaaaaaggcaaaggaaataactatacttaaggatatgagttaagcatttttcttctcagcctttatatatgtctgtctttaacatttacaaagtgtttagtgtgtggaaaacattatcttaatattractcctagagcacacattaacaacccaatgatatatgaactgctgtcatcccattgcacaggtaaagaactgaagtatagagaaattaggttatttgcacaaggtcccacaactagtaaaatgcagagttgatttaaaagcatagcctctggatccagactgtcttaaccaccatttacactatgctgcccttatgtgtccacaagcaacagtttacataccattttttaatgttttactatatcatgtatcttattttagtaccaaaggagtaattataaacataacacagttattctggtatttttagaaatctaaactattatgtctgaggtatacagagttatgttacattaaagtttggaatcaaatttgtactcttttgagttttctgaacacgtttctctcatcaaaccattccaaggtttttatgttgcttttacattgaatcaaaaaatacatgtttagtaataatttgatttttccccagaggtagttgtaacccatcaatttgaagggtcacttctaaagtcaccttagaattattattggtcacaaaaaaaaaagtttagtttcagaatcattgtttggatttgtttgtattctttcttatacatatttcctaacatttcagtagttaatctttttctttagcagtgataaaaattaaagaggggtggctataattaaaaaaataggacagaaagtcacatcaaaagtttaacagtgtacctctaaattacacgtataatatcaactgatcacctaataatgtatttagttatatatatgctttatattagcaaaaaagtgaacaagttttatagaaaaaatatttatcagaaattaaatgatttgtgatgtattttatgttgttatatatccaactcagatatactaagagtagtcttatataaatgctaatttatactacatctctccagttgcccatacttattttaaactctgtaagaatttgttcgtttatgagtggctgcaacagatttagagaaagatgtgggataattactcctctcaggctgccataacaaaagaccacagactgggtggttttaacaatagaaattaagtttttcacatttctggaagctagaagtccatgatcagggtgccagcagggatgctttctggcgaggcttctcttggcttgcagatggccaccatattgctgtgtcctcacacagcttttcctctgtgtgcacacactccttatgtctctttctcttataaggacaccagtcctgtcaaattaaggccccacacttatgacctcatgtaaccctaattacctccgtaaaggtcctgtcttcaaatatagtcatgttggaggttaggcttttaacataatttttgggggacacattcagttcctaacaattagcatcagtgattgtgggtaatctgccaggttctgctgatcatattcttttattttttatgttcaacaaactagcattgtgcaacaaataaagacatttttctttaacttacctcacttagagaaaacttcgaggtgttttgtattcactttatatctttaagtttaggcaaagtactagtatgatggctttcaaaattttttttaccttgatctgcatatagatatagatttttcattacaactcaattcacatgcacccacaatcacacatgcacatgtactgtataacagaaaaaagagtttatattatgaatcttaccctcttaaaagcattgcaccttggtatttttctcatattctgttctcatttatttttaaatttaataaatttaatcccattaatttaattaataatagtcatgacccactaaattgactcatgagttaacaccaaaaatttgaaaaactgcttgctaggtaaaactcatttgatcagtattgtctcaaggtagcaatgttgctgtatgtgcattcctaataactcccctagaatttaacatttaaacatatttttagcacagagttttgctgtttgttgttgaccactctcaagcactcaatgactggaagaaaactctctagaaagtgtaacccttcatttagaggtgcaccagtttctttcaaatcttgaaacagcgcaactaagagatctaggagattgctacattgttgaggttgggctccttgaaagccaatttcccatgaaaatcaggtgcatatgcacagtgatataagctattcaacaagtatctgaatgtatttgtcatcaatgatctttgtccctgatatggcctggctctgtgtccccacccaaatctcatcttgaattgtaatccaaactgtaatccccacatgttgcgggagggaccttgtgggaggtgattagatcatggggctggttcccccatgctgttctcatgatagtgaatgagttctcatgagatctgatggttttataaggggctttccctgcttcactctgcacttgtctctcctgccaccatgtgaagaaagacgtgtttgcttccccttccgccaggattgtaagtttcctgaggcctccccagccatgcggaactgtgagtcaattaaacctctttactttataaattacccagccttggacagttctttgtagcagcgtgagaacagattaatacagtcccttttacattaattggagatactctagcattcagggtcctttcagaaaataggaaccattctaaatacttcaaacagggataatttaatacgggatattaaatgatataggtgatgaaagctctagaagccaaaccaggaatggtgactcatcccagagaatggtaacagcaggaagctgctggctggaggcagtgttactgaaacccaggagctgaggtcatgtggcaaaagctggaaccacagagaggactgtctagataagctttagtcacaaatgagatggagctgctgctggagacactatgggaaacaaagagaagagagaagaaagaatgtgacttctcccttgctcctaccttccatccttttactaatagccttcattggtcaaaactactggaagcccagagaccaggggaaacagaaaaatgtagttccccgctatatagaatagaaccagggagaggcagggattggatctaagaccaactaatctaagcaaatgattggcatagatacttagagtcatctggttttttttcttatttaattaattctgtttttgtcataatacccacgtaaaaattcacccttgtaaattacactcatgttcatagatcataggatatgagttttaggcttttagaatatgcctttctctctcatgttttcattgaatatatgtgccttaatttatctgtttccttctaatggaacattgaggttgcatttgacattttgctgttataaattactctgacgttgactatattcatggaaagatagtttctcctatactgttttattattttaaaagttatactcagaagatggattagtgtcccaaaagcatgaataggtttttgactcttttttttttttttttttttttttttttaccagattgcttttctatagcatttttccagtgttccagtatataagtatgataagttagaagaaaagctttggacaattgaattgccagagtttaactgagcaaagaatgattcatgaattgagtcgcccccagaacagaatatgttgagagtgattcctggctgtcacatggtcagttaagcttatggatggacagaaaaaagaaggtgatgtgcagaaaatggaagtgaggaacagaaacagctagattggttacagctgggtgtttgctttatttgaatagsgtttgaacagttgaccgcmtgtgattggctgaaactcggatgcaatgattggctgagacttggctacttgttataagagtaagttacagtctatttatacatccagttaggttacagttcaytatgtatggagaaacctttaggtcaaacataaaatatgtraggagtaaacttaaggttaaacttaatttaaacaaccaattttactgacttttatctacattagaatcgtttcattaaaaaaatcttgttgcttcatttagttggtgagttatggtaactggttttcaatggttggttctatgattattaggatattgagtatatttttcacaaatttattgacaagtggcacattttcttttgtaaatagcttatttacatttttgcatattcttctaacaagtttgctaagactgtggatctaagaagacagaaaaccgtttaacatggactctcatattgaaaaaaacaaaaactataagcctgtgtctctccttcagccctgtagcctgggtggtggactagaatgaactatattgaaagatccctgaagtccatttcctaaaccagcctgactggttcccttacaattcacaataatagcttcctttgtctttttcttctctgtgcccttagaactggggtttggggttagggagggtcagtctttcaaaaaacaagcacttaatttctcgaagtgtcatcttgagaaaatgatgtttttttttcatgaaagaattctagttttttgcctttttcttttaacttaaaaacattttgttccacaaataaaaatattttgagaagaaatagtgtaaaaaaaaaatttttttttttttttgagacggagtctctccctgtctcccagggtggagtgcagtggcgcgatctcggctcactgcaagctccacctgccgggttcccgccattctcctgctcagagtagctgggactacaggcgcccaccaccacgcccggctaattttttttgtattttttagtagagacggggtttcaccatgttggccaggatggtctcgatctcctgacctcgtgatccgcccgcctcagcctcccaaagtgctaggcttacaggcgtaagtcatcgcgcccggccaataatttttatattcttaaatctgtgcctatgtgtttttatacatagtatgaattactgctttgttgttttgaaaattagttcttagcagtctataggtttaaaaattttcctttagaatttgaaaggaccttagagataatcaggcctattgttttattttcttacatattcactaacacaggagactatcttagttttgtaagaaaaataaaacatcttttatatatttgaggtttgcaacaataaaaagcttaatttagctcctttaaatgctttaatttccttcctttgaaatcattagactgcatactttaagttaaactcacaataattatttaattagcattcaatatatataatatagttgggtaaaatatgctgatttttacttaaatgttaacgtggttaatttaagatttatttcctacttctagctgtcataaggtgttatttatgatttattcttcccttgggaaaattattcaggatttatattattctcatataatctattctataaaacaagtatggaacaaaaaataaaagtatgatttttataggatagattatgtgaaaataatataagaataagagatataagctattcaacaagtgacataagctattcactattttatagaatatagaatatattattctcatataaaccattcaataaaacaagtatagaacaaagaatcaaagtatgaaactacatttattttctaaaatgttttaatttaaatgagaaaattattttacatttagtaaaaacatacaaaaatttatactgactaataatccacttacaaatttcattaaataatattttattttcaatcatttctatttaattagagaaaataggaagttatttttaaaaatatactatacacgcgcgcacacacacacacacacacacacacacacacacaccacttttcctttcctgccaagaggataaagccatcataaggctaggtctgcagaggggcagtcttcatgaaccagtgacagtttgctgataaaggaagcagctagtaaaccatggataaaattaacctacccatggtaaccacattttatggatctacagctggaagatgtggtttatgatcaactgaagcttcatcttttactatttccctgtcctccccaggtttttattccaagtttctatttttagattattgaatgtctcatgatttccttcctctgcacctttgcaattgctgttttctcttcctagaatctccagaatttgtatcaattttgcaagcaaaatttgtaataatagctttcctggctggtatagtttataatagattatttaatttgtttatttgttttttggtattccacattttttacccctgattttttgtgtatatgttacctttacaatcagaatacagattttattttatttatttttgagacaaggcctcactctgtcacccaggctggaatgcaatggcacatttatagctcactgcagcctcaatctcctgggctgaagtgatcctctcacctcagcctcctgagtaggtgggactacaggcccaccaccatgcctgcctaatttttaaaaaaattttgaatagagatacaatattgttacgttttgcaggctggtctcccaattcctgagtttaagcaatcctcccacctcagcctcccaaaatgctaggattacaggtgtgaaccaccacacccggcccagattttatttgtttgcttatacacatcatctatatcctaacatgatttgacagattggcagaagaaaaagcttgctttgaaagtccgttttgacttaaccacatagcggcaaactgaattaaatatgaaactcagatcttaaaagttcagcacgtttatagctgctcattctgttttatttcttatgtttttcttttacttagcgtttagactgagcgtcttctattttagcatttccccgcgtagcacctttctgagaattacttgcttaacaaaaattaactgtctgttccttatacttttttttttccttttttttttattattatactttaagttctgggatacatgtgcagaacatgcaggtttgttaaataagtatacatgtgccatggtggtttgctgcacccatcaatccgtcacctacattaggtatttctcctaatgctatccctcctctattcccccaaactctaacaggccctggagtatgatattcccctccctgtgtccatgtgttctcattattcaactcccacttatgagtgagaatatgcagtgtttggttttctgtccctgtgttagtttgctgagaatgatggtttccagcttcatccatgtccctgcaaaggacatgaactcatccttttttatggctgcatagtattccatggtgtatatgtgccacattttctttatccagtctatcattgatggccatttgggttggttccaagtctgtggtattgtgaacagtgctgcaataaactatgtgtgtatgtgtctttacagcagaatgatttataatcctaagggtatatacccaataatgggattgctgggtcaaatggtatttctggttctgtatccttgaggaatcgccacactgtcttccacaatggttgaactaatttatactcccatcaatagtgtaaaagcattcctatttctccatatcctctccagcacctgttgtttcctgactttttaatgatcgccattctaactgccatgagatggtatctcattgtggttttgatttgaatttctctaacgaacagtgatgatgagttttttttccatatgtttgttggccacataaatgtcttcttttgagaactgtccgtgcatatacttcgccaactttttgatgaggttttttttttcttgcaaatttgtttaagtttcttgtagattctggatattagccctttaacagatggataaattgcaaaaattttctcccattctgtaggttgcctattcactctgatgatagtttcttttgctgtgcaaaagctctttagtttaattaaatcccatttgtcagttttggctttggttgccattggttttggtgttttagtcatgaagtctttgcccattcctatgtcctgaatggtattgcctaggttttcttctagagtttttatggttttaggtctaacatttaagtctttaatccatcttaagttaattattgtataaggtgtaaggaaggggtccagtttcagttttcagcatatggctagtcagttttcccaacaccatttattaaatagggaatccttttcccattgcttgtttttgtcaggtttgtcaaagatcagacggttgtagatgtgtgatgttacttctgaggcctctgttctgttccattcgtctatatatctgttttggtaccagtaccatactgttttggttactgtagccttgtagtatagtctgaagtcaggtagcatgatgcctccagatttgttcgttttgcttaggattgtcttggctatacaggctcttttttggttccatatgaactttaaagtagtttttttctaattctgtgaagaaagtcaatggtagcttgatgttgatagcactgaatctataaattactttgggcagtatggccattttcacgatattgattcttcctatccatgagcatggaatgtttttccatttgtttgtgtcctctctgatatccttgagcagtggtttgtagttcttgaaaaggtgcttcacatccattgtaagttgtattcctaggtattttattctcttagtagcaattgtgaatgggagttcactcatgatttggctgtttgtccattattggtgcatagcaatgcttgtgatttttgcacactactttgtatacaactttgctgaaggtgcttatcagcttaaggagttttggggctaagacaatggggttttctaaataaacagtcatgtcatctgcaaacagagataatttgacttcctctcttcctatttgaataaccctttatttctttctcttgcctgattgccctgaccagaacttccaatattatgttgaatatgagtggtgagagaggagatccttgtgccagttttcaaagggaatgcttccagcttttgcctattcagtactatattggctgtgggtttgtcataaatagctcttattgttttgatatgtgttccatcagtacctaatttattgagtgtttttagcatgaagtggtgtggaattttatcgagggccttttctgcatctattgagataatcatgtggtttttgtcwttggttctgtttatatgmtggattacatttattgatttgcatatrttgaaccagcyttgcatcccagggatgaagccaatttgatcatggtggataagctttttgatgtgctactggatttggtttgccagtattttattgaggatttttgcttcaaagttcatcatggatattagcctgaagttttctttttttgttgtgtctctgccaggttttagtatcaggatgatgttggcctcataaaatgagttagggaggagtccctctttttctgttgtttgcaatagtttcagaaggaatagtaccagcttctctttgtacctctggtagaattcggctgtgaatctgtctggtcctggactttttttggttggtaggctattaattactgcctcaatttcagaacttgttattggtctattcagggattggacttcttcctggtttagtcctgggaaggtgtatgtgtccaggaatttatccatttcttgtagattttctagtttatttgtatagaggtgttcatagtattcttttatggtagtttgtatttctgtgggatagtggtgatatcccctttatcattttttatcatgtctgtttgattcttctcacttttcttctttattagtctggctagctgtctatctattttgttaatcttttcaaaaatccagctcctggattcattgattttttttgaagggtttttcatgtctctgtctccctcagttctgctttgatcttagttatttcttgtcttctaccagcttctgaatttgtttgctcttgcttctctagttcttttaattgtgatgttagggtgttgatttcagatctttcctgctttctcctgtggacatttagtgctataaatttccctgttaacactgctttagctgtgtcccagagattctggtacattgtgccttttttctcattgttttcaaagaacttatttatttcagccttaatttcgttatttaccctgtagtcactcaggagcaggttgttcagtttccatgtagttgtgcagttttgagtgagtttcttaatcctgagttctaatttgattgcactgtggtctgcgagactgttatgatttctgttcttttgcatttgctgtggagtgttttacttccaattatgtggtcagttttagaataagtgtgatgtggtgctgagaagaatgtatattctgttgatttggggtggagagttctgtagatgtttattaggttcgcttggtccagagctgagttcaaattctgaatatccttgttaattttctgtctcattggtctggctaatattgacagtggggtgttaaagtctcccactattattgtgtgggagtctcagtctctttgtaggtctctaagaacttgctttatgaatctggggtgctcctgtattgggtgcatatatatttaggatagttagctcttcttattgcattgatccccttaccattatgtaatgcccttctttgtctcttttgatctttgttagttaaagtcagttttatcagagactaggattgcaacccctgcttttttgctttccatttgcttggtaaatattcctccatccctttattttgagcctatgtatgtctttgcacatgagatggctctcttgaatagagcacactgatgggtcttgactgtattcaatttgccagtctgtgtcttttaattggggcatttagcccatttacattaagtttaatattgttatgtgtgaatttgaaactgtcattatgatgcaagccggttattttgcccattagttgattcaatttcttcatagtgtcgataatcttcacaatttcgtatgtttttgcagttgctggtactggtttttcctttccatatttagtgcttccttcaggagctcttgtaaggcaggcctggtggtgacaaaatccctcagcatttgcttgtctataaaggattttatttctcctttgcttatgaagcttagtttggctggatatgaaactctgggttgaaaattcttttctttaagaatgttgaatattggtccccactctcttctggcttgtaggttttcttcagagagatccgctgttagtctgacgggcttccctttgtgggtaacctgacctttctctctggccgcccttaacattttttccttcatttcaaccttggtgaatctgatgattatgtgtcttggggctactcttcttgaggagtacctttgtggtgttctctgtatttcctgaatttgaaattgggcctatctttctagactggttggggtagttctcctggataatatcccaaggagtgtttttcaactaggttccagtctccctgtcactttcaggtacaccaatcaaacttagtttcrtctttttacatagtcccatatttcttggaggctttgttcattccttttcattcttttttctctaatcttgtcttcatgctttatttcattacattgatcgtcagtctctgatatcctttcttcttgattgattaggctattgatacttttttatgcgtcacaaagttcttgtgctgtgtttttcagttccagcaggtcatttatgttcttctctaaactggttattctattagcaattcctctaaccttttttcaaggttctkagcttctttgcattgggttagaacatgttcttttagcttgaaggcatttgctattgccttctgaatcctacttctgtcaattcgccaaactcattttccatccagttttgttcccttgctggcgagttgtgatcctttgggggagaagaggcattctggattttggaatttataggcttttggcactggtttttcatcatcttcgtggatttatctacctttggtcttcatgttggtgatctttggatggggtttctgtgtggacgtcctttttgttgatgttgatgctattcctttctgtttatcagttttctttctaacactcagtcccgtctgctgcaggtctgctggagtttgctggaggtctgctccacaccctgtttgcctgggtatcaccagtggaggctgcagaacagcaaagattgctgcctgttccttcctctggaagctttgttccgcaggggcacctgccagatgtcagccagagctcttttgtatgaggtgtctgttgacccctgctgggaggtgtctcccagtcaggaggcacggtggtcagggacccacttgagaaggcagtctgtccctcagcagagcttgagtgctgtgctgggagatatgctctcttcagagccaacaggcaggaacattgaagtctgctgaaagtgcgcacacagctgccccatcccccaggtgctctgtcccagggagatgggagttttatccataagcccgactggggcagctgcctttctttcagagatgccctgtccagagaggaggaatctagagagacagtctggctacagcagctttgctggacttcggtgggctacgcccagttctaacttcctggtggctttgtttatactgcgaggggaaaaccacctactcaagcctcggtaatggcagacaccactccccacaccaagctccaaagttgccttcagactgctgtgctggcagcgagaatttcaagtcagtggatcttagcttgctgggctctgtgggggtggaatctgctgagctagaccacttggccccctggcttcaacccccattccagggtagtgaatggttttgtctcgctggcattccaggtgccactggggtatgaaaaaaaactcctgcagctagctctgtgtctacccaaacagccgcccagttttgtgcttgaaacccagggccctggtggtgtaggcacccaagggaatatcctggactttggtttgagaagaccatgggaaaagcatagtatctgtgctgaagtgcacctttcctcacggcacagttcctcagggcttcccttggctaggggagggagttccctgacaccttgcacttcatcggtgaggcaatgccccaccctgcttcaactcacctccgtgggctgtacccactgtctaaccagtcccaatgagatgagccaggtagctcagttggaaatgcagaaatcatccaccttctgcattgatcttgctgggagctgcagactggagctgttcctattcggccagcttgccagcctgatactccgtacattcttaaagattctaactttatcttttcttgatttcctcatctccaggataaggaaattgtgttgaatgagctttgtggggccatccatctctactatgctgcagtatgctttgggggagtcctattactttataactacctgccattctccattctgtatctgtccaactcaatctatgatggttgttggattaatcttcataatatagaaccctaatcacattgagcatctgttctggaatggaaaagaataaaatgttaataactttcttcatgcaatgggagttttgtgagttaccatttattaaaagctgaccaaataaattctacttagtaaacaaaaatatattgatacatttttatgtctggtacattctggcacctaaggatagtgaattgattcagaatttatgcatatcacactagtagggaaattaaaattctataattttgtatttaatcttagccgatgtatgtgtgtgtatatatatatatgcttatctttctgatattaattttcttacgtagaacatggatcctccaggcataactagtttctatttctcatgtacgtcctcagaattcccgaaacctctttgttattgccaatctggaatgactttcctccctttatcacatttctatttatctttcaatatgcagcttagatattagatagcaagtcttccttcctttctcaacatcttccttctttttctatggaacattamtttttaaccttgaactataagttacttaggttcacattttctcctccatgagactgctaccttttgcaggcaggaagtagcttaaaagcataagcttttgagtcagatagaccagactctgtctttaccagttttgcctacctaggcaagttacttgctttctctaagtcttggttttctcatctgcaaaatggggatgttagtaatgacttctgtatagggtagcagtaagagttaaagaagacaacgtttgtaacacacttagtaccatgcttggttcattggtaagtttccaataaattcaaggcatttttaattattatataattttaattatatattaacaatcccttctaccctgtgaactcttacaaatcactcagtgttttggatgtagcaagtgtttaatacatatatttaggagaactttaacaaatgttgttgaataaaggcttataggaattcagaagagggaatgattagttctgattgttggattaaggaagacttgattggagttggcatttgaactttcacgtctgagttatgatttgacagaaatgarcaacaaaaaaacattggaagccaatgacatgcaatttcagggagaagtgtcagctaagctttacattaataatagaacctactcaatgggtcggtttgttaataaatgcatctaaagcattggcatagtaagaatatggtaaatattagcctgtgttttaacaccccatatatagactacatgttaaataaataacaaaaactcacttatagtatatatgtgtatatacacacacatgcacacgtcatctttcacactaacttgaaggatctctgtatggcaacatttccttaatatttttgtttgcaatatccatttaaaagtacaaagaaaacatttattttaaaatattgtttatttcagctatatattattcttcctgtttatttgaattagtgagacaatactttgcaaatggctttaagttgtcagctgttaaggattatcatgccatttttttccccactggtatagctaaatttgagagaaatctatataagtgacagcttacaacagctgcaattgcttgatatgtgaaaacaatcaagggatatatattatatgaagttcaaggtcattttattttaattaaacatgtcttgaattataatatgttccataataatgtaactaagattttttctgtcatactctttttaaattttttgttttaatatactttccagacatatgaaagttacaagaatagtacaataattctaatataccttttatccagattcctcaatgttaacattttgacatctttactttatttctctccttttctctctcacccacacatactcattctctgtctgaactatgtgaaatagttgcagacatgacacccatcatttactcctgaatacgccagagtgagattcttaaaaataacaaaaaataggatattttcttaaataaccaaaaaacaattatcaaattaagatcatgcaatattattatctattccacagaccttatttagattttgccatttgtcccaataacatcctttataacaacagaaaaatcccatatttatgttttacatgtagttgtcacatctctctggttctcttttaatctggaacacttcctcagtctttctttgtctttcttggccttaaccttcttgaagaacacagaccagttattttgcagaatgcccctcaacttgtatttgtctggtgttttctgatgattagaatcaggtggtgcacttggagcaggaatagcatagaagtgatattttcttctcagtgcatcatgtcaggaggacaacaaaaatagtaaaacataaattttggaaatttggaaagaaacacttttataattttttagaatgtttgaaaacttatatttctcaattttatttatatttaacatttttcattttttagccaatcagtaaaatattaagtatggaataacactttctctgcaaggttctctgtcaaatttttgcaatttgtcaagtgtatttattgttaaatgaagataaatatagaaagacactctttagtaagaaatttagttatctatggtattaaatactaacatgggtttgatatgaaatagagcattgtgcaagaatgtttttgacaggtacaaataaagaggttgaactaagtaattggtttgacagatttattttgccaaattttgccacccaaatctgaggccactaatagggaaaagattcaggcattgcctattaatgctcacttagtattggttagctttttcagacatttgagagaaggaattttcttttaagtcagaattaattttaaatcaacagtgctcttttatatagaaagatatatgatactcagattttatgcctgatcattctttctttcttattttcccctcaagagagaaaaaactactgcctgattacaaatcctgcagtgcatatgttgaatctaattacatgtttcatattgctccttgccaacaaatacatgttaataataatgaataatcaacctcacttaacaagaggaacacaaaatgtgtttctgccatttctcatgatggacagacccaggagtatgtcaaagatggtatcctcaccacatcagttgcctatgacttattaccagcaacctgctctagatgatgaagtgtgaaattgatgggcactatagggaatttgaactgagatttcaggctagggaagcgctgtctcacaatattcgcctgccttgttcattggctcactggtttgccctaaggcctctttttataatgctctggaaaatgtttcctggctaagtttatgtatgtgttactgtatctggctagcaaccagattgatagaataaagcttacaggaaattttactatatcctgttccccagctgatagcaagaagtctgagccatataagaactgactgaacagaatgaatggatgaaatatttgagcatgtcattatgaggatatctttcactgcagaagatattatagacactaaaggggaaaatgttgtgctgttatcacctcccaacttttttaaattaacttttagagattagtttgttagtgattcccacatttaactcatgtcaaatgattcttttataatagaagtattaatttataatttatatttgatttatgaaattgcttgaatagtcaagtattgattaatttagcagagtctgaaagtatagtatatactatatccctataatttatttcagaaattttcatttacttctggaattattttcctcctgctttatttgaaaagtcaagatattattatgttgctataacattagtagaaaaattccagggaggcagtagagagacatataagcaaaactcaagttttcaagcaggcctgaatttaaaggtgtatcctagctacttaatctcaagcaaattagctaacatttccaagccttaaatttcttagcttggagaatcataatatttacctcacattcttaagtaaaataatgtataaaataacttgcacagtgcctggctttactttctcctctcacccagtactttgatatttttgttgaggcataaacagtggaatataaatgttaacattatttagtattttatttcatcatgatattttgtttctctttgaacttactaaatttaattttccttttctttttaatttttgagacagggtcttgctctgtttccaggctggaatgcagtggcacaattatagctcactgtagcctcaaactcctgagctaaagggatcctccccctcagccccccaagtacttaggaatacaggcgtgtgccatcatgctcagctttttttttttttttaaagtttttgtagagatggagccttttgctttattgcccaggctggtctcgaactcctggcctcaagcaatcctgtagccttagcctcgcaaagtgcccaattacaggcgtgagtcatctttctcagcctaattttcctttctttagaaacaaaattggactcatgactctattagcattcttaagaagtattctacgcagaacagaagtagaacaagcaagaaaaagtgaaaatacatctattgctaagggaaggaagaattaaaacacaaatatatttttgataagatttttaaaaataaaatctaaatttttggaatatttttgcacttataattctgtatcttagtttatttaactacttatcttttttttctttttttttttttaacaaagataatgcgggtttggatgaagcacttctaagtcaaaatgaacttttcccacagtggtcaggaattgccatagtgctattttctaaggtgcatagcatgtctgtgtggggtagttcgtattttgaagcccagagactcttttcctagcaggaatagtttttctgtgagatgctttgaaagatattttgcttcatttaaatgccctgtcagaataaatgtgccacttcttgcgcataccttgtacaaggtctgcaacctctgtaaactctgaatgccactggcaaaactaagcaatgttctggttaaccttcacaagcagggtagttgggagaaaaataaatgaagagaatatgaggaacaggggaagagaaagaaaaggaaaaaggagaaagacggccaggtgtggtggctcatgcctgtaatcccagcactttggaaggccaaggtgggaggatcacttgagctcaggagttcaagaccagcctgggcaacatagcaagatctcatttctacaaaaaatttaaaaattagccaagcatggtgtgcgcacctcccagctatgtgrcaggctgaggcagaaggatctgttgagcccaagaggttgtggctgcagtgagccatgttcatgccactgcagtccagcctgggcaacagagtgagaccctatctcaaaaaacaaaacaaaacaaaacaaccaccaaaaaacaggagaaagataaaaacatcattcatggcttcataatatataggaattatgattacttgagaatccttttttttttgagacagagtcttgctctgtcactcaggctggagtacaatgctgtgatcttggctcactgctacctcctcctgggttcaaacgattctcatgcctcaggtcccctagtagctgggattacaggcatgcaccatcatgcccagctaatttttgtatttataatagagacggggtttcaccatgttgctcgggcttacttgagaattcttaataatcgcttctgattttttgtcttaattcatatgtagatagtttatttcaggactttcactttaagttttatgaaaagaattattgtgtttgtgtacatataatgtatttttaaaaataactaccaatttgggctaaactcaagtaatttttttctgtaatgtcaaagtcatctcattgataataactatgctggaacacaagttcattttatttctacaaagcacatctcacattctttccctctgtctgagatggacaatttgttcgaatttgacctttcttcctcctagaggcataaatttgggctgatttatttggataagattggatattgcacctggtgtggatagtactagattacatcttcaggaaattgaactttttctgtttaccctttagaacaaacagctttctgaaatgaatatgttagagacagtgttagcttctttttttgtttccattctgctacataggatcttttcattttacaaaaaagtagctttctgttgctttagcaggttggtatattatactttctgaaactaaacttcctgatacattcttggtaaaattcagggtggtgtgcagttggtgttgacctatatgccttaaaacttttttatattaatgtaatctaaatttacagaaaattacaaaaatagtacaaaaaaatccagattcactgtttacatttttattttgcccaatttttttttatcattcatgctccagttctttttctttctctctccctctgtatatgtgtgtatgtgtatgtatatatttttcttgaaccagttgaaagtgagttgtaggcactgcacccgtttaacccttacattcttttatataaccagaatagaatgatcaaagtcaggaattttaatatggatacaatgttactatctccatagcctatattcaaatgtcatcaattgtcccaatatcttttatatttatcttatatcttattcagttcaagattatattgtatgtagttttcaagtttccttagtttcctttaatacagaattagcttctcttttgtcatttatgatcttcatatttttggagagtacaagcaaattagtttgaagaatgtccatcaatttgagtttgtctgattagattcatattatggatttggggcaggaatactacagaagtgatgcaccacagaaaaggcatgggatgttagtttatcctgttattgttaatggtgatgttaagtacctagttaatatggcacctgccaggtttctgtactgtaatgttactgttttttactttgcaattaagtaatttgtggtagtctgagactatgtacatatcttattcctcacctgcttttcatttagcatctgtcrtagtttgttttttgttgctgtaasagaatatcatagactaggtaaattataaaaatagaaatttatttggctcatggtttttgaggtggagaagtcgaagagcatggcactagcatctggtgagggtcatcccatggcagaatgtggaaggcagaagagagcacatgagacagagagagacaccagggaccagactagctttataacaattcaccctcccaataactaacccattccctaaataataacattaacccattcatgagggcagagccctcacaacctgatcacctgttattaagccttaccttccaacaaagttgcattggattaaacttacaacacatgaacttttggggaacacatacaacccaaaatagcatccattgatgattgttgcctgaattaattatcattaattactataatgtttgcaaaattgtgactttctagcacccataatttattctacattcattaattggcaaactaaggaaaagctttcctttctcttccccacttaycatttgttttctttatctgtatcaggataaattcgtggattcttattttttcaatggattacattctattattatcattatttattttgatactcaaattttcccacatttggccagtaaaagccccttcaaactaactcctgcatcgttttgacatgttctcatcactcctggagcacttccttgatttctgacatcacaaaatgttccaagattatattgtcctttgtctgacctagcgctgaaagtagcctttattccaagatctggatgtacagtgtaataatagctactggtatgctactgcttttaggccttctcagtggacacaactaggacatatgtgtgtcagtttgtgtatatgtttgtgtgtaatcagatcaaacagatactcagatacttctaattctaatccagaagcagagagtttgttttagtcttctcatgttgaacagtaagaaacctgagaaatttgctcatttgtagaatacacagaaagtattttcaaaattgttgacttataacatttttaaaacaaactaatataaagtcatcacaggaaaagaaaacagagtagcatctcttatgaatatagatgtgaaaactctcagcaaagtattagttaaccaaatccagcaacagattaaaaaaaaaatcatacaccataaccaaatcaatttaccccagaaaggcaaggttgatatagcatccaaaagtcaattaaaataatacatcatatcaatagtatacagggcaacaaccacatttatttgtatcaatatcgattcatggatttttattttgttcaatgagttgtgaaatattttgacactcaatttccctaatgcctacataaaaaaggcatttgataaaatgcacactttcatgcttaaaacacttaacaaactaggaaaagaagggaacatcctcaaccagttaaaagacatctaccaaaaaccacaattaacatcatacttaattgtaaaggctaaatgtattctccctaaaatcagtaatgatgagaatgtcttctcttaccaggacaactaggaataaaaaggaaaaaaaaaggcctctacattggaaaaagagaagggagaaaactatctctatttgcagataacatgatcttctatacagaaaatcctaagacatccactgaaaaactrttacaattactaaacaagtttacyaatattgcagaatataaaagcaatatacaagttagttgaacttgcacctgcaatgaacaatctgaaagtgaaaggaagaaaataatcccatttacaaccctatcataaagattacaataacccttacattacatcatactcataatttaactctaaatggatcaaagatgtaaagtaaaatgtaaaactataaaactcttggaagaaaacatagacataattatttgtgatactggattatacaaagccttctaagaatgacactaaaaatacaagcaataaaataaaaaatgtaaattggacatgatcaacattttaaaacttttaaggccgggcatggtggctcatgcctgtaaatcctagcactttcggaggctgaggcaggcagatcacttgaggacaggagttcgagacaaccttggtcaacatggagaaaccctgtctctactaaaagtacaaaaaattagccaagtgtggtggctcgcacttgtagtcccagctactaaggagactgagtcaggagaatcgcttggacgccagaggcgaaggttgcagtgaaccgcagactgcgcgccactgcactctgccctgggcaacagagcaagacttggtctcaaaagaaaaacaccatccaaaaaaaaaaaaaaaagaccacaatccacataatgtgagactattatggcaaattatatgcctgataagaaacttatatctgaaaaatataaagcaatattatttccataacaaaagacaaataacccaattttaaaatgggcaaagtatctgagtagacatttcttcaaataagagatatgggtaaatactaagcacatgaatatatgctcaacatcattagctgttagggaaatgcaaatcaaaaccgtaatgagataccactccacatctgatagtattgctacaaataaaatagccagataataacaaatgttggccagaatgtggataaattagcatcctcatatactgccgttaggaatgtaaaatgttgcagccactttggagaacattttgacagtcccttaaagcttaaacatgataatatgactcagcaagtctactctatgtttacacccacgagaattgaaaacatacacccaaacaaaaacttgtgcaatgaatggtcatgtatgtgctatatgtgatgtatccatcaacagtaatatatttatgtaatttacatatgctgagaatggggaacatactcaaaatattttttttactgataagtgttcaataaagtttggagaccactgtcttagagcaatagttcccatactttccatgcatgaggttcaacaaggtgtttgttaaagatttccaggccctaaccccagagtgtctagttcagtagatctaaggtagagcctaaaagtttgcttttctaagcagtctccagatgatgccagtgcattggtccaggggacatgctttgggtacttagattgttgtccctgttatgctaaagcttactgaggatgcctgttaaaatacatattttaaggccccacctctagaaattatatatcaataggccaagaattggcttcagaatttgcgttaacagtgaccacaggtgattctgactcagcgggcctaaggatcatcactttttgagtaatgctgcttaggagcttagagagtggagttatgaaatggtgggtgtcagtcagggagaagcagcattgtyccttttgaaaactgggaaacygttcttcaaatattctcagagtctgagaataaattcagagtcaggaaaattctccttggattctctcttaaaggatactgatggaaaaaaaagacatgagctaatgagaagcattcaataaaatagaaatgtttgaaagcttttttccccccttgggagctagatttatacttttgtttgcaaacaaattttcaagaatatagaaattatgtaaagcacgattttttggtatcattattactattttaaaactaaacatttaaaacttttattccattagaacatcataaccttcacatacatttactgactacaaaattgataaagtaaaagaaagaaaaataatcacctttggtcttacaatcattgtaaaatttctgaatttctttacaggtttttgtttttgcttttagtacagagttgtgttgttgttatttagtttcatgatttctttgtattagtgatgatagtgtatatgatgttttgtttccttttttcctcctgaattgtgtcataaatattttccctgtggtttcataaatactttataaggatggcccattgaattatagtgtaccgccatttgttttacatttttaaatatttagaagttatatttcctacattttccattagattcatagagttttataattggaagttaccaaagatgatttctacttgtccattttacaaatagttaaaccagttttcccaaagtcacaaagttaaaaaatggcaaagttagagctaaagcccgttttctcactcttgtactgtttattccactatgttgtgctgttttctctaataatttaaaatttactggaaagaacattagatttgtgccactttgtttcctacttaacccatttattctttgttcttttttcctctttttctgcctgctttgaggcagtttgagtattttttatgattctgtcttatctccacaattgacttattgagtatatctcacttaaaaaaaagtagtagtttccttagggtttaagatacacatctttatcacagtctaaagagctttagaataaagttttcagaaagagctttagaataaagtaaatgcaggtacctaactgacacatagttttaacaaaatatatcttgtttgtgtagtataaattaagatattttgtatattattgacatttatgataactaaataaatttcttatattatccctacttttttttaatgcaaagactgccaagcatgttgtattccttaacccaaatatgtcaagttcttatagtggacaaatgtgaatttcggatctccccattaacaagacatttataagaagactgttttcctaggttttctttttaattgcagtgctgctaatagagatgacgtgtcttcaaggggaagtgaccaaatcttgaaccttatttaaaactaccatagatttttgaactgtgaattttattattaagacatgaaagtgtagtttgtgtgtctatatgtgttttctcttttttgcctttgcaaccaatgtaagtgtacacattgaatgttggagttagaaagggactcaaaagctcgtttaaaccaaactctttatataacagaaaaggaaacacaggctgtactgattatctattgctgcataataaattactgtaaaacttagtggtttatacagcgagtatttattatctcacagtttctgtggtccagcaatcctgggatggcttaggtgggccctctggctcagagcctctcacaaggctacacagtcagtgtgtaggctgggctgtggtctcatcacaaggctcaacttggagaggacccacttccaagtccatttacatgtctgttagcaggatcctgttcaagtactgttggaatgagggtctcagatcctcactggctgttcactgggagcattagttgctacgggcctctctgtagggcagctgagagcatcgcagttggcttccctcagagtgtgccatggagaaagcaagccaaagagggaattcacagtctgtttataacttaaacagacttggaagtgacatcccatcccctttactatattctgctcatttgaagtgagtcactaggttcagcctataatgaaggggagaggattacacaaaggtgtgaatacaggagggaggaccattgggaagtaccttagatgctgcctaccacagagacccgaataagtgaaatgcccagtcatacatacattttgttagtggcaaagcagggccagcttcctgatctctcaattctcagtcagcccattgttcttttgaattttctctagtcattaaaaaaaaaaagttaatgacataataacccttactttttgagaggataaattacttttaattcactgcaactcaccagattactcttaatattgcagtaggggaaagatgcagagaaaaaaagaatagtttgatattattactagttttgcttttctactcagtggaaatccgtgccaagtatagaagcaaagttgtaaaggagaactaggaatgttgacagcaaactaacttagagacctcccagttaaaacttcaaactacacaccttgatctggatttgttagttggatgcttctacaataaactcatatttttaagaaaatgatagatatggacattagtatgctttacaaatccttacataatttacattatgattcaaataaaataggttaaagccaagttaagagcattaatatgatttaaaaatgtgaaaggcaaggctgggcatggtggcttatgcctgtattcccagggaggatcgcttgaggccaggagttcaagaccaccctaggcaacatagtaagatttttgtctgtaaaaaaattttaaaacaattagccaggtgtagtggtaatgcctgtagccccagctactcaggaggctgaggcaggaggatcactttagcctgggagtttgaggctccagtgagctatgattgcactattgcactccagtctggacaacagagggagaccctgtcttcccacaaaaaagaaaaagcaaacggcagcagtagcactgtgcttggatctaggagtgcttattgccatcaaatgttggggaataaaccttacagagcaatggaggtaaggtagaaaagggaacacacccaatttgtgatttgaggaaagatattaaggatataagtaacagaaattgccctcagtgccttttttttaaaaattttatgttttcagagcagttgttagctaaaaaggaagtgataaccaacatccactcatccttattgttttatcactgtactaaagcatggacagctaatatatatctagcaaacaatgagttgttaaacgcctctacttaagaaccactttctcatttaggaaaagtgaactgatttttctcatggccaaaaaaacaatccagaacagaaatagaagacagccattcctctgatataattgagaagtctattaagaaaaaagaggggctggccgggcacggtggttcatgcctgtaatcccagcactttgggaggccgaggtgggcggatcacgaggtcagaagatcgagaccattctggctaacacagtgaaaccccgtctctactaaaaatacaaaaaattagccgggcgtggtggtgggcgcctgtagtcccagctactcgggaggctgaggcaggagaatggcgtgaacctgggaggcggagcttgcagtgagccgagatcgcgccactgcactccagcctgggcaacagagcgagactccgtctcaaaaaaaaaaaaaaaaagaaaaaaggaacaaggaatgataagatgtagaactatttggttgttgatgagtaaaacacgtttgtttgtttgtttttaaattgctttgaatgtcattgatgtgtctcagtgcaaaagttaccttttcagagaaatgtgcctccagcatcgtaactaaactttgtccttccacattcctgtcattatcaggttattctgtgtaatatttcatagcaattatacattttaaaaattgtctattttctctccttgagaacatatacaccatgagaacagacactttttccatctcattcactactggattcccagaacctaaaacagttcctaaaacacactaggtacttaaaacttttgttgaatgattaaatacagtattccaaatgcatagaagaatctatatgtcagagctttacaaactttcacttttagcatgttggtaattttttcgtagcactactagaccaaaggaaatatataactttttcatttattagataattatgtccaaacaacttaataagcatttatatctaaaaaacttaggagcccttagggaaaaatatacagaaatttaaggaaaataatgttttatgtcattcttaaccagttacttacaaatgtaatatatgcttctgttgtggacttcataacttctcaaacaataggatcagattggacactgctcttcatgttctgttccacagtgattctaagaatggctttctattacagcaactactaaaaatccaactttgcaaaaaatatgatgtcaataaaattaatgtagtgtgatctactgttgaaactgtgaactgtctcatctagtagtctgtgtggtatccaacagatattcaacaaagctgtattttctttgaaaatttaaactatcccacagtaccctgagaaccataatttaaatgggttaagtttacttcatttttttatatggtacattgaaagcctgaatgttcagggaagaggctcagattcttctttgtaagctgggaggaagaaaaacaagccatgagctacaagaagcaacctaggattagggcactattagcagatcagggtcagaaacattgacctggagaaatcagtcatagtcaatacttaagaaatcagaatccgggcatattaaaaaatactagagccgaattagactgctaaacaaatcaagaacctttaaattagaacagacaaggctagcatgagttgattttggtatcaaaacttagtgttaattataaagtattaatatcatgttgagtagggtttccctgcattgaaaatgagattgagctagatgacctataagatccctggtaaatctcttgtaaaatgatctacataaaagagcagtattttttagaattgtgaatctttactgccagaaggaaacttagacattttctgcttaaattccctctacatcattctagttataatgaagcttagtctagcaattgcttttatgtgcaaatatgaaacaatcattctgaaattcaaacagcttatttttaatgaacaaggaaagcctacagtttctatgacttaaagctttttagtgttgatttcaattgtgtaataaaatctgtaatcttaatatttatataaatctaaattagaatttgtaaaaatagtcaagcttataaaagtctcatataaaagtatgagagtaatactaactgaattgcattacatttgaccatatgctagcctttataagtgttatctaaatcttaactctctaatcagccgctaccaattaaatggagttgaaacatctctgacctataacaacctatagcaagatgtgcactagtatatttaatatatactgacaccagacttcagcaattttgtcaagacctttgtaaggttttcttgtattctgttaccttatttcctaagccctatctctgatcaatctgttttcaagcttacaaataagaaattattgctaattttttggggtgtgatatcatgattatgttttttttttwaaaaaaaatctttataagagatacatactgacatatttcaaggtgaaataatatgattgtctggaattttctttaagattaaaacagagttcattcttaaaaatgcctattttggtgttaactgaattgaattgaattgaaaaaaatatgccttacaagttttatttcatatttaccctaccaccctacctatatttttacatgcattattaagggaatgctctttatagtgtgcagtttctacctcaaatctccgcatactgcataatcttgcttctcactccctgcccccacccaccgcagccaagatctaagtcccttttccacaagccagtaaaaaaaattaatgaatttatggttacttttagtatagcatgaagcccaccctgacagagctatgctgtgatcttttcaagttagattaagggctcactaagcagggcatgcccattaaattataatgttgtaaagcttgaattctggaacacatactgctggcattttagtttttaataggattatccctactatgaaataatttgagaacatatgttatattcctgtgaaactgtgggttgatttggtatgaaaagagatgagctgcttttctctctgtgtccaaaaactatttgtttttaatactccggagattataagacatatacagaaaatgagcatctcatgaagcattttgatccttattaatcttacataataatgttttcttattcatgtacttgaaatataacagtaaaagcacatcttaactgtataagtctgaaaaaggcaaaactatggagacagtgaaaagatcagtggttgccggactactgggaggaggtagagatgaacaggtggagcacagaggatatttagggcaatgaacatccccgtacgatactacaatggtagatatatgtcattatatatttgtccaaacccatagaatgtataccactaagaatgaaccctaatataaactctggactttgagttatgatgtgtcaatgtaggttcatcactattaacaaaggtaccactgtggttcatgatgctgacaatgagaaaggctgtcaaggggaggggagcaagagttaggtggatatatagcaaatttctacagcttctgcttaattttattatgaacctaaaactgctctaaaaaataaagtctataacacactcacatgttttaatatttttggtgttttttttttctgaactgcccaagggtttaacaactctgtggcctataaaatgtcttctattcaacatatcctcaccaagaaagtatattcatatatgaaataaacttactggagtcttttgcatttccaaaatttgagctggatttttctttttatttctaccacgtttgtttttactttttattatttctgcttttatctatctatctatttatctatctatctatctatctatctatctatctatctatctatctatctatctatgagacagagtctcactctgtcgcccaggctggagtgcagtggcgggctcagctcactgcaacctccgcctcccgggttcaagtgattttcctgcctcagcctcctgagtagctgggattacaggcacccgccaccacacccagctaattttttgtatttttggtagagtcagggtttcaccatgttggccaggctggtctcaaactcctgacctcaggtgatccacccacgttgacctcccaaagagctgggattacaggcatgagccacccttccttgtatattgtgggttttacttgatatattggatcaaatacttgttgtttatttttccatgcttcttgttttccaatgaatgtatcttataaaagctgtagacatttttctgagacctgctttggttgtatctcataagtattgatatatcatgttctccttgttcttcatttcttaatagtgcttttgttctgatkaatattttagagtatttatgaagtattttttatttttaggtgtttattgttgggatgagtttaaggacagtttttgttgcattgtgagcagaatctctaatccagtgtatgatcaatttcataagtgttcatgggcatttaagaatgtatattctgcctaagctggacacaaagttcatacctgtgtgcatgtgtgtatctattcataaataaaacatctttagattctgctgaagcatctaaaatcattaggcctgtaatccacctggcaacaattggctagatccaagtaggaaacctgccttcacatacatttagggaggttgatcccttctcagctccagccagttgtacacatacatgtaaacatttatagatcaccttgttaattatttaaacattcagtcctctgacctatagattgtgatttaattgcaaaatgtgtattttagcttcccttgtcgatgatggcttttcagagtctttttttctaacactatttgttttacatattttgatactttgctgttctgtccataaaaattcacaactgctgcatccctgtagaatcgagctttcactagctatttaatattttagccttgagttctttcatctgatattaatattgcaacttttgtttccttttgttaactttacctgtgtattagtctgttttcatactgctggtaaagacatacccgagactggataatttatacaggaaagaggtttaatggatttatagttccacatggctggggaggcctcacaataatgacgaaagacaagggagagcaagtcgtgtcttacatggatagcagcaggcaaagagagagagagcgagcttgtgcagggaaactcctgtttttaaaaccatcagatctcgtgagatttattcaccattgtgagaacagcacaggaaagaattgaccccatgattcagttacctcccactgggttcctcccatgacatgtgggaattgtggaagttacaattcaagatgagatktgggtggggacacagccaaaccatattgacctggaatgttgatattcactcttatttccattttttgtcatatcatttttattttagctgatttttatgtttttattattattaaatctgagcattcatatcttttggtagccaaatacaacatttgccaggtctggttttatttaggcaatgtatctttttcctttattcttcatgttttcttactgtctttagtttctgttttcctgaattttgccaaattgatcgtatttctttgctctccaacccccttacttttggcttctggtataaaggtcacaaactgatggtccttgggccagaaaaccacagatatgtattgattaggccatatactcctaaaacatctttttaaattatttgccaactttcaaaaagctacagatttatacatcagtaatttttggaaatgggtaagaggaaattgaattggatgtgcatttagtttggattgggagctatatttatatgacatacagtcacttctatgtatagaggatcggcttccaagaagttcctgcagtcaccaggctaactccatttcttctgaggcaagaaaagctccagtgcctcaaaaagattgacttgggtatggagaaaggttgaagaggaaatgataagagacagagatacatgtgtgtgtgtgtgtgtgtgtgtgtgtgtgtgtatgtgtgtgtgtgtgcgtctgggttcagcagaggaggccaagtttgtcagtataggctcacagacaccaggatttaatattcatacctatcatgttaggtagttagttaatttctttcccactacctcaacttttttcttgttatttttttttctcctgtcctatttttttccctgttggaacttgtaaataaataattggagtaaatatcacacaaggatagttgtgttcatataccagcataccttggcgatattgcaggttcagttccatactaccacaatgaagtgaatattgcaataaagtgaatcacatgcattttttggtttgccagtgcacatgaaagttgtgtttacactatactgtagtccattgtgcaatagcattatgtctttaaaaagcatacataattttgtttaaaagtactttattgctaaaaaaaaaatgctaagcatcattggaaccttcagcaagtcataatatttttgctggtggagggtcttgccttgatgttgatggctgctgactgaccagggtggtggttgctcaaggttgaggtttgtggcaaattattaaaataagacaacaatgaagtttactgcatggattgactcttcctttcacagactatttctctgtagtatttgatgctgtttgatagcattttacacacaatagaacttttttttttttttttttttgagacagagtcttgccctatcacccaggctggaatgcaatggtgcgatcttggctcactgcaacctccgcctgctgggctcaagcgattctcctgtctcccaagtaactggaattacaggtgtgcaccaccatacctggctgactttttgtattttagtagagacagggtttcaccatgttggccaggcaggtcacaatagaacttctaaaattggagtcagtcctctcaaaccctgctgctactttatcaacaatgtttatatagtgttctaagtcctttgttgtcatttcaacaatattttcacagcatcttcatcaggagtagattccatctcaagaaaccactttttttgctcatccataggaagccactcctcatctgtacaggtttatcatgagattgcaccaattcagtcccatcttcaggatctacttctaatcctagttctcttgctatttccattatatccacagttgcttcctcttctgaagtcttaaacccctcaaaatgtcatccatgatggttagaattaacttcttcaacactcctgttcatattgatattgtgacctcctcctgtgaattatgaatgttctgaacggcatctagattggcaaatcctttccagaaggttttcaaattactttgccaagatctttcagagatgttactaccaatagcagctatagtgttatgaaatgaagttgttaagtaataagacctgaaagtcaaaattactccttgaaccatgagctgcagaatggatgttgtgttagcagacataaaaacaacattaatttccttgtagatctccatcagagctcttgagtgaccaaatgcattgtcaatgagtcatgatattttaaagggaatcttttttctgagtagtaagtctcaataatggtcttgaaatatttattaaaacatgctctgagcaggtgtgcaatcacccagactttgttattccatttctagaatacaggcagaataaatttgtcatcatttataagggccctaggattttcaaaatggtaaatgagcattggcttcaacataaagtctccagctgtatgagtccctaacaagagtggtcagcctgtccttagaagctaggcattgacttccttttctggatatgaaagtcctagatggcatcttcttctgatagagggctagtttatctacattgaaaaatctgttctttagtggagccacctcatcacttatctagatcttctggataacttgctgcatcttctacttcagcacttgctgtttcatcttgcacttttatgtcatggagatatctcctttattaaacctgataaaccaatctctgctaggctccaatttttcttgtgtagcttcctcacctctgtcagcatttatagaattgaagagagttagggctttgctctggattaggcgtttgtataagggaatgttttgtctggtttgatctattcagaccacaaacacttcccaatatcagtaatgaggcattttgctttcttatcattcatgtattcactaaaggagcgtttttaatttccttcaagaacatctttgcattcatatcttggctagctcgtgcaagaggtctgtctcagctttcaacatgccttcctcactaaccttaatagttctagcctttgatttaaagtgagagacatgtgactgttttcattgaacacttagggtcattgtagggctattaattggcctaatttcagtatttttgtgtcttaggaaatagggatgcccaaggagagggagagagacaggagaacagctggttgttggagcagtgagaacacacacaacatttattgattaagtttgttgtcttaagtgggcatggttcgtggctccccaaaataatttcaatagtaacaacaaagatcacttatcacagatctccataacagatataataatgaaaaagtttggtgtattatgagaattaccaaaatgtgacacagaaacataaagtgaacacatgctgttgggaaaacagcactgatagacttaacacagcgttgcaaaaaaaaaaaaaaaatcttcattttgtaaaaaacacagtatttctaaagcacaataagaaagaggtatatctgcttgttcttacttataagtgggagctaaacattgagtacacatagacacaaagaagggaacagtagacaccagggcctacttaagggtgtagggtaaaaggagggtgaaaattcttcattgacatggctttcacggaagattattaaatccttttattgtacttacatagaaatttacaaatacctgtattagtccatttcacactgctgataaagacatacccragactgggcaatttacaaaggaaagaggtttaatggacttgcagttatacatggctggggaggcctcacaattatggtggaaggcaaggagagcaagtcacatcttatgtggatggcggcaggcaagaagagagcttgtgcaaggaaactctcatttttaaaacaaccagatcccatgagatttactatcacaagaacagcacaggaaagacccacccccataattcaatcacctcccaccaggttcctcccaggacacgtgggaattgtgggagttataattcaagatgagatttgggtggggacacagccaaaccatatcaataccatttaggcagttttgcctgatgtcactgattttgggggagctttctaacctttaagaatcttgggtttgaaatttttcccaagtctgaacatgaagaaaaagtgaaaaatatgtttaagcctataaagcaaaatgatggattttataaatgtgtatgacacaaaatgcaaaaatatttgaaattattccacacataggcaaagcaaggaagagaatattcaaaattgatgtcaattgctattgatgcataatagttgcccaataatatggtcaattctcattattcgtagtagttatgttttatgaagtcactacaaacactgagttggcaaatactgaaccactgctcctggggaaatatagggttaggttcttgcaagcctctggtcccatttttatcaactgatagccttattttatatgtgcttctatttaaagacatcttatttaatatatatagttgattcatttacactgagttcacagccaacagcaccataatgcatgcctgaacaaaccttatctaacataaattttctctataaggcacatcacagccttcttgtacttaggaaaactagacagcatttcagcactggcagccattttaatagcaaaatcacccaaaaaaggcacaaaaatttgaaaaatgtagaactaaatggaccatgagaaggatacttgtttataatatgagagatgaaacaagaaagatagtcatcttgttccacctcagctaggactgcttctcgaccttttggctaagatcaagtgcaacctcagctaggaacatgtaatcaggtgactcaaatatttcactgctctgtacatattcacaaattactacaaatgcaactcaagaatggatttttgagttacaaataaattctagcaagtaggcaaatgcacaaatatagaatctgcaaataatgagaattgactgtatctcatccattctactctaggccttggagatatcaagacggaatgagtgcaaacgttgttaaatgaattttattagggtgatagtgttaaagaataaagggtagttttcttcttacaagttttttaaagtaatgaaatgacttaaaatgacatgttaaaattatgatttaatttgatgaaatcaaattaagaagtaaataagtatctattatgggtaacatgacttctgtataaagttcatcaatatattgtttgattcattcttctgctgtaatgagcatgcagtattctctgatttttttaatgaaaagaaaaatgggtaattatgttgggaacaaaaatttaaagtaaataaaattaaaaccaaattttgatgacagatttagaaaaattatctgcaccaagattacataaaatccactgttattttcttgtgataattagcatcattttataacttctcttttaaaaattttcttttccaagagccattcagtgggtgcttatgaagtcaaacctatgagtcctgacagacctggttagacttctacttttctatttactagctgtgtgacttgggcaaatttattaacatttgtaagcacactcttaacttcattgtcaaatatagataatgaaggatatccctaattgtaaaatgaatataatgaaggatataatttattcttattgtaaaatgaggataatgtttatgaggatgaaatgggatagtacagtatataaaaactacttagactaaagcttggcacatcatgatattgtttgtttggtttgcttgttttgtcagagaaggtatctctctaaatacttgaatatgtttctactgccttcatatgtaaatgcagctgtgtaaagtattcttaagccacaattctctcttcaaatgttgctccattatgtggcatataatactgtagagtgatctgaggccaacctcttttctatacttgtgcataacctgttatcctgccttcatgccttaatacttaaagtgttctgtctgatcaaaacctttgcctgtttattcatttttttcttaggatacctaaaggcagtagaatctttttgtttgttatttttaccataccaggtgagttctttgaaatataatttataactattttctgtctagtaatatttccttccttcaaaacaatttacattttgaataaaattttccttccatatattctggtcttgtcttcaggaacactggttatccataagtttacatttcatcatctattcaccatactcctcatatttctcttccctttaacttcttttttctctctgtcctcttctttgcattcaggaggttctcttaagccataatccagtttttctgcaatagtaatctgcttcttaacatttataatgtggcgtttgctatgtttgtaaagctataataacaccacattgctataaagattgtcatatatctgggatcacgtaggatgtatctggaatcaggagtaagccaagaagtctctgatctcttgaagtagttgggcaaacaccctacactctagtgtgaggtgagtagatgtgaaggataagcaacttacatttactgaaggccactggtttgctgggactctgctgcagtactatttatttctcacaatagtcctacaaatactattgttatttacattttacagatgaaaggcaaatactcagaagtatttgacaaggtcagacagctaatgaatgggccaaatatgaaataccaaaacatttgttcctttcacaatattttttatctcatatggcaacatgcatttccctgagaaaagctcccatttggtttttcagtcataatttatttttccttcttgttggtactattctcaaatggctggcctccagttctacaggggaaatattgaatgtagaaaatgttaaaataaacattgatagcatcaagaagttcttgccaatagcttaagagtgagagaggagatagaaaaagtataaaaagcagactaaatttactgattctcataaaaattagaatatgtatctctataacctgagggcattattataatgctatattatttataattgatactcataaatatgacacagtcattaagaaaagatgaaattatgttcaagttttttaaagaaggctaggaaacatgtaactgacaagaaatttcaaagttgtaaaaaatgttttgggttatttgtaatagcagaaaaaattgaaatatcccaaatgactatccacaggagaatggacaaattatatcatagctctaaaatggaatactaagagtagtgaaaaaaaaaatgcaactccatgtgtcaacatggatgcaacttgaaaacataatgttgtatgaaaaatgcaagaattatacatataattccatttatatgaagtttaggaaacttcaaatctgaatgatatattattagaaatacatatctatgtggtaaaactcaaaagaaaaccaatagaatggtaaacacaaaattcagtatagtggttatttcagggctgggaaaggtgagggagatacagttggttagggatatgtacataggacttcaaaaatactacwaattttttgtttttgtaaagctggataatggatacttcagtagtttttatcatcaccattattatttataactcatgtagtttaaaatgtatttctatttatgaaccaaaaaaactggttcttaagagtatattttagttatctggtagtatttagttatcagaaattttccaaaaatgtcagattggtgattcattattgttattattacaatgtaaaacataaacagatggctatatcaggaagcttgcttttaaaataatattcatttatttaaataaagaaacttttctattaaatagagtttggataacagtatttattagatagtttttatgaaaaggaattattcaaaatagaataatcccctaaattatagtatgtcttctaaaaattctggtgctttgggttagtgaagagtaaatttcagtaacaaaacattgtgttaaattttagagaaagcgtcacctaattcagaggatttatatgtcatgattatttaatgttaattacctgagggcattgtagaaatttctgttaaatacctgagggtgttgtagaaattcatggaggacatttttttaccctctagtaatcatgactgagcatctacacattgcaatacttattctattctaaaatactgattctttttttcttcaacctttattttaagttcaagggtacatgtgcagtatacgcaggtttgctacataagtgaacgtgtgccatgttggtttgtggcacagatcatcccatcacctaggaattaagccgagcatcaattagctatttttcctgatgctctccaccctcccttccaacaggccccctgtgtgtgttgctcccctgccatgtgtccatgtgttgtcatcgttcagctcccgtttataagtgagaacatgcagtgtttggttttctgttcctgtgttagtttctgataatgatggcttgcagttccatccatgtccctgcaaaggacatggtctcgttccttttttatggctgcatagtaaaatactgattttatttctccttcatattacagctattatatttatttttatttagattacataggtcaataagctaaattcaataattgaaaagggatattataaaatatttattgtaaaagggtgttaaaactgatagggctaagaaaaaactaatctgaaacccatatggaatatgtggactaatttttctgaagggttaagatcaagccagaaatctctaagaaaaattacatgaagatttagaagctttatgtatttctccactgtgtttttattttaattgcattataacccataattaataatctaatgcagattgacatccatgaataagaaaaaatctattacttttcatttcttgtttatgaataaaaggattcagcttcccttttattaaaactcgagaaggcacatctattttgaaaggttttctaatatatttttcattgagaattttttaatacacaattatttttaatttcatctgtcattttgggagggaatagaatgtaagattctgtttggtttttattgttttttaacaggtggtttgggaacagagtatactctgatgccttgtatcaggatcgctcttttatgcaaaatgctttacttttcctggaaactaatctccttaaaagctaatacccaaatcaaacaatgtacccttttcagtgctgaataaaaatgggtcaggaagggattaaaaaactggcattgcactaaagtgaggcaatgaaagttttacttttcaagctccccttgttatatgagaatttataaattaccagtaatttagcctccattcttctgcctcttcttctttccctccccctatgtaagccattattgttattacatgtatgaaacactgtttttttaagaaattttcccattacatctgttagaaatttagaatgtcaatcagcattgaatccagtttgcatcatctgtatatttaatcagtgaaaaaacttaggctgattttgcattatatttactacttcagtttctgcctgtgtccctttttcattcatctcctttttccttagtgtctgatgatcaacactgtgtccttaataggtgtcaagtttactgaagtgtttgattcaataaacatatctgaaaatctaggtacaaagacttgtaacagttggtatagagttgagtaaatataagagtttgcagtcttattgaaaatccctcaaaataagactaacttagatatctccagtacaaatgaaaataggtatctgactgtggagagagtatctaaactttttgagcttcttttattcatatggaaaatggaggacaaatgcagacctttatatagttttctatagttagttttcagtacaggagataaggtatacaaggttcttagcatagtactgccatgtaggaggattccaataaatggtttatattattggtactgtttttatatttggccattaaaccatgcttattttctccacattatctgtttccctactctgaacctatcaattaaaaagaatatccaagtctctatgtttttgcctataaaataactggattagacttggtgagttttagggtttctttcatctttataattatgtagaactttgtttaaggaagtgggtaccatccgtatacagattttccaagtcaacttagtgtatataagtatttcatatcatctcttcctctcttcaaatgttcagtacttcctccctttctctcttaattcaaagagaaaatagaaaaatcagaaagagctctacatattttatcagtaaacacaccaacatatctgtttctatgtccatacgctataggccctccgatcctattcccatttaagcccatgtctcactgtgcactgcatttcatccccttgtgtcctcagcagtttttcttatcagttatgccaatcagatagcaaaaattctaaggtgactttcactttttaaaatcctcccttacctcacttagccctacaccgaccacgccatttacgtgctcccctttaacaaaactccttagatattcatgacttcatcttctcttcctctactttcttcttccaatcttttgtttaaaattacccattttttaaagttgtaaaagtagtataatgaatacccatgtagccttcatatagaatcaccagtttttactattttgccttaccttccctctttatctgacatacacatttttcttcaaccatttgagagttccttgcagacatcataacatttcaccgcaaaatacttcaacgtgtgtctcctaagaaaaagggcattctcttatataatcacaagccaattatcacctacaggaaatttgacatcaatataataatgttatggaatacactgcctgtattgaaattctcccaattgttcaatagcgctctcactctctttgaatatgcaataaccaatcaaagataggcattgtttttagttgtcatatatcttaagtatcctttaatataggatcctgtcctataaaatttgttttgtctttcttaactttaacattttgaaaaagaatctattctaggtattttacagaatgttctcaatttggatttatctatttcctctattagatgaaaattaaactattggcaagactgcaacagaatgactcaaatattttggccagcatactatagagctaatggtgtatgccttgagtataccacagcagggagcacatggtatcagtttgacacattgtttgtgatattaggtttgatcacttggttgatatggtgtctgtcagatttcttcattgtaagaataccggtttccctttgtaataatagtctctgaggagctactttgaaaccatcgtgttctccagtaagttttcctcaatggttttagcatccgttgatgatttctatgcaaatcagttattacaacggtcattattaaatggtgatttttgtatttctattatgccttgtacatgtatcagttttccttcttctctcttgatcctatgataatcagacctctgtcccatcattctaacaaaactgctgttgtcaaggttactaatgacttctgtttactaaatataatagactagtctcagtccttatcttatttggtgtatcagctgcatttgacaaagttgatcatttttctcttgaaataccccttggtttgcttctgagaaaccagtagaataaccccttatcagtctccttatcagcttccaaatctctaaacattgaaaaactcagggcttagtccttatacctccactgcaaaacaatatatggcagtttgattctttctaattgctcaggctcagaactctagagttatccctgtctctttattttactctctacatcagtccatcagcaaattctgtcagctctgtttttaaaatatgtttcaagtcaaatcacttctcactacctccactgctgtatcttaatctaagcaactatcatgtctagccttgactatttcagtagtgacctagttagacttcctatttaagtcaaataatgtccccaaatccatctaattcaaaataaaatccaaagtttccacatagattaaaaagctttgcatactgtagcccctggctacttctttgatcttctcttctgcggtctggaattcactaactgcagcagtcctcccttatttgcagtttcgctttctgtggtttagttacccgcagtcaactgtggcccaaaaatattaaatgaaaaattccagaaataaacaatttataacttttaaatagcayatcattctaagtagcatgatgaaatctggcacaatcccactgcgttctgcctgggacatgaatcattcctttgcccagcaaatccacactgtgtacactactagcctgatggtcacttagtagctatcttgatgatcagatcgacagctgcaatattgcagtgcttgagtccaaattttacttaataatggctccaaagcacaaaagtaatgatgctgacagtttggatatgccgaagagaagctataaagtgcaagcattaagtgaaaaagtaaaagttattgacttaataaggacagaaaaaactcatatgctgagattgctaagatctgtggtaagaacacatctatccatgaaattatgaagaagggaaaagaatccattctaggtttgctgccatacctcaagctgcaaaaattatggccatttcagtgtcttttaagtgtttggttaagatggaaaagtccttaaattcatgggtagaagacatgagcagaaatgtggtctgattgatggcagtcgggttcaatactatctgaggtttcagtcattcactgaaggtcttagaatgcatccccaaggataaggggagactactgtatacttgttattctctttgtttggaaaactcttcccctagataatccatacaccttactctctcactttattcagatctcaatgtcaccttattagagaggccctttcaggtcagcctatctgtaatacrtttactcttccttgctctttctcccctttctaatttttctttttaamccctaatatagtatatttatttgttttgtgtgtatcacctatctacccccactggaatgtgtactccatggcagcaaggactgcaatatacccaacccttaaaacagtgcctagcacatcttaagcacctaataaatatttgttaaattaactgttgaaattcttagtattctattaatgacgacaagtaaagacaggttggtttttttttttccactttcaatgtaagtcttaattttatacctggtcttttttcctcctaagacattgtttacattgtctcaaagtatactgcagtgagaaattgtstttttctaggttgtataaattaatgggttatttatagtgttgctgctgctactactaatcccagtatgtttttctcagtatttggatatgattccttaaaaggtaacaaatttcttagatgctaacctagttttttttattataaataatagcacaaagtcttttattaaatcattcatttatgaattttaaaggccatcaatacaaagtatttattttactgccctacataattctctaggaagtctacctgtcttatattggctaatgaagggagaaagttctaacttctctgtattgaattaaaagtaaaactagccacatgtttataagattaaactaatgcaaaattttaactcaccaacatcgccctggtattttttttcttctgtttatttggtttctctgtgtatcatatatatgtgggatttaaataataggaagaaatatataagacctcaagtctgattttagcagttcttggtttgtttgaacgagtgaggaaattatcatgcttgttttgtgggtatgcagatacacaaatgttacttataaatgccctcatgctaccatgtctgtgtctctaacatcaggggatggatttcagagaagataatgaggtgtttatattctgtttttttactgggtatccagaaatgttaaattttaagcattatcttcaagagttctcatacacaattagctatttcattataaaattaaatgattgattttaacggtgaacactacttatgactttatgttctcaggatatttttaaagtttacattgtatatgtcatgttgttttcctatgttaattttcaagaagacatattataataactaatatatttgaacttttaaacatcatttttgtagctctcaatttcaaggaataaaaattattttggtgccttttattcctttatgttaatattaccttctcagtgacaggagcccaagtagcatataactgagttttgcattttaagtaatttctggaggtccctgggaaatacagttgtcctgaggtggaagggtctataatctaaagaatctgatctgtgtctttgttgactcactgcattcattggaactggattttaaagagcaagtaggcatttttaggcaaagaggtaaataaagcaatatttcctgaagcagattcctaaaatagtccctaaagataattagatagtaaaaacattcagttgtcaagtaatctggggaaatactatgttattctggattaaacactttctgtactgcaagactccttagcacttttactatgctagtgggcattgcgattctccaaaaaaatagaaaaggtattamttttctaaagctacctgatggtagaactcactatttttctctctaaatatctttttatatctctttcctcttagtatcttgagagactactgttccacaagtgtgaaatttctgaaatattagtattcatgacaaagtaaactgcatgtttaaaacctcagaaagatgatacatcatggcgtgtttgaagaataactggtagtttcatctgaccagagaatgatgagattatgggagtaaaggagtggcaggaagtgagctcaaccagatgatgaagtctcaatgttaaaaatctaggaaggggaacatcacactctggggactgttgtggggtggggggaggggggagggatagcattaggagatatacctaatgctagatgacgagttagtgggtgcagcacaccagcgtggcacatgtatacatatgtaactaacctgcacaatgtgcacatgtaccctaaaacttaaactataataataaaagaaagaaaaaaaaaatctgtcctatcagcagtgggggaaccaatgaagacttttaagaagggaaatagcatgaacacatttgcattttagaaggaatgggcatgaaaaggtgagactttagatctgagtgtttaattagaagactattacaagtgataaataattgtgaactgaagatgtggctttggttggaggatgatgagtggatgatgatattattaacaaatagaatatcaggaagaaaacaagtttcatggtaaaagagttcagtttttggacatgtttggcttgaagtctctggatggcacaggcatatattaagaatgcaattggaaaatctgatctacagttctagagagcagtgtgaactgaactatgtatagttttgggtatcagtatgatgtttcaaaccataagaggacaagagagagataatagacatctttctgataaatgttacgcatcccacctgagtttttctgtggtaaatttacttcaaatccagaatctttggttctgagtttctgaaaatttctttaaatgttatcaaaatctagaaagtatacctttagcaagtaaacatcaggattgctgtgattactttggttatttggtcggttggttttgcgtatgtgtgcttgtgcatgcttacacactatagttttttatttttatttttatttttattttcatgtagagacagggtctcactgtgttgaccaggctggtctcaaactcctggcctcaagcagtctttccgcctctgcctccaaagtgccagcattactgatgtgagccaccatacctggctgtatactatgttttaaatcagctattgtccattacttttgcatttaaaagtctaaacagtgaagacataggagaatttgtatttactgaattaggttgtggccaaaagaagcacctactctgggtatacaataaccattaaggtaagtcttgaatatatatattttttttactaaatccaagccatttatatatatatgttttaactccagcactcccaccacatgacatttccttgaaaaatatactttagcatgtctctcatgctgattttagattgaaataaatatattatcaaaaggataatgtttaataatgatgaaaatttctctggtgtcagaaaaacagatgaaataaatacagaggggaggcagcatagtgcattctaaagtagaaaaaagttatatttatttatttttcttaaaaagacagtaagctttactactatttaacagagaaattgttagtactatgtatatttgggtcctattcaaaatattttactaataaaggatttatgttttctggggtggtaggtgagagcacacaccttgaactgagaccagcaggattcaaatcctggctccatcatggagtaactatgtgaccaaagcaagctacttcattatttttgtttacatttttcatctgataatgcaataacagtacccaacctcattgagctgttacraaaaaggattgatataataaataaaatatgcttagcacatcgtaatcattcagtagtgctaataccagcaaataagaatatccattcagtggacttcatatatacaggttgagcatcactaatccaaaaatccaaaatctaaaatgctccaaaacctggaactttttgagtgcagacatgatgcaacaagtggaaaattccatgcataagtacttattacaaactttgttttgagcacaaaattatttaaaatgttgcataaaattaccttcaggctatttgtataaggtatatgtgaaacataaataaattatgtgtttacacttgagacccatccccaagatatctccttatgtacttgcaaattttccaaaatccagaaaaaaaatttctgaaacccaaaatacttctggtcccaagcatttcagacactcaaccaacattcatgatgagtctaagtatgcacaattgtaatgatctccctcaaacatccctagctcttttctacctaaagactattgcatcagcagttccgtttatatggagtgctttttctcttgtttcccatggctggcttcttctttttattcaaatttcaattcagttacctgctcaatgatggcttcaagattacctaatataaaatattcacctagtcaatttcaaccatattattctattttaattttctccaaatcatcacttaattttttattataaaactcccatcactggaatgtaaacatcactcttgttctccattgtttccagcaccttgatcagggccaggcatataataagtgctttaaaaaaatttgctaaattaatgaactagtctgttgaggttgtcatgaaagaaccagagaaaaagagggagattcaaaatttcagtttcggaaaaaatgccttcccctgccctacctaggccctaaaccagtatacctatttcagtagactcagacctcccaactggtatagtttgagtatagtcttgctattttagatctgacatccattgttacttaggataagatatggtcacccacatgtctcctgtagtgcaagctttctctgcctagccctttgtatctttcccttttcctaaaccctgctggctggagcactgctaaacactactgctggccaggcgtggtggctcacacctgtaatcccagcactttgggaggccgaggctgttggatcacctgaggtcaggagttcgagaccagcctggccaacatggcaaaacctcgtctctactaaaaatacaaaaataacctgggcgtgatggtgtgcacctgtaatcccagctactcggaggctgaggcaggagaattgcttgaaccctggaggcagaggttgcagtgagctgagatagtgccattacactccagcctggttgacagagactctgtctcaaaaaaaataaataaataaaaataaaaataaattaaaaaaataaatactaccactgctaggtaccacccatcaaattagacctatgcggatatcaatactttcccagactgagtcctttttgaatactaatttggatcactgttcccaccccatccatgcctgtagctgggttcattcccagagtctttttctttccaccatcccttgctgctgagatcctaacattctttacagttaggcctgtaaagttaggatccttagaaagggaaaaggaatggtagaactggaatgcaaaactgcctttgcggtttatacagaccctgtgtaacttgtatgaatagccctgcctttgagtgttaacttttaagtttaataaccattctctattttggttattgtcatagtattgagcactatctcatgtataggtaggtgccctaatagatgctattcaatgatgctaattcttacaaagccaatattatggtatctgtcttatgctccattgccacataaataacctctgcaaagcttagtgccttttcataacaattattgattttattcacagttctgcagtttggttagggcttgatgggaaagcttgtctgttctccatacagcatcagcagaggaggcttgacatcttaaagcatatttctgtgttccaagagcaaccatctcaaaagacaaaaattggaagctgccagaaaagagcaccatgttgtttctgtattagatagatcaaacagtcatgaagctgagatttaataacagacatagatgccacctctagatgggaataccatattttaatatagtattaatattgccaagaatttagggccgtgtcactttagatattcagcatttcattttttaaacaaaataaaatatatgacaaaaaaatcaaagaagaaaacctataaggtcagatcatagcggacattagaacaccatgtgcacaaaagaagtatttttttaaaaaatcacttgactctgggaaagttggcatcatttcagactactacagtggcatttaacctaattactgtgaaacatcaattggaagccaactgaggattacttgaatggcctcaaaaagttaacaaaactattaagacaccttactgttgttaacttaagcctctgaaaaagagggaaaagaagyaaatacctaactattttctacagttagcctttttgttttaaaaacatttcagtttggtcttgtgggcaacttagacaatattatggacttaaaataacaacaacaaaaacccaaaatgccagagcagagtaatgtttactttgtgtggtgtaaatggtatttggatgaaatgaaaatatatgtgttcaattaactgtggattctggtattcggaaattaaattttttttttcatcttagagaaaaaaatagcaggaataagaaggttttacaatttccattattcactgtatgtaagctcttctataaacaaagcagaagctttgacctggtaagagatgtgattatactttcttcaacttttgtccctcaacccaacatcttgcctaaacagtttttagttattgactttttaaaagaagctttagaattagatatggaagggtgaaaggtgcatgatatttttagtcagcatctgcagtactataacatgaaagatcttcccaatctattttcatttctttccttctggataatccgattttgcaacaaattgattgctcaacctctccatgtcacttttcaataaaatcaaaaaggttgctacagtcccaaggtggggaaatggtctctttctggaaagggtgagacccaaaggtcagttcattaaacagagtgacttaggagacctctaatgccttagcaatatattctaaaatcctgacattcgaaacttaaattgatccttttcattgataagtctgctcttgaaaattttatttagaggaaaaactgaagtaaaatacattttatgattgactctgaataattaaatttttccctaagatataattactaggraatcactcatttccctgctagaaagcacctcatttccttgaacgcacgcatatgaaaaagacaccagcattgaaattctgacatcacaattaattaaaagcatctgtttaagacagacataacagatcatattgaaaagaagactgaacctgacattagaaatcctactttagagtcccagcttcaccacttaccagttgcatgtctttgaacaagtgcaaagtttgagcaacctatttagtgatcagtgtcctcatttgtaaaataagaaaaatgtcatctaccctaacaacctgacagagttttgaggttagatggtgtatcaaatatgcaagtgcttaatatattgtaaagcatcatataagcagaaagtatccatcattttaggaacttcaatgaaacatatatggatttttgtaagttgtggctgttaaaatttcttttaagaacattgtacaatgtgattaataaaatacattttctaagcacaaatataatgttttgtactaattaaacaaactatatgctcattaaggatagaaactaagagttatatatctttacatctctaacagtttagagaacagttctatataggccaagttagttgtttgatgtgttgaatgaatgattgagaaagatacttatgagatcattattcctcaatttggaagtataaattagccttttttaacattatgaattccaatgaattctgctgtctttttagttaattatttaattattgaatactctaatagtatatataacaaaattataagagtaaaaatgccatcacactgttaagctgttgatgatttcatagactgaactgtggggtttgtgaatgggggagagtatcagattatttgtatccactgttacaagaaaattgtcacattgaggtcagtgcagctaagaggattagtgatagtagcctccaattggctttaaaaatgtaaaattaaaataactattctagatttttagtgttttcaacaaggtatcgccaaaatttaaacaaagttgccctaacctacagtgtaaactttatgttgctgactaatttcatgtattttctcaggagtttctttaggaattctgttcttccattctagcttttgaagtctacttacacagctttaaatggctgttttgttattctctcacaaaagttttcagaaacttttctatccctacttaaaatactgttttatagttgacttcttttactgttttgacaaatgcatgcatagcatcgatatctaacgcattttcacacttagtacctgcaaaaattagcataatgccttgaaatgcagtttgtcatatttgcagagaaaactcattcattaaacttttattgagaaccttttatgtgcttatcagtctcctggtaatcttttcatttaattggacccaagtttatgcagttccaggaaaaaatattcatatctatttcagggagacagaagcaatttcagctaacggttttttggggagttattttaatgaattatacttaggtttcattttataataaatcatttcactggttaacaataatagactttatagtataaaagatttgttattttgggtagtaacaaagagcttgaaaaagtaacttttttctcttttgtcttgaaaaaaattgttattgacaaaagtrgatgttttaaattcattctggaataaggaaaggtgatgggattcctaaagttttaaagcaaggagataggttttaagcaaagggaacaaattatataaaggaactaattcataaggtgtgagaaattcaaagaaatgtcacttgtgtagagaggctggaacaatgggcaaatatcgaaagtagcagatgaggttagcaaattaatcagagcccagatcatttaaaggccttgctttcttgccaagacatcaatatttttttcttaaggcagagaggagcctataaaggtatttgagcaaaggagagatactttaatgggtacatttggaagggactttagtaatatactgaggaaaagcatgctcagtgattagctatggaacaacgagacagaatgtggtgagcatagtgcatcaggggtataacaagggaagaggagcctgagaaggagagtgaggagaatttaataggggttcaaaagatttcttgatctagaacaccrgggttcaaaatggtttaatgagttcaattgattccattttattttttaattaaatcacttaatggcagagagcatcaattggggttcaatgctccagataattttatggataatcctatctaatttgaagatatactatatccagaataaaaatgatgcagactaacattataaaagaacaccttagttggtaataatgtaaaattaacagtgctgtctattcagattgaacttgtccctaagcagctctaagtacattaaatatgaaagcaaggccatgttttcggtaagacacagagaggcaaacaacaagcaatgtcatttcctatctggcactgtctgcctgtattttcacgtcaatctgatgttctactacttcccccattgatctctcatttttaggtgcaagtgagttaattgtagttttctcctaaatatgtcatattgttcttggtatgccttccccatccccattctatctggtaagtttctgatcctccttaaatgcccaagtctctgtaaaggccattctaatgtctcaagacatttctattttatcttcaatgcacatacttttgcacataattaacacacaccttcttcttaaataccgttaacttcttaagaacagaaactatgtcttcttattcatttctgttgagatgcgtcctctgcatatagatgagtattgggcatataagtaggtatcttacttattgttccaagcatgaaaaccatagcaactgtggggatagaacctcggctttgctgttgattgccctataaagcatgataaatgaccattcatcagcttgtctttcttaatgctgttaatcagacctcttttgaaaacattaacatttgtggttgtcgtcttccctctcacctgttcaaggttctattagtgccaccttgtctattcaattgtcttataccttctttaaaagagtggtgtatacaacattgatctctgttgaaaaaatttgcttttgctcttgatttttttaccttttcggtgtgtttttaagctctaaacatagttttagccttctttgtctccatattaaaaaaaaaacacacagaatactgttggtgtgctatatctcaaacaaatgttttgaaaacaaaacagcaaaagaatatttagtaaagacatctaatgagtatccrtgcactcttttataagtaarttataacttgtaagatacttgttattttaagctaagaaacaaaaaattaagagctgcctgatttgggacataaattactacactgaacatgtgtgctggtggtacatgtacacattttccagtgatttttttttttcattatttgatgctttggatgaaccaaaaatgctggtgttttaacatggcttcccccttgcttaaaaattggctcctttacctctgtactttcttttctggcaatgcaaaccacactgaagtgtctaatcaagtacctcctaactggaattagacaaagaaaaaactcatttgcagaagaattgcattgcagaacaaatgacatcatttgtattaaaatattctacacttagatttctttttccgtgacactagagatccatcatttttagtcaagctaaaaatagattgtaattttatgcttgtaaatattgtctcaggcacaaggatactgaataaaaatagaaagtaggatttgatttttaaattaatactgtatcccaaaataccacttctttaccttgttgaatatatttgagatcctgctcatatttcctggagcttcgtaatatttataaaactagaacggggaaagagaatgctttattagaggcagcttttccataaagcatctgagcaccatgctgctgtatttttagctcaatctctgtgaatattatgtgcagcgtatggtctctcaacttaaacacaaccctgaaaagtacctctttgctttcagccttcatttctacatgtatttttttatatgcaaagatgcagtattagcaagaaaaacagatctctatcagcatttgcttttgaaacagacctaaggaagttaggtaattctaaatttctaattaaaaatgtggtatagaacttgatattagatattccatttaataatttttttcctatctccttattcttaacaaaaacattccttttaactttcttttatgaaaattctttgactaaggaactgttaagaaatctacaaacagagcaaagacagaaatgctcgtgctcattccttacttcatggtggctccatttaatggcagtattttttactctaggtctccgaagagcctcaaagtactcttctttttgccttctgacacctcctttcctcccctcttcttgttcttattctttctactgcaaattaaaactgcattgccataaaaatataaggcatatttagatgaatagaaggatggatagaagtatgataaatcaagtatagtaagttgttaatggtagaatctaggtggagggtataaaggcattcactctaagattctttcagttttgctagatgcttgaaagttgtcatgacaaaaatctcttaggagtggttacccatgaagggtgggattacagcttttacttcttctgtgtttaaatattgtacacatatattattagagaaaaatgaagatagttcttttaaaagctacatgaatctgtcatcacaaatgaagtcatcagagtattgacttaaatattcttcatatttgaaatttacattcatccatgctaaataattaaggatgtgacaaaagaatcagctgtgtatgatgctcacatcattacaataggaaattgggtacttcaattatagtgtatatatagtcaatggaatactatgcagccattaaaatatatagataggaagcaacgcattgacatggaaagatatttacaatatttcatattttgtaatataacattttatattttatacctagctagaacacataaaatttatgaatatmattgaaagtaaccatacatgtacataaaatgttatcgctgaattatgatgctataaatttttttatatagttttttatttacatttaaaaatctttcctaaaataatattttcctgtgctttttaacttagtaacataagagagaaggaaaacagaaaagagaagaaaagaaaaatgtcatgccatttttctgggaaaaaggagcaaggaaaccttagtatgtttaattttttatcaaaccaaaaagattatcaggattttcccttttatctatatcatggaaatctggtgtcttacattttcttaattttgctcttgtaaagaatgcacttgaaatatgtacaaacaaataatttcattcattcttctgaagatatttttatggatttgactagcagttttgaaaggaaagttaagatgtttttatgttgtggggccccaggcatttcatacttggaaatgccctatcctgaatctctaattgcattatatttctgtctgactcatgaggaaaggaagcttcaaagcagaaaacagaaaatccaatttctccctaaatacagtaaccattgatatatttcagacaatgtaacacctgtgtttcaaagtttcccagtgtcctacacagaagaatcaagagttcaaggatgtgccaattaaacaataaaaatatttttacttattatggatctctctataaggagattaagcaatgtgttgaaattaggtactctttacaatatgtctctgaaaaaagataaagggagaagacaattactgttattttttccattctgccaacattaattggacagttggtttatgaccctaaacttagtgtttcagttattgtttccatgctttaaaagacatattgttccccatagatttcctttcaatggctattgaaggaaatgttgaatagacataaaagtaaaacaagcaaaaataaagttcatctcgggttctagtcctcctagtcctcatagtctgttacatggaatttatcatttattattttatatgtatgtatgtatgtgtgtatgctcctccccctcctcctcctctatgctggtagtctattttaagcgtgtcttcttgttccctcaaaatatataatgttttgtgttcttcatttcttgtctttctcaggtaaaatgtccagtgatcgagctttgaggaagcagcaacagttgaacaaccttgtctatgtggtaacaaatcaggccaaacctggtgacagaattgtggatttctgcagcggtggggtattttatctctcctttcatcctttttagtctttctaagattatgagacttttctatattacattcaaggtcatgtttttatttggcaagattgtggtttcagaatgaggaaaagctgtggggaccaaagctaacttgtttgtcttactgactttttcagggccatgttggaattgtccttgctcacatgctgccatcatgtcaggtaaagccagaataagagataaaaggaaatattttaaaattatacagtkcagctagccaaatttggtttatcccgctcttggagtttctagtcactcacccaagtcaaatatgtggcacaggcattgtcttttctttgaaataaactttcaagactcagaatcttaaggaaaaaaaagtaaagtaagatcataaaacatttatcaatttttaaaagaggtttataggtttaagtaatttttcaaagaagtagctattttattgctaaataaaataattatgattcaactagtttaattttcaatataattttaaatggaaatattgacctctgaaacttgctgagcatattcttttggtatcttgattttgatccattgcatcaaaattataacaatagcaaaattttttaaagcaaaaaaaaaaaaaacccaaaacctaccatactgatccatcaaatgctttgcttttcttgttctcattaagtcactgtccatagggatgctaattgttgcaaattttaaaaatgcaaacacaatgtatcccttgctttcactcaatattgtatcataaatgtttttccctattgctaatagttttacgtatcatcatatttcggagactaccaaatatattttcaagtaaatatatcagaatgtattcaatcattgccacaatttgttagaattttgtgctgattttagtcttctgccatgttaaatcagttcctcactgtgaccacttcttagcataaaattctgtttgtttttgttttgtttttaatacaaactcaactgcaacagagtctttgcttgtgagctctctggaaggtgtgaactagttatagtgaatacttgcggaagaaaaaaaaatgtggaagaactaatagactggccagaataacatgtaacagaatgatgacgaggggacagggaatagcattcttttatttttcttttcttagagaataaacgggaaaataaataaggaatcctgggagaagaggcagttgtttgttttattattaagtaaagcaataattttgtgattgagtaggaggaagagagctcacagagtaaaattctgagaagcagagtcagggatgtaatattttttcttcccttattaatatttctggaagtttagaaaggttgaaaccaaaaatgagtaatcttgtctagaataaagtcaggaaagcctttcacaccaagtatagtctaacaggtttttcaaacggattttttcttacagacaagcataagaacaaaataagaactaggaatgatagtgatgaaagtgacttaattcttttcatttttttccattcaaaccatcttctctgcctagattatcactggagtctcctaactggtttctctgccctctggccttgttgccaccaatccataccatacattacagactactaaaacttcttttatcataattgcatgatctggtttcagtttacctctccagcctcattttcaccctttacaccctgtccccccatcacyactatcaccatgacacacattgtgccctggaaattgcgtaccaattttctcagttcttcaaacrtgccatattctttctcatcttgggccttcatgtgtttctctccctaaaatacycttccattccccccaaaccgatttgtattcattttttaggcctcagttaatatgttacttccccatgaaaatagtcatcaagtttgaatgctcccattaacattgtttgtctttcatttaaygcttatcacactgtattattattatttttgatgttttgtttttggtttttttgtttgcttggttggttgattggttggttggttggttggttggttggttggtttgtttgtttgtttgagacagattctccctgcgatgcccaggctggagtacagtggtgcgatctcagctcactataacctctgcttcctgggttcaagggattctcctgcctctgcctcccgaataactgggactacagatgcacactactatgcccggctaatttttgtatttttagtagagacggggtttcaccatattggccaggctaatctcgagttcctgacctcaagtgatccgcttgcctcggcctcccaaagtgttgggattacaggcgtgagccaccacgcccggcccacgctgtattattattgcttgtttcacttatatcactatgcttcaaagctatatcactatagttcaaagacctttcatttttcctttctgtaccagattatgtgacatacttcctgccacagaatagaggctcaatataatacgttctacattattaaagctatgaaatatagtgataatgctttgcctaatgtctgaattatgttactaaatatactattgttttctgggtaaaatctaggttacattaatagaaaacaaggaattatcattaattcgtgctaagaagagaagtgatgaactgggtttaagcaacatttggttcattcaagcaaatatrgaatattttactgggatgtttaatattggagtaagtaatcaagtaatttcaatttctttaattagctaaataagaaaaattacatgccttagagtaaataaaaaagataattttgtgttctttgccaaacaaatttataattttgtatacttatattatctatgaaatatagcatattaatgaatattattatattcatagcacttcatcattacataacagagataacattggctcctctatcagaccagaactttattttcttcactacagaatccccagtagcaagtgctgaaaactggttaataattgaataattgattctgatgaacatgacttgccttggtttattctgcatttttagaagacaatgaaggaaaagaaaaaagaagaaaagaaaataacttgttagtaatctctaaatacaagcattgccttgtgattttttttagctaagattttatatttacatgtattttcaggttccaagagagaaagtatattgatcatgtttctaaacctttggatcaaattgttattatttgatattatgaaaaatccctaagatatgtaattctgcctgatcattaaaccccagggttttattattttttgtagactttgagttttatgaacatgttagtgttgctgctatttcttatatttgctttaaataattttttttctgattttgataggaatatacattttgatagtaatacagaaaaatacatagtaatataaagaagaaataacctatatgcctactatcaagtgataaatactatcaaaaatctttagttttttatatttatgcacgcatataaatgcatattttacacatatgtgaacattgttaagaccatactacatagatcctgcattgactgaatactgttaaaaatcttttacctactttttaatcatacttttttttctcattgttataatgcaattattactatgatggatattttatgcatcctttaagaattttgatgcatttgccaaaccactttccaggaaggttcttactgacatcctttctaattacatatgttcatataaacatgtggttgtctaggtagaacttttatcaacttaactaattcagaccttttatagtatttctgatttttacccagtgaaatttatttcttaaatattgactactgcaaatttgggggtttattgtaatttttttccaacctaaaaaatatgctattcgtttcctttgcagacacgatctacagtttacttctctttttataagcctggctgttaataaggaaattcaggaaaatgtagacatgtaatctagaaaattcaaattaaaaaatacctgtgcagctttaactttacataaatgttgaggtaaagtttagcgcttctcccatgaaacaagccattaaaccagtccagatattaccagtacaccagacagaatggtagcaagtaaatgtggactgctacccatttatttacctcacaaagcatggaatttccagcctatgtctgttccatccgtctcttggcccttcatgacttatagatgctaaatcactctagcatattcttgtaacttccaagtgtataatttactaatgccaactaaaaatgtatatatctctttggaagtgaaatttttctctacattttgtaatacatctataatgactttttttcctttcataattacccttgtcaaggtgtatagaaaatggattaaaattgcttagaaggttaaattaaaagtagattcactctgaagagaataatttgcctaggagagtaattgagatattgtcactaggtaaattagactaaatgcatcagaggttctaactcctgtgttaaatgtgttccagtatacacacaaaaaaatttaaaaaatattgtggctagagaggaaagcagaataaccagatattggaaatgcattaaaactgcataaattcatggttttgtgacatttcaataagggcttagttagcatttatctttgcttagtaaatgctttatttttttcatttactatttttctttagatataaaaattaatagtataaacaagattttaatgaaagaattttaaaagacttagaaacaactaagtctttttaaattattaaattttataatatgtgtattaatacccatgctctcaaacaatattacaaatatttatttgcaaatagtattacataaagggtcatgactatggaaaaatgctcattttgcattaaaaacaaaaaccgtatcaaggctaaacagcctgccaccaacatgtttagttggaaaatttcaacaataacaaacagtcatttcaaccagatgataaggtactgatttctaacagtattggcgaatcctttctgttcatcaacatgtatatgaaaatctcaaaacagttttattttctagttattggtatttgctttttgctattttgcccacaacataatttttaattattgtttatcactcataagtgctgactagttaattataagctcatttctatttatgtatgtatgttagtgtacaattaaaagaagcatgtgtaattatagactgtaattcagtaacatttttgatgagtaattatataatccttgttttaaaagataaggaccttgagaaattatatattctgcaggcacgctttttaaaaatcattaaggcaaaataggggacttctgagatgaaaatagcagatagaggtatttcaaccccgcttctccccaaaaaagttcagatccccaaataacaagaacaagaatcagaaaaatcaaactctatgatgaagctatattcaacattctgtaacttgaatcacaatatgaagtgtgaaggtgaaaagcagattgaagaaaaatgataagttattgagtagaggagaaggaagataaaatttaaatgcatgccacgcagagtggcaagaaggctatcaggacacaaaccactttgctcccacagaatcccagaaaagtttgggaattcagagcatcagaaacctcagaggaaatgaatagggagggactgaaatcgtgtttaattaaaaatattatttagagacaagattcctgctctcatcttgtgtaaacaagaaactacctctccccaactcctaagagagacaggaagtttattctgtagaagaaactgaaccagagaggcaccaagtatagagatatcaggcatagagaagggcaatggtgatgtgccataccaagaataagaactaaatgagaatctgcatactgaaggatagatctcttccctatccatctgccttctaattccagaaccacagaaaccaggatcatttccacaatcatgagaattaaaagattcttctctgtagaagcagaactgtccccagagaaaagaactacagatactacagctataattaaaaaaaaaaaaaaaaaaaagaaaggcacctatccaggctttttgatcacccaatcactggtgaagcccaccagttttcaaagccttactctttcattcagaatttccaatcaactttttagtggtttactctttaatatgaacagctaaaggaataccaaacatggaaaacttccaaaatggaagatagagacctgtattagtctgttctcacactgctaataaagacatacccaagactgggtaatttataaagaaaagaggtttaattgattcacagttccacatggctagggaggcctcacaatcatggaggaaggcgaatgaggagcaaagtcacatcttacatggtggcaggcaagagtgtgtgcagggaaactcccctttataaaacgatcagatttcatgggacttattcactatcatgagaacagcatgggaaagacccacccccatcatacagttacctcccactgggtcccttccatgacatgtgggaaatatgggagctacaattcaagatgagatttgggtagggacatagtcaaaccatatcaagaccaaagcaacaaacataatcaagggtcttagggagagactaaagaagataatacattagtgaaacaaggatataatagaaaaagagggaacgatcagagaacaagaaaggacgtcttgaaaaayaaaaatgttagccaaaattgaaaacaaattaaaaattaagagataaagtatttttttaaagaagtataggataccacttgaaaaaaatagaacttaaaaaaaagaaaaagaaaaatgaaactggaaagaagcaaattttttaaattagagatttagtccaggaatcaaatacctcagtaatagcaggaccagaaaaagaaaaatggtaaatcgtggggaggaaaacatcaaagaaaatacaggaaaatgtgttaataattaagaatgcatttcttttgataaagttaacttacaaaatggcctaagccaaggcaccttgtgaaatttcagaacaccaagggtgaacagattttcccaactgtttccacagagggaaaaaaaaatagtgatataccataatttagaatcaaaatgctatcacacttcttaatagtagtgtggaaggctcagtgacagtgaaacaatatctcgaaaattctaacagaaaacttctaatctaaaattctatacctagctaatccatcagtctagtaaaaaaaagtaaaataaagaaaaattcgacagtcaaggtctcaataaaatgtacattgtacataccccttttcagcaagctactagataatgtgcttcattaaaatataaagtaaataagaaaaaggattaagtggtatccaatacaagagaaaaatttttagtatcatgggagagggaagtcttagggcaagagctgggcaacaggcctagaaagcattgagtccatattttagtaaaacrtcagaaagcccaggaaagatgtctctaggaaagaaaaaatggagctgaccaattatttgaaagttttcaaacagtggaaatttatattgtagagcattttacagagcttttgggtagggaacaacttggatgttaaaaaaacaagcagaaaccctgatatccagcacacttccctcggcagtgaacagtatatacaaaaccatgagaaaagatggaaaaagggaagatagtgtataaatgtgcaaaaaaaaggccaaaagctcttctctcctagtagaaagataataaataatgtctaatatttacaaatcaagagatatcaatatacgttcatcatatagaaaaacagattttcaggaagtaaaccaatgagttgaacagcattgactttggtacacagattttctttcagtggtgtggcagtgtgtacaaaacagggacttttaatataattgcataccttttagcattatttgaattttaaagctgattacctataatattgttgtatgaaagttttaaaagaggggaaacaagagtacacaggtgggactagcctgcttctctgtctaaggtatctagagttaagaatccttcttcgaaaagcaacaccggagagaatgattgggctggggcaagtttagagatcattcagttcaaccttctccttttacaggtagagaatttgaggctacaagaaaggaagagtgacctagcaagttaatgtgggggctgggtctagaagtccagtcagtgactctctgtttacttccatatctaaagaaaagagtaaatagagcatagagaactaaaaaaagaagtttggtttggagtcagacacattgagattaaatcttggctctttgttaaaaaaaatattaacaattatttctcttacttggagcaatattgaccaatttttgtttaagaactctttgcttgtttttgtttgtgtgttcacatctcttgctcattttactctcactttattgggctttttctttctttttagaagtttgttatatattaagaatataagccttttgtttgtgctgtaagttgtcaatcctttccctactttgtcatttgtctttttacttatggtttggttttctgccagtctctactgaaaatacaaaaattagctgggtgtggtggtgggcagctgtaatcccagctacttgggaggctgaggcaggagaattgcttgaaccctggaggcagaggttgcagggagtcgagatcacaccgttgcactccaccctgggtgacaagagcgaaactgcatctcaaaaataaataaataaataaaaataaattttattttgtcagatttattaaccttaccccttattgcacgtagatttttagcttagttaggaattacttcccattccccttggttgtgcaggaatttactcatatttattgcattttaaatctctaatgcattcaaaatttatttcctatgtgtgatgagaggaaaagatctaatttttatttttttatatggctgtctggttaaccaaacattacttattaaaaagtccatcttttctccctggtttgaaataccacctttattgtatgataaatttccatatccaatggtttttttttggtctatatctctcattatttgcctgttatttctgagtttcatttgataacagtgaaaactaggagcatgtgatgcagtaaaaccttttcgaccaaaaacctattattagtagacaattattacattatctataaactattgtatagttattcaagttacttatttcatttaaatgaaggaaataaactcacttttttgcatgtagtgtaaggaatgtgaacctaagtaaagagagacttataaaagtaaattttctaaactcttttttgctcagagcctgaagagggttttgtagagaagccgcctgatacatggggtcaggctttgaggtcagcatcctgcccctcagtagctgttttgttgtgggcaagttcttaatttcccaagacttcatttcctcgcatctaaattggagataataaagtctttcagggatgttgtgagcatagttctgagtgccatcacccagcacagcatagtgccagcacataaacactcagtaaatgtcagtttgctttccctccaggggaagatgtgtctataatttttactatgaaattttctccaactagtcatgaaaataaggattagcctgttttttactctgaaaagctgactaaaagaagcagatgagaaatcaaggttatttactttcccattccctgtagttgttgctgcctttactggataccagccttcctaggctgttttcagagtgaaacaagaaaggtgggatgacagcaacatggagattgttgacttctatgtggctcatgtaagtctagaaggaggaggaggaattcaggaggaggattaagaacagagatcttgctttcctcttcctgatagagtattgtttgtattgtttttagctttccagttcaaagggggcatctggtttataatattttactttcgctgggsgcggtggctcatgcctgtaatcccagcactttgggaggccgaggtgggcggatcacctgcggtcgggagttggagaccagcctgaccaacatggtgaaaccccatctctactaaaaatacaaaagtatgcaggcgtggtggcacatgctgtaatcccagctactcgggaggctgaggcagaagaattgcttgaacccgggaggcggaggttgcagtgagccgaggttgtgccattgcactccagcctgggcaacaagagcaaaactctgtctcaaaaaaaaaaaaaagtttctaaaatttacagaaaatctcctctttaccctgagagcccctccctaccctgaagttggtgagggaagattataattcattacaatttatgtttgttcagaatgaaatggagatgtgaggggtttttttggtgttttttgtcaaaatccagtacaggttattcatcttttagaatccccacatctgattttcactgagagtcctatttaggctttatttggcctaagaattttcataattatctcatttgtagtaagattatagtaagtatagatatacttaaggatatgtgttttaaaaacacttaaaaatcgttttgagttatttttatgagttattgaagccccactcagtattctaattcataatttcattcaatccttttaaaataaactcattgaaaatagttcctgtaactcatcattcaatgttaaggattgttattatgtgaaaacatcttaaaagggtactacatgatatgattcagttagttttaatacagccctgattagattatgttaatatggcatttgaggaagtgttttcaaatacatttttatttaatttttgcaacagcattgtgacatgtcatattgttaaccatcatttatagttgaagagattaaggcccaaagaagctaaattttaagtggctcagggttatataggcaaccagagtaatagactcgaaattcttgtttcgaatctagtgttcctggaacgatgctatagtttagataaacacttgtgttaatttttccacactaaaattgcatcaaattttccgttgaatgaatcttatgctttatttgcaatattccatttgcaacctttcaaacttgcttagttttcataattaattgatatgtgtagctaagtggtcctttggtatggccaaatgagaactatttaaaaggcataaaaattgcactgtgagttaagagggaacttagtgctaaggcctggttttattttgtaggtagcattgcatgcttgtggagtggcaacagacatggtgattgagcactgtatcaaaacacgggcttccttcgtcacatgcccttgctgttatggtttcattcagaacacctcaaagttcaattttccaaaaaggtgagaaattcagtgttctacataagacaccaacatgggtataagccaggacacaaaacttgtttgatataaagttgcaatgacttaatttttggctcatttcttctttccacaatgccaaatattgtttgtaaattgtataaggaagagaagaactcctttatgtttgtccctgatttttcccctggatccagtttttactgaaatttagaagcaaggctatccaggagacaggcaactagaartctattggctttagcacttctctctgtatttccgaataaatttaaaactgtaaccgtacataatgtctatgagaggcagtcaagtatagtaaagtgtttaggacctggaagtatagtgcctgggggaaaatactagctccttatcattttataaggcaaattacttaaaatctttttgccttagttttcttgtctacaaaatgagggttatgataataactacctcaaggtttttgtgaaaatttaatgatatgtgtaaagcctttagaagtggcaagaataagtattcaataaatgtgaactgttgctaataatggtagcaatgtcacaggatccttggggcgtcgctttgccarctggatcctctgtggttggtggagcgtttgcctgagttttgcttgggcccattgggctcactccactcactcagcctggcaggctgcttttggcttgcactaccagcacagatcccacacctgccaagggtgagccaggtacagagtggtgaggggtacatgaatgagcaagcacagggtccggccacttcacacagccaggcatgctggctgctgtggggcaggcatctccaggcaccagcttgggtgctggctccctgcgaggctgcagctggaccaggtgtactgcaagcagcttccactgtgagcactagggaacacagtggcaaccagaagcttggaaacgccaggagccacagaacccctcagagggtatcacagccctggctcagggagctcctatgactgggctccctgaagggccgcatctcttctctccttctctcttctctccttctcatgcttgcaacatggcgagtgggtgtatttgggggcaggggggcatgtgagccctgtttgtgttataactcttagtcctgccatttggcaggtcctgagttcttgtcccaaatcgaggaagaatgaggtacacagacaattggaggatgagcaaggcaaagaggtgctttattgagcaacagtacagctctcaggagataaagtgggtagctcctctccacagacagtcatcccaatgtctgctcagctctcagccgagaggagacccacagagggtagcttctctccataggcaggtcatcccaatgtctactcagctctcaggtggaaggagacccgcagtgggtagctgctgtcttcaggcaggtcatctcatctcatctcatctctgcaaccctcagcagagaagagatccagagtgggtagcttctttccgcaggcaggtcatcccaatatctactcagctctcaggtggaaggagacctgcagtgggtagctgctgtcttcaggcaggtcatctcatctcatctcatctctgcaaccctcagcaaagaagagatacagagtgggtagcttctctccgcaggcaggtcatccattgtctgcctaagtctggcagagtccggggtttttatggactccagagggaaggaagtgcatgcgattggtccatgggtggccatgggtgggcctggaaaaagcactctaagttctcactttggtccacggagctggcagcctggaccccaggcttcgggccatttctgggttgatggtggggcttcaccagggacctgcccctttctacctaggagcctgtctgcctcctgttgccatcaacctgccatccatggtgcccatggcacccaggctgtttgtgccaaggggtgcctgcaggcccatgtcaagctgccctcagtacccccttggtgtccatctcatgctcgtcagtgcccaaagtccagagggggctgaggcgggggtgggggctggcatgtcagcaccaccttgagtgcacacacagctggccaggtcaccacagtgcctgggctcagcctcaacttttggtggcctttacagtatgttactaccacttcctgtctttttcacacctatgtagatttactgacatttgtcctcccttgtcctttgaactgatatctttagaaagtttctttgtgaataagacctatctcaatcaccaaaaatacagttgggaatttataaatagcatactgtttctatagtacgtggaaagaagtactcttttcaaacaaactaattggcactaataaatttagtatcaaatgtataagtcaatgtttttgaatgacttaagagtgaaggttatagcattaataaaagacaatgtttatggaattgaatgtatgtttatctttattagctgtgacaacagtgatttcctgatgtattaatcatgcctttttaaattttctgatgttttactatttgctaatcctggagagactgttcctcccagggctagccaattcctagagatagtaaaggtcttatcaacaaacataccttgcataagtaaactcaccaacccagagcccttatcccacaactacctcctttatcaagctcttattacttccaggccactatccccctgccctactaccctagggccagatatcaaacaagtaggaacggccctatgcctgagttcactgaaattattcaaactagccactcccaagcctgcttacctcacctttttcttcccatggaaaccgcctcctgacctatactggtgtttccccatgtggcccttcatcacatggcatgccccctcttcttggggaactgtgagtaataaagtatcttttcaatggcagtcctctcctgatctgttggctgtgcacatctgaataacagtaaaacccacatgttaaaacacctggatcttagtgttcccatgagggatagagacaaaaaaggtgcttctctaacagtgtaaacaatctgtggaatagatttcttaaaattaataacatattgatgatatgcttttctgtctttttataaaagcatttcaaactggcatagtttttacttcaccatagcattttatgctttctacatacaaagcatatttttatataatttagtttcttcaagattatcttactcttaatatttagaatgatgactaattccttttttttctatttcagtgaacaattcaagaaaactttatcatacaaggtaaccttaaaaagatctagatatcatcctaatacactttttatcctttatatttttccctctcatatttctagtggagtaaataatctatagttataattgaataactcatgaatgtctaatatgggtttctttttctctttcttttgcaaatccagattaactcttcaagtaggtaacaagatttgtgaagggtctgagattttaactctacttgcagtctaacaagttagcctgcccagtggatgctggcagaagatatgagacccctaagtcagagacaaaagacagtttgttgctcatggcaatagtggtagccacaataccattgttttcacactgactctctatggcccaattcccacagggcagaagcaaatgggccaggtaacacctgcccttttgttccagagggagaaactatatattttccaaggctgtttactctgtaaacgtgcttgaaaagataatctataacagaggaaaattcttttgtaaaaggtcagatagtaaatattttaggctatgctggccataacaaatctccaagtattcctctcattgtccttgacattcttattgtttttgttgttggtttacaactctttaaatatataaaaactttcttaattcacaagccacacaaaaactggtcataggctagacttggcctgtgggccaaaccttgctgaccattggtctggaacaaagacagtcagtgtctctgcttgtaaaacatgaagaaacacaagagacccacagagaattgtcttccaaaagtagtcagaacatacatagtttttagtcaccaatctgatcaaaacagtttctagcttcctaaacatcaccactatccaattaactggtcaatagcatgatataatacaatttaagaaatgataatatttgagaaaaatatataaataattccattagaagttgacaaattcatttggattcttagttaatgccactttttgcacagactcactaaaaacatagtctccttttatataccagcccctatattttaggacttttactttctcttccatcaaacagttgaaatatagtgaggtatagtgacctaaaaatgttcattgttaccacatcagcagctgtatctccttcattcctgctttataactcaawtgcccacttccagctctgtctcttaccaccttatgtgctactcacaccttcccctcttcctaccaaccccgcaccctgtacaaatatgcacagatatggaaaggggagaacttttagtgttcatgctttcagccaaaaccacaacattgctggccttcacctactagattaaaagtttacatattttaggaaactgtatgattttggaagaaacattaggacccaagaaactttatttgcataacattcaaaacatctcacctttctttcacaaggctatgtcaataaagtagaaaataaattgagaaaacagcccaggtgcagtggctcacgcctgtaaacccagcactttgggaggccaaggcaggcagatcacttgagaacagagttcaagaccagcctgaccaacatggtgaaaccctgtttctactaaaaatacaaaaattagctgggtgtggtgacacacacctgtaatctcaattactcaggaggctgaagcacgagaattgattgagatcaggaggcagaggttgcagtgagctgagattgtgccattgcattcccatttcagcccgggtgagagagtgatactctgtctcaagaaaagagagagagagagaggagagaagaaagagaggagaagaaaagaaaggaaaaggaaagaaaagaaaaaagaacttgggaaaacaaaaactagacccctgtttctaatccctcctttgagtgatgctagttaaaccaaacaatgaaaggatgtatggaaaaaatcaagggtggtgaagagataggctgcccatggtctcctggctagaaaagaatgtaaaatttctacagtagggacagggcacacagagtctttcagaaagcagaaactccccagtacaccagtcataacctttatctactctttctccaacacccccaaaagctgcttggccttttgaaggcctcagaactttgtgccaaagtatcttgagactcactttggaagtgtttttctctgcagttcaatttagacagcaacctttactgagtacctaccatgtgccttgccctttcagaacttgattttgaccaaagagaacatacacacaaataattccaataaaatatggtgagacttatcagtacaagagaactgaatcttacctgagattgcgattgccttgacattaccattatataaaatgaatcttaatttacaaacaccatgaggacaaagtgcacactgtttcttcaaatcatgtaattctaaattttccttctctcctttcgttgatgcctgttagtttgtggggagttaaagttattcattgaaaccattttattagtttctcacccattgtcatgaaattttatagtgagcattaaaatgttttttttaagcatacaagtttagacaaagatatcccttttaaaaaaccaacattgccacaatcatttcacttattaaaaatggaggcttcaaatttaatgtacagaatactaaaggaacaaatgatgaatctgaatttaacctgtttgctaagctgacaggtgagattatgtacacacttagaaacaacagctgttctgaatgaacagttgtcgtgggatcattgcttcatttcaactctgcctaatcactcacttttggctgcatgcagatttaagagtactgtgcaaaatcatcaactctgcttttaaagccttcttttctttttcattaatgcactcttttctaagactgttaagcagaagtaataatcaggtccttacctcaggccgtctttacagtttgtcttaaggcagaaagggatacacttcctgcagccttttggagtgagagaaagaaatcaagcttctttcctctaaaaggactaagtgaagggaagagtcaggaaaagccaagaactagctaccaccctgctggatatcccagaaaactacagaagccacacagtgatctgcattgcttccttttcctctgatagaatgaaaagccacttagcaggccaggcacggtacctcatgcctgtaatcccagcactttgggaggcagaggcrggcagatcacaaggtcaggagttcgaaaccagcctggcyaacatggtgaaaccctgtctctactaaaaaaaataaataaatacaaaaattagccagcatggtggygtgcgcctgtagtgccagctactcaggaggctagggcaggagtattgcttgaacccaggaggcggaggttgcagtgagccgagattgtgccactgcactsgagcctggacaacagagcaaaactccgtctcaaaaaaaaaaaagaaagaaaagaaaacccacttagcaagactgcctagaaccacattccagagtttcaaatacattttataaaagaaaaatataagtgaatttttggtcttttaatttaacacataatagcaaaatgtaaccatatttttatatttcagctaaaagcaactgggcaaaatgaccccgaggattttctgtgcatctattcttaagagctacatctgggccagctgggcatggtggctcatacctgttaatcacaggactttggaaggctgaggtgggcagatcacctaaggccaggagtccgagaccagcctggccaacatggtgaaaccccgtttctattgaaaaaaaaaatacaaaaaatacaaaaaattagccagatgtggtggcatgtgcctgtagtcccaactacacggaggctgaggcatgagaatcactgggagtctgggagacgaaggttgcagtgagccaagattgcgccactgcactccagcctgggcgacggcgagactgtctcaaaacaaaacaaaaaaatacagtgtacttgaagggaagaaattattaagtaccatcttctgaaagtttacttttttcaaaaatactatttgtgcagtactttattcagttaaacaatgttgaactccagaaaaatgaggtagtttttttggtggttgtttttataactttgaagcagaagataaaaataaacccacattctattgctttttcttttaggaacacatgattctgtgcagatttgcagaccagacagctgtccagctcccaccccaacgaaggctcataggtatgtgttttcacagagcagctgttgagtgtattatgcacaatatgactgggaatgattggaccaagtctatatgggaaaaatttagcaacatgaagtctatttttcaatgagaaactaaatatgttcttcccaaaaaaacttaattcatattgaaaagggtattgtaactataacattttatcctattttggttaactttaatacttttaaatgtattttgaatgtttgtacattgagtagaattcttacattaaatctcttactgttatgaacaaactgcaagatctatcaaaagccataaaagaaaataataaagattaaaaagtcaactatatataccaaaattgatgcattataaaatgtatacacagggatgataatgttttctttctcaggaaaaaggatacttgtgtattatttatcatagatgaatttgtttgacaatattaaatattacctaaattggaagaccacagaaacatttcaagtttaataagtaattgatttattgaagacatcactttagaaaaaacaatcacatttaaaagaataatagcagttaatagttatacatttaagcactgagctaaatgctcttgactgttatcttggtaaattcttacaaatatacatatggggtaggtactattatttacattttaatgataagaaaactgagacaaaagctttcctggggtccctcatctggtagatgatggagctatactatgaacccaacttatttgattctggacatgaagttcttgtccaccttagttactgcttcccagcatactggtgtcatatcagggtttaagataagtgggttcagtcaaaactaatcttaaaattattcagagaaacccaacattggacaccattatattttttctctaaatttacaatgtagccccttttcctccatgatatactagaaaacagattgttgtttctttggctgagcaccagatgaagctgttagcttacattcagagaccaagtcgtatgagaaatccttatctttaaactctaaaatcaaaggcagcatagcaagatgctcacacttggagacctgagacctgagactcaaggagtaagtgattccttctctttctcactctctgcagcataaacatttggaaagaactcattctctcttgcctgcaacctctttgtctttcaatgcctttccttcttgctcctccttttcccatctccaacactttgaattaatcaaatacacatttgatgagactccactcactagacccatgtcttagtctgttttgcactgctataacacaataccatagactgggtaattcataatgaacaaatttttatttggctcacatttctgaaggctaggaagtccaagatcaaggggctggcatctggtgagggtcttcttcctgcatcataacatgatgaaaggcatcacatggcaagagagagagcaagagaaggctgaacttgtccttttataaggaacccacactctagataatgaacccactaccatgataatggtattaattcattcactccaccctcttggcctaatgacctcacattaggccccacttcctaacactgttgcattgcagattcagtttccaacacatgctttctggaggacacattcaaatgatagcaatccaatgaagacataattagtatggtggatggatgggtacatggtagatgtgtgttttaggtatcaaactaaaggggagtatctggcagggaagttgctagagtggyggggktgggggtgggcatttggcaatgggaagaacggggggaatcacattgagagaaagctgtcacgtctacatctctgctttacacaggccattcctccccaggcccacaaaggtagactatcagcagctaaatttcagttgtagagacacttcaacatgtgaaaacatgaaattcttctacataatggaaaaggaaaaattaactggactgggatcaaagccaagggtagatgagctcaatgtaaaccctgggtgggtacttaaggaatgtagagcatcccattctgacacagaatgtttcattttaagctaaaaagtagatgggagaaacatttacagatgtcttaaaggaaagacaatattttaagggaaaaaaaagaatgtcggccataaggctgttaatgaagaagggatgattttgcctaaatggaattctggacatctctttttatatcatttctaacmcagtttattctttgtgggatgggctcttttaaggaaaatgtacaaaataaacattttaaatgtgagtctctcattgctaattcttacctactgatttcaccttccactgtttttttctgtgaggattctgttgttcatagaacttttctattttggtgatctgtcttcatttctgaagttgttttagtttatcagtttccactgtcattcaatgtttagccattattataattgtttaggaaaaatataatgaagttctgcatagtcagtaatctttttccagggggwtgaagaagcttatatattgaatttaaagcaattgaaagtataaaagtaaatcatggctttgaatatattcagccccaaatcatttttcccaagctacttttraagtttgtgtttgccaaaggaaaacaaattaactgcttttcttgccagtcaggtttccttttttgtcttccaaagattgtaaatgaaatacaataccactattttgtagagggacaggagctcagaaaattaagagtatactacactcaacattacatttccacctgaaataaaaggcatgtaattgagaattttcttaaatatttttcatttctcacttcttcatagccctaaaaaacttcagctggaaaagctaatgtctttcagacaccacttaatcagcatgttattttaaatattcttaaagacaaattttttttccacattacagataatctagttttatagggaaagcagagaaaaggtctttaaatgtatttttaaccaaagtaggaaatacagtctgaggctctaatttgagatttgcttataaatacatctgaaaaggttaacattctttaaattattagcagaggcaaatatatgaagtgccatgtttttgtcaccatcatctytccacattgatcaagaagtaaattgaaagaaactaaacaagacttaggggtacaaagcatgctccrtagtacttgcagattttgtcactatatagattcccttaaacaaactgaaactgtcctgctagtgaaagggtgtctcatgataccatttgactgtgtttcaggaaaacagtgcatgtgcttggtggatctggatcgagcaagagctgcagaagaaygtggatactccgttcaagtgatatccatggagccagagagctgctctcccaaaaataacatgattgtgggagtccccatttaaaatgagatattcacatttgatattttgccatccgtcttcacgttggatgcccagtggcattcaggaggttcttggcataactaggaaacagcattagccatcttgaacctattgtgctcaggaaggaaagcaacagggaaatcttggaagtaaaggctccctgcaaagcatcacaaatgctttacaatgtgtgattaaaggactgctggtttttatagtgagaatcccctgaagtctcagctgccaaaagaataatactagtggaggttccatcacaggaataacaatttccttctcacttcacaagctcctctgatcttgccaatgtgatgtttaattcaaaacagcgcacttacagcctttattttatacttatttagatattcacatgggaactgaaagtagactcagtggagttttttgttttttatatttttaacaattgtactttttctatcactttaaaaaaatctagtcaggtaattatagtacagttatttttaagctggggttagttgaacttgtatagcatttaatatactccttttaaatatatttctgccaggcatggtggctcatgcctataatcccagcactttgagaggccaaggtgggaggatcatttgagcccaggatatcgagaccagcctgcactacaaaaaaatccaaaaaatgaggtgggaggatcacttgagcccaggaagtcaaggctgcagtgagccttgatagcgccactgcactcctgcctgggaaaacgagacccagactcaaaataaatcaatgaatgaattaataaacaaataaataaataaataaatttcccataaattaccaaatgagattgtcactggttcaaattattaaataattgccataaatttcctattacgggaatgtggaatttggacatacattttaacaataagtacattgattaatacatttaagtttataagtaattattgaggatccagtattttcaagaccttggcctagtttcttttcaattcaaagatgagttgcaaaagacataatgttttgcctatggaagtagatcatctagaagaaaaagattaaagaattagttaagcttttttttttttttttttttgagacagagtttcactcttgttgcccaggctggaattcagtggctcgatcttggctcaccacaacctctgcattctcctgcctcagcctcccgagtagctaggattataggcacctgccaccatgcccggctaattttgtttgtaattttagtagagatggggtttctccatgttggccaggctggtttcgaactcctgacctcaggtgatctacccgcctcagcctcccaaagtgctgaaattacaggcgtgagccacctcacctggccatgttctttatggaatactacaatgtgttgtcacaggatttgttattcagatgtcaatcatttttatttatatatttctgggtaaaacttattagtggtgtgaggagtgcagaatatggaagcttacctaaattctttttctgccagccaacattttaaaagacaaatgatgcatcctttctcaatgctgctaattctttaaattttacatgtcccaatttattccatttgagatttattttaatgttttcaacccctgtgtaacatgtatcatgaggagaaagcactatcattgatcatcactatggattaaaatataggaatattttacagggcagtatgggtgggggtgggagacatattggaatcgtgttttctgggataaaatttttaaaaagaattaatcattagccctgagtattttagtcatttgtgcctatagaaaacaacatgctcttttattgtggactttcttcttttaagtgaggtttaatttatatacaatacaataacagatttttaagtattcatttgagatgttttgacaactgtatatatacatgtaaccatcactggaatcagatatagaatattccccttaaatattgtcaggtaaacacattgagaatattttttccagtctgtggcttacctacttattttcataatgaatgttttacttgtgatgaagatttaacttacccttttactttaatgattaatattttctgtgttctttctaataaattttacgaactctgaggttataagatttctcctaagattttttttgtagaaactttatgatcctagcttattacatttaggtctatgatcgatctcaaatcaaactcacatataaaggcaggtaggttttgaggaatatatagttgtttcagcatcattaaataaaaatcccttcctctcttcattgaactgccttggcacctcagttgaaaatcagttcatctatatgtatggttctatttctgaattctctagtcttttccattaatctgtttgttttgattgctgtagctttatagtaaatctggaaatcaggtagtttgtctcccaattttatttttcattctctagattattttggctgtctggatccattgtatccccagataaatcgtagaattgacttatcaatttctttttaaaattttaccaaaaaagcttgctgggatttttgatattgcctgttctctttagatcaatttgaggaaaatgaatgtcttaacaagattgaatcttataatctatgaagatatctttgcatgtgtttaggtctcctttaattactcagaaacattttgtaattttctgtgtagaagatttgttttatttattatgattttatttttttgatgttattaccctgagctttttacatgatgttccctgtatttagaataacctccttttacccctcccactagcttaatgtcattcatccttctgctctgagacttgacctccctggaattaggtatctgttataaaatgtctaccatccagagtagtcttctcagtcctcccgaggtgactcaaggtacacccccccaccaccaccaccaaaaacaaaaagcctatctgatgagtatggagaacaaaaatagaatggggagccgggcgtggtagctcacgcctgtaatctcagcactttgggatgccgaggcaggtggatcacttgaggtcaggagtttgagactagcctgaccaacgtggtgaaaccctgtctctactaaaaatacaaaaataagcctggtggtggttgcatatgcctgtgatcccagctactagggaggctaaggcagaagaatcgcttgagcctgggaggcagaggttgtggtgagctgagatcgtgccactgcactccagtctgggtgacacagtgagaccctgtctcaaaaaaagaaaaatagaaaggggaccccattgctctcccatgcttgatcttggcatggcattctccagctgtgatgtctgcggctagtaagagatatgggtattgtgattgctcttcgggcattatttttctatgtaaatccttgccaatgcttcttcccagccagggcaaatgaaaagagttggatgcagggagcaggaagattgttgcaatgataaaagcccaacaagtgacctgatcttaccctcacctttgtccatcaaatgcaaggctactgctcactgatctatctctccgaaggttgtaataatattagaaaccacagctcatctttcattgacttttgagcctgactcagaaacaggagtataattattaatggctaaactactttatcttatcttgggagacaaatttcagtcatattagatatcaaaatattttcagggcacacatgcaagataatatgtaaataacaccaattaaacatttagtttcattctatagattttggctacaggagttgcccattccatggttcaagaaaattgctattaatagagctttcacatactgaaacctgtttttctactgactttcataatgaaattagagatgtttctgtaaagtgatataatgaaattataataaagtgatacatttttaaattataatttgttaaaagaatacaaaagtagtttggagttttttaatacttttttttctttttgagacagggtctcactctgttacccaggtgaacacggctcactgcagcctccacctctctgagctcaagtgatcctcctacctcagcctccagagtagcagggactacaggcacatgccaccacatccagctaatttttgtatttttttgtagagatgatgtttcatcatgttgcccaggctggtttcaaatacctgggctcaaccaatccgcccacctcagcctctcaatgtgctgggattacaggtgtgagtcaccgtaactggccaaatacacatttttaattacaaagaaatacatatttgttgtagaaaggaagatgtggctaaacaaaaagaagaaaattcttaaattcacggtgttaatactttgttgtatgcctcctagacttattttttttatagacgcacacatttgtttttattcatttttcattttatagagataggggtctcaccatgttgcccacattggtcttgaactcctgggctcaggcaatcctcccaccttggcctcccaaagtgctaggattacaggcattagctacctcacctggcccacccagatttatttaacaaacattcatacagtacttaatatttgctaggcactattctaaaccctttacaaataactcatttagtcttttaagtcttttttcctcgtagtgaccctatgagctagagaccattagtaatcctattttacaggaactgaggctaagtttacacaataaatgcagacctggatttgaactcagccagtaattggtagaactaatattcaaattaaggctctttagccatcctatcaggattggctgggataaactatgataacaaaatctctgtgtctttacccaagaaggatgtatttttcattcataccacatatctgtccaaattgctatgactacttcacattatcatcataccatgacttagcctgactggttagcctctactgggaacatagctggtctcctggcaagggaaaaattggcatggcaaactaccagctagttattgaagattgagctcagatgtgatacacattacttcccttattttgttggctaaagtgagttatatagtgcctcctgatattaatagggtggggatatatagctttatataataatataacatgccacccacaatgtagttgaagaaagaaagggaaggagaggatgaggggaaaagacaaaagtaaaagaccatcatatattccagtttggaaatagagttcttacatgccattgacttggtgtagggcattctctctaatccatcaaagagaaggaaggcatgtgctataggcatttccggctatggttttccccaccttatcagcagaagatatgttccaagatctctaacagatgcctgaatcctggaatggtactgaaccctatatatactgtgtttcagtctgacaaccaagatggctactaagttggcatggttagcttatatagtgtggatacactggacaaaggggtgattcaagtcctgggctggatggaatgggacagcacaagatttcatcactcagaagcatgaaatttaaaacttataaattatttatttctggaattttccaattaatattttcaaaccacaggtaactgaaatggtggaaagcgaaaccatgattgagagggaattaactatattgttttgtgaactttcacacttacctttagaaggttggagaaacattaaatggtgtttcaaatttgcaaagtccatttctgactcatatattaaagtatttgacctttagtaccaaatattccattaagaaggtacaagtttacactcctgcgaggaatatatgagtgtttatttccctaaacccttcatcgatacaggcattatcagatatctctttaaatattggccaatttagtgggcaaagaatgctatcttgtataaaagtatatgattgcatacttttacatatgtttttgcacaatttataatctgagttctctaggcaattattaatttatttaatcaacacatttattgaactttgagcctaggcattgcatttgtgtttcttactcattttttacctggtactttcatctttcacataaattagtaaaagtttacgtgttgattaaagactttttattacattatctttttctgagttggcctttatggaagaaggtgttgttttgttttagtttgctattgtaaagtttaaaatatatgtcactttcttgtggtttctcagaaaaaaatcccccccaattaaaaaatatctatatttttgaaattctaattctttaatagttttagttgttacatttaaatctttaaactaccaataatttcttctggttggtagtttgaggtggaaatctaatattccttttgatgttagttacttttcaaaataccattgtaaaaaagccagatttgtatcagattgatttgaagtgcctttattatgtattaagtacaccagggactttcttcacttgcattctgttcttttattattattattattttaatactttaagttctaggatacttgtgcagaacgtgcaggttacataggtatacatatgccatgatggtttgctgcacgtatcaacctgtcatctgcattaggtatttttcctaatgctatccctcccctcgcccccaaccgctgaacaggccctggtgtatgatgttgccctcccatgtccatgtgttctcattgttcagcttccacttatgagtgagaatatgcagtgtttggttttctgttcctgtgttagtttgctgagaat

SEQ ID NO: 10602 - DNA, 12941 bp, Homo sapiens
gaaggtaagaaccactttattcagcataacactggaagtcctagctagagcaatcagacaagagaaagaaataaagggcattcaaatttgaagagaagacgaatggtttgttgttgttgttgttgttgttgttgttgttgttttgcaccattgtatcctcagtgccaaatacattgccagacacattgtaggtgctcattaaatacttgttgaataaatgtattcatgtgtgaatgaatgaatgttaaataatagatgaggaattgtcatacttgaccttgcatgtcagatgaggaaatatagccttgacagagactttgatcaggctggggtgctggaagtggaactgaaaagccaaacataaaggctgttttaacatggggatcaataacacagttgctctctgttgtgcactctctataccagctgtcccctgatagacatttctctaccagttgcaggctctgtcatgacatcagtttcatacagaaagaatgtgaagaaactgtaggccaaaataaaaaaagaattatttcttagttctctggaaaggccagtagtggtatacaaaagtcccacagtctcaaaggtctcctttctcttttctttacttgttttccctacacaaaatgccactttgtgttttgttttgtttttcaaacagctctgatttggcaaaacttcattgcctgtttgggatgaggtccctgaagctctcagaagataattatttctttctggtaaagatcagaaactttgaactctacttgtgagataaatggtctggtggcactttgaaacttcaacttatttaagttactgagcagctcatcaacttacttcctgcatttggaattgaatctgaaagagaattagaccccagacatcttgagtaggccaagtaggtacaatttatagattttgttcagagccaaacatgctcccagagatagaggcctggtgacagcttccagataaacatatagattgatggaatctacaaaccaaactgctcaatgaaaggcaggttctggtcagttatattttctaggtaaatgaggggtatccagacattttttgtttcaactccattataatgcttttgaaatgctggagtctattctccagccttagtgggcaggtagagtgactgatattcgatctttttgctgattgagggatgcacaggaccttgtgggtatgaaattatacatttttactactgagcactgagaagaggttgtggagaaagagtaggaaactggtagggtatgtacagagcccaggacctttcctaggcatcatccaatttagtttaaagccctgggtgcagaatgttttgttattgttttcctttttttaagaaagtgacaatttggtttagttggattccatttcaccaagataagataatacatagataaatattgccaagaggcaatggatgtctaaactagaaggttgcaaattgaaataacctaagggtcttgatgcagagcattcaaatgacctcaatcctgtatatgtcataacttttctagggaagattgaataaggttgtatgtaggtcaaatgccattgaaagaaatgtttgtctaagacattaaataatttaattagataccattaccaagggctgcagatcaaagggtttgttgattgagatttgacctaatctaaaagaattttctttcttcaggggtttctaggcatttgtgagtttgagaagctgggaaggcttttgaaatattgccaggaagtttgcagggagatcgtcacagtgctaaacctggcaactcttggagaattgttcttttgggcagcccattctgttccatctactgatacttgagagggacctccactggtgagtaggtaacagaacaggttttaatttattttcttttctcctttcctcctcttcttgggtctttaaccatctatctgggatggacaatctccaggaagacaagaggcagccattagttaaaaggaaagttatgctatatcaataaataattgcaggtaacaggactaagatgggaaacatgctgggttcagtttgccagaaatttttaatggtaattctaggatgaggcaatcagcactgtctctggaggccagggcctagactaaatgaaaaatagcccccccaatttagatgctgagtagcctttaagtgtgagagggaaattgtcatcaattttagttctatgggtccaaacatggtactaatgggggcaaggtcatgagttcaaccccaatctctatcagcaagtttaaccccatttaaaaaataastcgatctcacagccatagactgwtcaccaatttttagtcaaatggctcatcaatttattctactgggctcatgagggactgagggatagaaactttataaaccctccttcaatactggaaaaacaaaatacatcctgtggctcactgggaatgatagattcatataaggaggaaaaacgtctattttatcaatatttaatatttgacagcaaaagcagtgtgttttatagagttctaggaggaacatatagttttaaatggcataataatcagccatccacttcaatgcaaaatcagttcactctcccatctgtggccggcccattatctcattaaatattccactgtgaaagacccatatgtagataattgggagctaaatatactcccaaatattcaaaaaaaatttaagatatgactataccaacttaaatataagaggctgcgggtcattgtttcatgtagccatttgactcatatatttgtatgttctcactctgtagagatgattttctctattttcacttggaaaggtggaggcaggccaaggcaaaatctctttctcggggtcctatgataaatgaagacagcggcagcgttaggtctctcaagctctgagggcactcctgtgaagccaggtcaccaccaccctctccatcccttacatttgtttccctcttcacaaatagcaaacactttcctggatatatggatttacctttgttgtgcacctagcctatctgataggctgaaaaaggtagacaatgtgacacagggatagcttactagaaggccatgacatggaagggaaacgttaggaaattttctttcttaaagacttttaagggccaggagccgtgtcttacgcctgtaatcccagcactttgggaggctgaggcgggcggatcacctgaggtcaggagtttgagaccagcctggccaacatggtgaaatcccgtctctactaaaaatacaaaaattagctgggcatggtgtcgggcacctgtaatcccagctgcttgggaggctgaggcaggagaatcactggaacccaggagacggaggttgcagtgagccaagactgcgccactgcactccagcctgggtgacagagtgagaatctatctaaaaaaaaaaaaaaaaaaagatacttttaaggacaagacaagtgagagagtttcccatttcagagatgattagggatacttcatttcttagaaaaccgcttctgtagcctacatgtctctccaacaaaggagaaaaatgtaacacatttcaatactctgcggagtgagttctttttttctttatctgagggaagtcgagaatcctagcttgttaaaactagacgggaccttagagataatttagtttaacaagattggaaataaaaattcaggcacgtaaggggaagaaacttgtctagagacatagcaagtgagtagcggaagctgcaaggaggggattagaaagaaaatgggagttagtctcatggagaaacacatatacatcaaaggggtgcttagcatagaaacagtaatgtcaagggaagaggcagatggaaaaagagaggttgcctttcaataaggaacagcaaaagaactccattcacacattccttcagcaaataattattgagctcctatctaggtactattctatattttgggcacacagcaatgaagaaaacagaaaaaccctgacctcactgagcatacattctagttgatagagacaagcaataaacataattaatagataagctatacagtatgctagatgtagttctaaggagaaaataatgcaggaaagggggatataaaatttcaatggctagaaatgaactcccagacgaggtgacccagaaaggatgtaatgcaatttcaggggctggagatgaattcctagatgacgtgacccaggaaggatacactgaaaagatgccttgtaagtaaaaacctgagggaattgagaaggtgagctgtgcaaggatctgggtttcataaatatggagcagaaagtttttacaaatatagaacagcaggatcaaaggctctgtgaaagggatgggctttgagtatttgaggaatggtgaggaggctagtgtgactggagcaaagtgagcaagggaaagggtggtaggagatgcgttcagagaggaggtgattgggaggcaaaccatatagggcctcgtaggtcatagtaaggagattggtgtttagagaggctgaaatgagaatctatagttaacaatatgatactgtatacttaaaattttattaagagagtaggtcttatgttaagtgttcttattacaaagataaaagagagaaggaggaaacttttagggatgtttgttatatttacggcattatttatggtggccgtttcatgagtatatacttatcttcaaactcaagatgtatacataaaatatgtgtacctttttgtatatcagtcatacctcaataaaaatagaataaattttttaatggaagagtgacctgatttcacttacagttcaactgaatcatctgaactggatgggaagaagactagaaacaggaaaaccaatgacgaagttactggaaaaatccaggtgaatgatgatgatgccttggaataaagaatggcagtgcaggtggcaagaggagtaggtagattctgaataacagctctgaatgcttaggactttatatattcatttactacctattgggttcttgtgatcccccaggtactgttctatgttctaggaatacaccagtaaacagcagacaagggccctgttattaaattcacatttgagtgaaagacaaataataagcaagtaatcaaattattaatataacttcaggtattagaatgtgttataaaaaatgaagcagggctaggggaaagagatgggtgaggatgggataagagagccttttcagtgaggctacgtactcagaccctctccttaccacccacacttttagaaacttcatgttcagttttcatactcctaactggggctcaacgacaacagaatagaaaatgtaggagaagctagaaatgtaacttcagcaggggatattagaagagggtcctcccagacctcactactacatctacataatatcagctcaggtcaaagagctaccttgcacccactctatgtcaggcaccgtggtaaattctggaactatggaaaaatgaaggcatgcacaatctaggagtgagagacatcccaaacatagacaatattttagctaagacatgtgtcagaaggtaccctgttggttgagattaataactcaagctaactgagattcaaccatgtctacatatcagatttatcttggaaaatgacgtgagaaagtcaggaagatggcctacctttcctgtcttcttagttaggaaaaattattcaagaagacctctagtggaggagggctggagaaattttcatataactattttcaaaaagataaggaactttccattttcttaggattgagggaggatatctagctttgcctctgttcccattatagatatctattccatttgtgtcccattcttctgaaaaggacaaagataatgatcctgcacaccctaattctttccacctttctcacaccctccatctttattcccattctttcaggtaacactaagtagccaattggcatccatttaatgaatagtggcaagagggaaagatggccatggacaatgtcacagcagtgtttcagtttctccttattggcatttctaactatcctcaatggagagacacgtttttcacattagtgctgataatttacctcagcacattgttggggaatggatttatgatctttcttattcactttgaccccaacctccacactccaatctacttcttccttagtaacctgtctttcttagacctttgttatggaacagcttccatgccccargctttggtgcattgtttctctacccatccctacctctcttatccccgatgtttggctcaaacgagtgtctccttggctttggccacagcagagtgcctcctactggctgccatggcctatgaccgtgtggttgctatcagcaatcccctgcgttattcagtggttatgaatggcccagtrtgtgtctgcttggttgctacctcatgggggacatcacttgtgctcactgccatgctcatcctatccctgaggcttcacttctgtggggctaatgtcatcaaccattttgcctgtgagattctctccctsattaagctgacctgttctgataccagcctcaatgaatttatgatcctcatcaccagtatcttcaccctgctgctaccatttgggtttgttctcctctcctacatacgaattgctatggctatcataaggattcgctcactccagggcaggctcaaggcctttaccacatgtggctctcacctgaccgtggtgacaatcttctatgggtcagccatctccatgtatatgaaaactcagtccaagtcctmccctgaccaggacaagtttatctcagtgttttatggagctttgacacccatgttgaaccccctgatatatagcctgagaaaaaaagatgttaaacgggcaataaggaaagttatgttgaaaaggacatgagccttctttgcttctaaacgtctaaaataacacaacgtccctgatggagaaaatggtttaaaggatctgactttatctttggaagtgattgacatatgagaagcttcaggaagtgctcccaccccaaatattattcctactgagacttgaattgccattagaggtattatttttgctctttctttacatagaatattgttagtggctacccattaggttactcaccttcaggtaaatgaacttatcagagtaattttctcactgacagaagagacctatacagcaagagaatcttctgtaactgttgacagcaggtgaggcataactgaaattggaaactaagacaaagaatggtataataaaaggccagaagacaaatgtcagaaactttacaactttactgagggtaagccctgttacgtaagcacaatctccttgtttcacttaatcttggaatcatgagaaaaattatcatagctatttcctacatttgtgtagagtgttttatttttgctttttgtttttcaaaacatctttctaatctattagtctattttatatccctaattttcctatggaattggtaaaaacaccaccacaatttccctctgtattaacaatgaggaaacagagtagacattgagactcatctaaagtcatacataattgataatggagtcaaaattagaatttagatcatatatatgccacctccgaatttgtaaaagtaagtctgtaaaattatttagaatcatagaattataaatacagctaccatttattgagaacttatgatacgctaggggttgagcaaagctctctatatctattatcacatagaattcacacagtggttcaatgccatggcactattttccatccatatttagaagtgtggaaactgagtgatttgcccatggccacagagccagtacttaaatctaggtctggttgattccagatcccacttactatatctaaaggcataagaaaccctagagatgactaatgtagtgatattttaatccactttatcatgacataatttgtatacaataaactttgtccaattacagtgtgcaattctatgagttttgacagatgctcacagcatcaccacaacaatcagctacctaacaatttcatcacctacagaagtttccttttgccttcttgtaacccatcccttcctccctctacccccaattccaaccagtgatctgatttctttcactatatgttagtttttgtttttttaaatattgactataaataaaatcatgcagtctgtactcctttgtgtctgggttctctcactcagcctgctcttgagattcatctatattgttgcatgtatccgtaatttgttcctttttattgctgaataatatttcattgcacacatttaccgcatcttaaaacccattttctgttgatggacataatgcaatgtttttcaaatcttgatttatatagtttttagggactcaattgtggtgcctggagcctgctaatggggggtcgtttcctgtgagctatttcatttgaaaagggagttctaaaactaaaaggaacggttttgataaacaatgatctattacaggtaaccgattttagatgagaaatctaaggctcactgaatgtggagtaaatttcccaagatcatgaaactgtttggaagcagatctagaacgaagacccagatatcctgtctcctggtctcactttactttgggcctccaccacatatgatgaagtcatctcccaagaagccttttctacctgtttgtgaggaaccagacacaaacaggtagaaaaaaataaaatgcacagtacccagcactactgagcaaacagatactcagtgtgttcctcttactgtgactgctggggggctgaagagacattgtatggtgttgcaaagggagtaccatggatacaaggagactgtcttacgtgtttactaactaaatgaaaaataattgaggatgaataaactacttatcaaaacagcttaatttcaaaacaagtgcaagatttattcaaaccgtatactttttttttaattattatactttaagttttagggtacatgtgcacaatgtgcaggttagttacatatgtatacatgtaccatgctggtgtgctgcacccattaactcgtcatttagcattaggtatatctcctaatgctatccctcccccctccccccaccccacaacagtccccacagtgtgatgttccccttcctgtgtccatgtgttctcattgttcaattcccacctatgagtgagaacatgcggtgtttggttttttgtccttgtgatagtttactgagaatgatttccaatttcatccatgtccctacaaaggacatgaactcatcattttttatggctgcatagtattccatggtgtgtaagtgccacattttcttaatccagtctatcattgttggacttttggattggttccaagtctttgctattgtgaatagtgctacaataaacatatgtgtgcatgtgtctgtatacatttttaaaggtacatggtactcttcatctctgaaataatgttttaatattgagaaagaaaaaaattcagaaaaaggcaaatgaattcaatctttaatttatccatttaacaaacattaggtttgtactttaaggcaggcactatgctaggtattagggtaagtctcatgctttgtgcaaaatgttccttactatcaagataaacctttcaagcaaacattgtgaaataaacataaactggcacaatcaatgaaatattaaaagaatcaaagagtgtcttcgcacagaggaaaattcagaaattaggtggaatattaagagtataggttttaatgattctgcctttggagggaaaaatatttcactctctattacaggttggtttacagcttaaaatgggatgcacattttcaataatggtccctctactacaaaatagtatagctatgtcactaggttctttctccctttattgacttgttggtatgggcacagcctacagacagagtgacatagtggagtctggagatgaaggttgtggaattgattctgctactaacaagctgtgtaaccttagttatatctctctctggcctttaaacttgcttatcaatataacaggaagattgtgtttagctacctaaagacctctctagttctaacattctgcatccgggtgttattttatatagggcttgctcttattttcttaaaaaatgcaagcatatcatcaatttactctgcaacttgctttttccacttgacaatatatcatgaacattcctccagatcaatatatatagatctatctctctgactttaaatgttagctttgactgaaaaagaaggcaaacacggcagctagttaacacagctctggcccttccagcattaacattcagtttctaggcactaactctagaggctatctaattttacattgatattaatttattttaaagataaaaatgaactctgtgagggtgttgtgaaatgaaatcaatgctgggcttttgaaaattcctgagattgagtagtgcttctctgcctgatcaatcacaaggatcctgtgaaaccttccactggactcctccctactccccatccccaatggctgagtagtgaagcttaccttgcttcaccctggaaagaaagatggaaagactgtgttgaaactaagatggttctgtcaaaagttgagaagaaagtttacaaactgaaaagcaggctccaaatgatcatttccatggaaatattcatggagatttcagaaaaagatacagtgccccatttataggatttgggttttcagttgaagagaggcagtggagtataactacttagagcacaagccctggggcaaaacttgttagattcagtccttccttctgccacttcttcactcaagttaccccctgcttaggtctcttcacctgtaaagtgtagcactcagttcgatcaggcaaacagaaactactctatagttatttcaggaaggcatttaacacagagaattaggggcctacaaagcctttggaagggctatgagagaaaaggtaagggaactaccagcaaaatgagacagttgtaggaattgcaggaatcatgggaaattttagagattgttaggaaactgctgctaatgacrtcactgaagcagatgtttcacaagagaatgctcagaaatcacttaaatcttttctgatcaagcccacacacctaaacaagacgtcaggaagagcagtgatggtgtctacttcccttctgcttgccaagtttcctgcaagtacctctcatgggtggaatccaaaactgaacttgactgacaaatgagtgtgggaaatgtagcttccaagcttaacaatataggtgagagctagaaaaagcagggatatgacttaacaatacaggtgagagctagaaaaagcagggatatgaatatgacttcataggttggttataagaatatatatatgattcaatttatgtaaaataaaacacttagaacaatgttagctgtcacgatggtgtccagattatctgcacctaagatgccaggaattgaagtgcctacttgctttttaaatagtgcatcctgaggctgctccttcaattgtccattcaagcattcatacatatagcatccactgaatacatatttatcagctgtctaccagatagtgggtactaagctcatcactagggatgcagtggtgaaggaaggatacttgttcccttccctcaaagagttcacctcaaaggtagagagacaaacatgtacacaggcaacattattttgtaaagctatatcttcctaattctcatgttggtaaagtgctttacaaactttacagtttattttattcttgaacacgtattacctcctatcctcaaaataatttaatgagataagcagatcagatgttgctataaatattattaatgtcatttacagatgacaaaaaatttagagaggcaataatattatcaaggtcaacagttagtaacaggattggggttggaatacaattctcctaatacctagattaatgatctttctgatgagagcctgatgcgttcatggagtccttggaagaggggtaggaagaaggcaagattgttgctgagcagagagaggaagacactgtaggttcagattgtctaggttcaaaatagctaggttctgacacttactagctatacgaccttgggcagctttctgcctcagtttcctcatctataacaggaagacaattataggactgacccttgtagggttcttaagaagattaaatcagttaatttatctaaaatgctgagaactgtggcttggccatggtaagccctcaataaacgttaactatttttatcattattactgaagttgttgttattattgaattcccaattgacgtaaaagtagttgacccccatctcactgatcaccttctccctctcctctttttctccactagtaatgtgcatagtaactgtttctggttaagtgtgaacagcaggtcaaacacttttacagtgcaacatcatgagagactgggaaaaaaacatgctcaggcgtcaggaagtctggattctagtctgggttctgccattagtgagctatggaactctgagtgtatcacttaacctctctggactgcatctgtcatacaggggaaaatatattccttagcctacctcacagaatggttgaaagatcaaatgagatcatagatgttagatgttaaaaagttaaaagcacattacaaatgctgcatgatggtattatcattatcctcagagttaatctctccatctccttctcacttacccttgacaaccactcactcactgaattttattgagtcttgttctgaaatatttccccaacccaacccctcttctctgtcctcaatgcgtctgtcctagttcactgctttatcaatgcttatcaggatgactgtaacacactcc

SEQ ID NO: 10603 - DNA, 38778 bp, Homo sapiens
  misc_feature (1)...(38778): n = A,T,C or G, or insertion/deletion polymorphism (see Tables 1-2)
caagtccacagagcttgaaagtatgagacccagatttggactcaagcagtttgacaccaaagcctaggctcctactcactgttatgctagctaatatagtgctcaataagtttattcagtgttatgaaagatcgtatgcctcctacttttttaaacttttaagttcaggggtacctgtgcaggatgtgcaggtttgttttataggtaaacttgcgtcatgggggtttgtggtacagatttgatcactcaggtattaaacctagaacccactggctattttcctgatccactccctcctcccaccctccaatcagtccccgtgtgtgttgttcccctctgtgtgttcatgtgttctcatcatttagctcccactttcaagtgagaacatgtggtatttggttttctgttgctgctttagtttgctgagtatagtgcatatgcctcctacttaatagaaaaaaagtcagcaggtatggtcaacttcaactttctttctcctacaatctattaaacctacgtacatctatatcttcaccatctgcctttccaccagtctcagaaaagaagtttcccctctctcagttcaaggccagttcttcccgtagcctttgaccccatctcttcctgttttctctggacttcatcagttattctatttgggaactttaatctcttaatctctcctctccttactttctcctcctcacccatcatcctgctcaagatctaagaaaatccccactaggggacccagcattgatctttccagccccttttcagtcattatcctctctctcctccctttcaagcttctggaaaggacacttctcacctcttacctccctcccctcccattctttttttttttttgagacggagttttgctcttgtcgctcaggctggcgtgcagtggcacgatctctactcactgcaatccctgcctcccgggttcaagcaattcttctgcctcagcctcccgagtagctgggattacaggcgcctgccaccacaccctgctaatttttgtatttttagtagagacggggtttcaccatgttggccaggatggtctcgaactcctgacctcgtgatcgcctgccttggcctcccaaagtgctgggattacaggtgtgagccaccacgcctggcctcccattcttgtctcaacatgttacaatctgatttctaccctcactatgctatttaaacttcactaagttcaccagtacattcccaattgctaaatgtttccacgttttatttactgacattctatgctgcacttgattgttctctaccccttcaactcctcattcacttggcttcctggggttggctctgccctcagcactctaccaactctccctgtgagagagacccatccactctccttgattcaggtgaccacctttcataaagggaaatcttttttttttttttttttttttttttttttgtagagacaggatttcaccatgttggtcaggctggtctcaaactcctgacctcaggtgatcctcccacctcagcctcccaaagtgctgggattataggcatgagccactgcaccgggcccatgaagggaaatcttatctgggatcttagcagaacattatctaagggggacgggtaatatccgtataggttcttagctacctgagggcaaaactgttttatgcacagcctgccacagcagacaaacaatagatatctgttgaacaaattaccccttataaactttgcttcacagatgtctaagcaatttctgtagatgtgtccaaatgtttatagaaatattgtaaacgttgtacagagtgttacagatgttcagagaaggaactatcatttttggcttggtaagaatttttggcagtgatagcacttgagctggaaatagtttaagtaaagtccaggggcaggaaagggaggggaggagtagtaacattcaactcccatgccagagactggagaatagcaactggagggactctgtggaaacatcaagtttgaataagggaatagaagattcaactaaaaagataagtaggaggccgggcacggtagctcacacctgtaatcccagcactttgggagtccgaggctggcggatcacctgaggtcaggaattggagaccagcttggccaacatggtgaaaccccgtctctactaaaaaaacacaaaaattagccagctatggtggcatgcacctgtaatcccagctactcgggaggctgaggcaggagaatggcttgaacccaggaggcgcaggttgcagtgagcagagatggcgccactgcactccagcctgggcaacagagagagactccatctcgaaaaaacaaaaaagataggtaggaaatacacatgaggagggcctgaagtctaagctaaggagtgctgggattactccataggcagagaggagcctagactacacaggtaggtgttcagtcgtcctatgtggtggcaaagcagctgctggattggagtgtcacactggcggtgaacagaccgtgggacacgccagtgagcaaaatgagaggctgacacagggcaacggcactgaaatgacaagaaaacagctgtagtacttgacagatttcattgaatctaataaatctgtatgtatgtacatatatatagacacacacaaattttaacttgttattaatctttatagagacagtgtctcactctgttgcccaggctggagtgcggtggcatgattagaactgactgtaaccttgaactcatgggctcaagcgatcctcctgccttggcttcccaaaaccctggaattaacagatgtgagccaccacactggccaaattttaacatctttgttattgaaatacaagtgtttaatttgccggcatattttttaacaatacataaaatactaccgcatcttaaagttgatgttatcttagattcaatgaaatatgataactggatgtgaataagaaggaattcaaaagcaaagtttcaaacccgagtgactggaagggagtttccttgagccccacaggagagtctaaccaaatcttctatttgagcaatgatccccagacaatactgctctcccaccttccccacttgaacttattaataagaggaagtagttattaatgacaactttaatatgaacatgtgcttaaccctcaagaaattgtcacaactgaaagacgggagcaagctgacactgcaaggaacacatgatgctttggaatgggtggcctgcgtattcaaacacatcaaagcagcagttacttgaacaatcggaacttcttcaaatactggcccacttcttccttggggtagggccggagagcaatacaagtggcgatattctctggttgctcaagccacagcatgtggtcaatgttcttctgttgcagggtctcggccagctcctttagggtggtctcatctggggcctaaaggagaagaacacagaacacaaactgaatagcccacttaggaagtgtcaaaaggccaaaaaaggtttccggagtcctcttgcctgaaagtggagtaacagctttaccaaggagggagctgcagagcaatgatgtcattccgtggtgcactggggaggggagagaggcttcatattccagtttagaaaatggagatttgtatcttcccttgtgagatgttgtatgcccaacacacacatgtgtaatgtgtaattctgctctatacattttccagctctcctatggctggcgcccataattttaagtgcctctgactttaagagctgcctagtggaagtttttttttttttttcttttgagacagagtcttgctctgtcrcctgggctagagtacagtggcacgattatcagctcactgcagtctctggctcccgagttcaagcaattctcctgcctcagcctcccgagtagctgggattacaggcgcacaccactacacctggctaatttttgtatttttagtagagatggggtttcaccatgttgcccaggctggtctggagctcctgacctcaagcaatccacccacctaagcctcccaaagtgctaggattacaggagtgagccaccatgcccggcccctagtggaaggatttctaaaagcacatccacttccactttcctccacccctcccactctacctcactgaaacctagaggggttttccttctgctgggatggctcccacttgtttattaaagggagagtacaatattctctaacatccttctgaaattgtttctgggtcatccttactgccaattcacccatgctgaatcccattccaggaagtattaaaacgatcactcagaaaattattatttttgtgttattttgcataaagtttatctcttacctatgaaggcagaagccactaagctactcagaggcttgttttaataaattagagaatgccagtattgcgactcttaacctgctgagtccttctggcagagctctgctggaggactcatcagcttcttcagcctcgggcagcagcagagcatagtgagatacagtgaggctctggaatcagactactggactccaaactcttgctgactgtgtgatcgtggataagttaggtgacttcgctggcctcttcgtccctttataaaacaggaataatgcttcctaatggggatcaatgaaatcaggcttggacctgtgcctggcacacactaagcactcaataaatgtagttaatcctggtattttcttatattttattggcccttctgactacagcagcacctcaatgtaatcagtagcgactcctaagtccctttcttgagtcatgactaacaactaagaatcatgagaccctcttttaaactcaggggagtcacttaatccctgtaggcttcagagagtttcacctgcgacaagaggagtctaacctgatttcttgagacctcttactaggaagaaaatctaagtgaaaagccagcagcttctgttctgcctacacagattctcaaggcatttttcctacaggttaccgcttgatgtttcactatccagcagcaatttttctcttgaaagataatctatctttgccagttacccatgaagggattactccacccctccacctgagttctggcttaaagccgtttttccttattataaaaagccgtttattattaaagccgtttttccttattataaaatatgtgcttaaggtagaaaattttaaaaatacagattaagcattaggaaataaccaaaatctcaccatgcactacttaatatgtagatgtatttctttagtttttcctttcaaagtctggatcattctgtatatatagttcagttagcttcgcatcatgagcactcttcccgaccactaaatatgcttcaaaaccataagggctcccatgaatatccttgtgcaaagctctttgggtgcatctgattattttcttaggctacatctctagcagcaggatagagagtcaaagggtaagggtgagatttgtttggtcatctgcaaacagaacctgactgctattttaaaaggtgtaccgatttacacacctggtgcctggtctagctgaagctaggttcaatttatactaacgtttttagtatttattttcaaataatttggcgtcctacccaggtaaatactcagtttgacttcactttgcactgtcccttcgggctcggttttgcaggaggacagcactttggggcatggctttaaaaagtcggccagtgcacaggcggaacagcggggacacaggagccaccactttaccgcgagcccagcagggggcggaggactgctgtccactcttcacacagtcaggcccttcccaagggcgcacctccagggaaacagctccagtctaaatgttaacgatcaccccaactcccgccgcacccactccccgcagccaggccttcggaccgaagaccacacccacttccgccctcgatgtctcagcacctccccctccgcccgagtgcctcacctcgaggaccactttgcgcatgcgccccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctgggtgagctagaagggagaaggtaggggaaagacccattgtcggaccggaccgtggccagggtggcgggctgaacggccttcttaaaactccttccgtggccgggaagcccgctggaccagagtagccgtggcctcgggagcgcgccggggccgcgggatgggcgcgggggtgggcatggactctgctggctcggacgatgggagagggcgggcggctcaggaarggggatcctagccgtgacatttgtgtcatccgcggcccaggggttgtgcctgagtggtgtgtgccctgccgtctgggtttgaatgggactagatgtgatgtgactgttgccatttttcttttattagcaaggacattggagtccctatcaccggttgcctagacaacttcatgggaaggcccttgggaatctgagatggagcaggcgaaccctttacgtccagatggcgagtccaaaggaggtattcagagggtcgccgcctccttcctgctgctgcccaaagatgacccgcaggctgagagagccctttcctcctggaactgacgtgggacctggcctgtttgggagcagaatagtgaaaggaactaacattgaagacaaagggacaggcagccaagattattcgaggaggaaaaatggcttcgtttctaggctcccaccccttttgaaacggataagttgcatccatcatatgctcagtgtttatattctgaactgcggttctagccagggaggtccctttcctctccccggattttttgggccatgtatgcattactcttgagggagggccagtgtagggcagtgactttagtgttggctagaactggttttgagtgttggctctgccatgataaatattgtgaccttaggcaagtcactttattctctgcctctgtttcttcatctggaaaatggaggtgaaaatagcactgtagttgtggttgtggaaaaagtatttcttttgtggtggaaaagtattmaactcagacttttcaagtgaagcatttagcacatgtctaatatataggaaatattcaatgaaaggcttaattctttacatactttgtgtcttaaaatgtagaaggtgtttaaagaatgcttgttagagttgcttagaattacgaaactattacttttacttagtccttagtcaatcctttggaaactgagatttgcgtttgaatttctgtccaggagtaagttgctttcttctttagtgcctagtaatatttgtggacagttctggttttgtgtgactttatgttctttgctactaatactttttagaactttgaaatacttactcaagcctgatgcctaaatccaaagggttctacgttagtactttgggaaagcttgccataaaacctaacttaaattacagttttaaaaagaatttctgagcgcgtcagtgaatttggttatcctatttttctctgggtcatcattatcattgataacagagaagtaactatattcagcttaagatgacttaagctgagactttagataataaaagtatatggggtaagatttattgttactttaagactaaaaataagtttggtgactttatgtagtggaaacatgctacactcaggagtaacctgttctctagtccaggccttatttcatttctgttaaagtaagtgatgaggtggaagttttggattatcaagagacttagaccagtctccttattctctacccaaaacaatatttaaacacttagctgttacccatactggttttatccctctgcttgtttgatttcagttttttgcttattatttgaattctccccactcatttgagaaggaaggacatggagttgtagttgcaaccagatgatttattcaaataggcagggattttgacyttttytgggacaaagctgactggctaggatgagatgcaatcataacttccaaggtaaagcaggcccagcagatacactccctcttttctgtagtagcaacgctaaacaacaacgctacccccttggtgtagagggaatcaggtcggtaaagaagctgggcaggtttgagagcctgagaagagggctgtgtggaagtgcctagagaaggagcagcatgatactgttttgaacacctacttatctcagaaactttgggaatattgatatctactgttttagtaatatagaatttccataaagtagaatttggtgaggcgtctcctctaccaccctaaattattctatgtgtgcgtgcttttcagatcacctcctggttggacattaatttttgtaagctccgtgaggacagggacttcgttttgccaccacagtatgaataacttccagcacggtccttggtccatagtaaattctcaatgcatagttgttggataaatagagatttgtgaataaagcagttaatcacgtgctaattattaggactaatttatttaattagaattttggtttctcacgattattattgcggtaatgtgggtttttctgtggacatgagccaagtgaatgtaatctccaagagtgtcatgcctggttgtccgtgtttcggtaaacatttccggagtgttggccgggcgcggtggctcacacctgtaatcccagcactttgggaggccaaagcgggtgaatcacaaggtcaggagttcaagaccagtctggctaacatagtgaaaccccatctctactaaaaatacaaaaattagccgggcatcgtggtgcatgcctgtagtcccagctaattgggaggctgaagcaggagaattgcttgaacctgggaggtagaggttgcagtgagctgagatcgcgccactgcactccagcttgggcaacagagtgagatttcgtctcagaaaaaaataaccatttccggagtgtttaccatgtgtaaacactttgtgctagggttaagggatccatgggtgaacacaaatgcacacggtccctgattttggaactttaaggttcagtggaaaagataagcaaatcaaataatcacactaatgaatatacaattaaaactatagtggccgggtgcggtggctcacgcctgtaatcctagcactttgggaagccgaggtgggaggatcgcttgagcttaggagtttgagaccagcctgggaaacatagtgagaccccatctctttatttaaaaaacaaaaacaaaaaaactatagtattgtctcagaaggatctttgagagcttatgagctggcacctgaccttgttctgaaggtgctacaaaggtttccctgaggaaatgctgcttgcattgagtgctaacgagctagagtagctgcaggtgaaggtggataaggggcggctgtggaagagcctttggtgtgtgtgttgggggtggggggatcaggtcagtaaagaagctgggcgggtttgagagcctgagaggaggcctgtgtggaaatgcctagagaaggagcagcatgatactgatgagggtaagagagatccagaggccagtaggcctcgtaggcagtgtgaagtcatcgaaaggctttagccagctggatgacacgatccagtttagattttgaaatatggcttcagtgtatgggccacctaggaaacttgtaataggccagaaatggtagtagcttgaactacaatggtggcattgcagatggggaaaatggaaatattttagagatactaggaatgtwtattcaataggatctggtaatggattgggactgggtcagggagaaggtgtaaggaagaaagtactggtttacacagctatagatggataatggttccagtcatggaggggtttagaaggggagatgatgaattcagtcttggacatgttgattgtcaggttcctgtaagtcttccaagtagatacactgagaaggcaggtggatattctgctttctcaagaagcaggagagaggtataagctagagatacatatttgtgtggcatcgacatgtatggccattaaggctgtgggtactgatgagatttcttctggaaagaagaggtcttaggactgagctctggaaaatttcagcatttaatggtcaaggaggagagtaggagccttcaaagcagaaagtggggtcagagaggtaaaatgtaagtgtcacaaaaacaggttgtctgttgttcatcactatgttcccagtgcctgaaatagtacttggcacaaaatagatgcttaataaacatctgttgaacaaggcataccaacaggccgctatgctaagattcagaggaaaagagggtttcgtgaaggtggtgatcagtaggagcatatagtgctgggaggtgagataagggagcttgaaaaatgtcctttgggttcagcaacatggatatcactgttgatcttagagtggttttgtaaaataatgggaacagaagtgagtttcaagtgggttgaggtatgagtcacaggcaagaaaatggagaaagtgagtacaagttgagcactgaagatccaaaatctgaaatactccaaaatctgaagctttttgagcactgacatgatggtcaaaggaaatgcttatttccagttttggattttcagatatgggatgttcagccagtaagtgtaatgcaaatactcccaattccgaaatctgaaacacctctagtcccaaaacgttcggatactcaacttgcatggacaactcttttaagtagttttcctggaaaggaaaggggagaaaagggagatagtagctgaaggggatttgtgggcaagaataggcctgtgagtgtatgaaattgtgtgtgtgtgtatgtgtgtgtatatatatatatatatatgagtgtgtgtttgaagacagttgagacttgagcgtgtgtggaagggaaatgaacacagcagagaaaagggtaactgatcatttagggtttctgagaaagcaaggggataggcctcaatgagtaaaataggataattctgcatatagtgcgtgtctgtttctatttgatctcacacaaattttttttttttgagacggagtctgtcacctaggctggagtgcagtggcacgatcttggctcactgcaagctccgcctcctgggttcacgccattcttctgcctcagcctcctgagtagctgggactacaggtgcccgccaccacacccggctaattttttgtgtttttggtagagacggggtttcactgtgttagccaggatggtcttgatgtcccgacctcgtgatccacccgcctcggcctcccaaagtgctgggattacaggcgtgagccaccgtacccggcccgatctcacatacttttttttaatggttttattagccataaaaaccataagaggtttctagtcttaattggataggtgaatgagataagtttttggattccgtcccaaggcaaggagagaagattaaggttttcatatatgttcatccatatgaaccctacaaaatagatgctgggtgtacttaagaagctcgattaaataaagtctggggcttcctttttttttttttttttttttttttttggagacagtcttgctctgtcccccaggctggagtgcaatggcactccaatggagtgcagtgatcttggctcactgcaacctccgcctcctggattcaaacaattctgcctcagcctcccgagtagctgggattacaggcatgcgccaccatgcccggctaattttttgtatttttagtaaagatggggttttgccatgttggccaggctggtctcgaactcctgacctcaggtgatccacccgccttggccccccagagtgctaagattacaagtgtgagccaccgccctcggctgtgagagggcttctctccggcctgtggtaaagctagagaatcatcctttacacactagagatgtggatttgcgataaactgcagacctagataagacactgctgcctaatcagcgtgtgatagttcatatcctctctcgggctgtctttgaggaggatcctsttttacatcactctccaacctaggaggttgatgatctttgatttcaattgttagctcccctggttttataaattgacagatatctaacaattcagctggccacaaagttctggtaaaaaaaaaaaagagtcacctgttcttccctgagatgcttcctgtkgccacagtgagaaatcctcagcttcttgtaaaattctccttttactctccttaggtgttttagctcacttggaaaggctagagacccaagtgagcagatcccgtaaacrgtctgaagagctgcagagcgtgcaggcccaggaaggtgctcttggaaccaagattcataaactaaggcgtctgcgagatgagctgagggctgtggtgcggcaccggcgagccagcgtgagtagaagggtggtatcagcagttcctttagagtataatgaacaaacgtgatttgggaattggtgaattggccattttttataatgtgttttacttgtgatcttactggattgattgcagtccttgatccctcaaatgatcaaacctgtagagtttggccaggcacggtggctcatgcctgtaatcccagcactttgaaaggcgaggcaggcctatcgcctgtggtcaggcgtttgagaccagcctggccaacatggtgaaaccccatctctaccagaaatacaaaaattagccaggcatggaggcaggcgcctgtaatcccagctactcaggaggctgaggcacgaattgcacctgggaggcggaggttgcagtgagctgagatcgagccactgcactccagcctgggaaacagagtgagactccgtctcaaaaaaacaaaaatccggtagagttacagtgaatatcacctaacattttttaatttttttattatactttaagttttagggtacatgcgcacaacgtgtaggtttgttacatatgtatacatgtgccatgttggtgtgctgcgcccattaactcttcatttaacattaggtgtatctcctaatgctatccctcccccctccccccaccccacaacaggccccggtgtgtgatgttccccttcctgtgtccatgtgttctcagtgttcaattcccacctatgagtgagaacatgcggtgtttggttttttgtccttgcgatagtttgctgagaatgatggtttccagcttcatccatgtccccacaaaggatgtgaactcatccttttttatggctgcgtaatattccatggtgtatatgtgccacattttcttaatccagtctatcattgtaggacatttgggttggttccaagtctttgctattgtgaatagtgccgcagtaaacatacatgtgcatgtgtctttatagcagcatgttttataatcctttggatatatacccagtaatgggatggctgggtcaaatggtatttctagttctagatccctgaggaaycgccacactgwcttccacaatggtggaactagtttacagtcccaccaacagtgtaaaagtgttcctatttctccacakcctctccagcayctgttgtttcctgactttttaatgatcrccattctaactggtrtgagayggtatctcattgtggctttgatttgcatgtctctgatggccagtgatgatgagcatttwttcatgtgtctkttggctgcakaaatgtcttcytttgagwagtgtctgttcatgtcctttgcccactttttgatggggttgtttgtttttttcttgtacatttgtttgagttcattgtagattctggatattagccctttgtcagatgagtagattggaaaaattttctcccattctgtaggttgcctgttcactctgatggtagtttcttttgctgtgcagaagctctttagtttaattagatcccgtttgtcaattttggcttttgttgccattgcttttggtgttttagacatgaagtccttgcccatgcctatgtcctgaatggtattgcctaggttttcttctaggatttttatggttttaggtctaacttttaagtctttaatccatcttgaattaatttttgtataaggtgtaaggaagggatccagtttcagctttctacatatggctagccagttttcccagcaccatttattaaatagggaatccttccccatttcttgtttttgtcaggtttgtcaaagatcagatagttgtagatatgtggcattatttctgaggcttctgttctgttccattggtctatatctctgttttggtaccagtaccatgctgttttggttactgtagccttgtagtatagtttgaagtcaggtagggtgatgcctccagctttgttcttttggcatgggattgtcttggcaatgggggctcttttttggttccatatgaattttaaagtagttttttccaattctgtgaagaaagtcattggtagcttgatggggatggcattgaatccataaattagcttgggcagtatggccattttcacaatattgattcttcctatccatgagcatggaatgttctcccatttgtttgtgtcctcttttatttcgttgattagtggtttgtagttctccttgaagaggtccttcacatcccttgtaagttggattcctgggtattttattctctttgtagcaattgtgagtgggagttcactcatgatttggctctctgtttgtctgttattggtgtataagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctcttttcctaattgaataccctttatttccttctcctgcctcattgccctggccagaacttccaacactatgttgaataggagtggtgagagagggcatccctgtcttgtgccagttttcaaagggaatgcttccagtttttgcccattcagtgtgatattggctgtgggtttgtcatagatagctcttattattttgagatacgtcccatcaataactaatttattgagagtttttagcatgaagcgttgttgaattttgtcaaaggccttttctgcatctatcgagataatcatgtggtttttgtctttggttctgtttatatgctggattacgtttattgatttgcatatgttgaaccagccttgcatcccagggatgaagcccacttgatcatggtggataagctttttgatgtgctgctggatttgggttgccagtattttattgaggatttttgcatcgacgttcatcagggatattagtctaaaattctcttttttggttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatctatctggtcttggactttttttggttggtaggctattaattattgcctcaatttcagagcctgttattggtctattcagaggttcaacttcttcctggtttagtcttgggagaatgtatgtgtccaggaatttatccatttcttctagattttctagtttatttgcgtagaggtgtttatagtattctctgatggtagtttgtatttctgtgggatcggtggtgatatcccctttatcattttttattgcgtctatttgattcttctctcttttcttctttattagtcttgctagcggtctatcaattttgttgatcttttcaaaaaaccagctcctggattcattgattttttgaagggttttttgtgtctctatttccttcagttctgctctgatcttagttatttcttgccttctgctagcttttgaatgtgtttgcttttgcttctctagttcttttaattgtgatgttagggtgtcagttttagatctttcctgctttctcttgtaggcatttagtgctataaatttccgtctacacactgctttgaatgtgtcccaaagattctggtatgttgtgtctttgttctcgttggtttcaaagaacatctttatttctgccttcatttcgttatgtacccagtagtcattcaggaacaggttgttcagtttccatgtagttgagtggttttgaatgaatttcttaatcctgagttgtagtttgattgcactgtcgtctgagagacagtttgttataatttctgttcttttacatttgctgaggagtgttttacttccaactatgtggtcaattttggaataggtgtggtgtggtgctgaaaaaaatgtatattctgttgatttggggtggagagttctgtagatgtctattaggtccgcttggtgcagagctgagttcagttcctggatatccttgttaactttctgtctcgttgatctgtctaatgttgatggtggggtgttaaagtctcccattattactgtgtgggagtctaagtctctttgtaggtctctaaggacttgctttatgagtctgggtgctcctgtattgggtgcatatatatttaggayagttagctcttcgtgttgaattgatccctttaccattatgtaatggtcttctttgtctcttttgatctttgttggttgaaagtctgttttatcagagactaggattgcaacccctgctttttttttgttttccatttgcttggtagatcttcctccatccctttattttgagcctaagtgtgtctctgcacgtgagatgggtctcctgaatacagcacactgatgggtcttgactatccartttgccagtctgtgtcttttaattggagcatttagtctatttacatttaaggttaatattgttatgtgtgaatttgatcctgtcattatgatgttagctggttattttgcccattaattcatgcagtttcttcatagcattgctggtctttacartttggcatgtttttgcagtggctggtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggatgagaattcttttctttaagaatgttgaacattggcccccactctcttctgacttgtagagtttgtgccgagagatcagctgttagtctgatgggcttccctttgtgggtagcccgacctttctctctggctgcccttacattttttccttcatttcaactttggtgaatctgacaattatgtgtcttggggttgctcttctcaaggagtatctttgtggcgttctctgtagttcctgaatatgaatattggcctgccttgctagtttggggaagttctcctggataatatcctgcagagtgttttccaacttggttccattctccccatcactttcaggtacacctatcagacgtagatttggtcttttcgcatagtcccatatttcttggaggctttgttcgtttctttttattcttttttctctaaacttctcttcttgcttcatttcattcatttcatcttccatcactgataccctttcttccagttgatcgaatcggctactgaggcttgtgcattcgtcacgtgggtctcacgccatggttttcagctccatcaggtcctttaaggacttctctgcattggttattctagttagccattcgtgtaatttttttcaaggtttttaacttctttgccatgggttcgaacttcctcctgtagctcggagtagtttgatcgtctgaagctgtcttctctcaactcgtcaaagtcattctccgtccagctttgttccattgctggtgaggagctgcgttcctttggaggaggagaggcgctctgatttttagagtttccagtttttctgctctgttttttccccatctttgtggttttatctacctttggtctttgatgatagtgacgtacagatggggttttggtgtggatgtcctttctgtttgttagttttccttctaacagtcgggaccctcagctgcaggtctgttggattttgctggaggtccactccagacgctgtttgcctgggtatcaacagcggaggttgcagagcagcgaatgttggtgaacagcaaatgctgctgcctgatcgttcctctggaagttttgtctcagaggagtacccagctgtgtgaggtgtcagtctrcctctactgggggatgcctcccagttaggctactcgggggtcagggacccacttgaggaggcagtctgtctgttctcagacctccagctgcgtgctgggagaaccactactctcttcaaactatcagacagggacatttaagtctgcagagttttctgctgccttttgttttgctatgccctgcccccagaggtggagtctacagaggcaggcaggcctccttgagctgcagtgggctccacccagttcgagcttccaggctgctttgtttacctatccaagcctcggcaagggcgggcgcccctcccccagccttgctgctgccttgcagtttgatctcagcctgttgtgctagcaatgagcaggctctgtgggcgtaggaccctctgagccaggcacgggatataatctcctggtgtgccgtttgctaagaccgttggaaaagcgcagtattggggtgggagtgacccgattttccaggtgccgtctgtcacccctttctttgactaggaaagggaactccctgaccccttgcgcttcctgggtgaggcgatgcctcgccctgctttggctcacactcggtgtgctgcaaccactgtcctgcacccacggtccgacacttcccagagagatgaacctggtacctcagttggaaatgcggaaatcacccgtcttctgcgttgctcacgctgggagctgtagactggggctgttcctattcggccatcttggctccaccccctcacctaacatttgtcaggcactactggtaagccaggcaagttcttcctgacaggttcttaacctgccctaataaacacctaagtttgttacctcaatcatatacatattgggtatatgcctggtagaattgctgagtcataggatatgcatattcggtttagtaaatactgccagtttttgaaagtgattgtactagttttacattcccagcaatagttgtataagatttcccttgttttgcatttttaccaatacttaaartggcctgccttgagttgttgatacttgtgtcatttttgacatctgtcatccagactcaacctcctagggagcttgacccttcccttttttcagttttctctctagcctaggttcagtcagcaagacctatcagatttttcttttatattgcctttgtccttcctccattgccacagctcaaatattagtcatatatggagtaaatatcaggtgatttggatatcaggattatgacagyagtctgccagttggtgcatcttctagtatttctgcttttccaataaatcctgcacagccaagaaaatgcttcatgaaacaccgcaccattgctctgctcaaaagccgtcaacaacccttcattgcccattggatatcagccttcctccccctcttccttttccacctgtacctctcttccttcctcccttcttccgttctttttttttaattaaagtgtaatatatatgaagtgcactatgacagagattaaagtatagagcattaccaacacccagaagcctccagtttgcctcttcctagtcttctcttaaggtacccactattctgatttctgtcaccatacataggttttacctgattttgaactttatataaatgttaaaaagctaatttatagcttaaaaagtacaaactcttatgtctggcttcttttgctgaatgttctgactgtgagattcacctacactctgcttatagtgctcattttttttattgctgaatagcaattctattttatgagtatactacatttatttacccattctactgtgatgacatttgggttattggggttatttcactttgggacaattatgaatgctgctgctgttaacattttgggtgtttctgtcctttgatataaaaatatacacttatatattgggtatatgcctagtagaattgttggttcataggatatgcatgttaggtttagtaaattctggcagtttttgaaagtgattgtaccagttttacattcccagcaatagtgttaaattccattgtcctgcatttttaccaatacttgctattgtcagttttaaaaatttgtcattctggtgggagtgtaataatatgtcattttggattgaatttgcatttgcttcataaccagtgatggtgaatccctgtattgaacatttgaaaatcttctgttgcaaagtgtgctttattcaaggcctttgtgaaatttttattaggttgtccatctattaaattgtagaaatctttacatattttgagtgagttcttttttgggtatctgtattagagtcttccttagactgtggcttgtattttcactctctaatggtgtcttgtgatgaaaatctttgttttaatgaagtttgatttagtaattaaactttattcttattgcccttgtttcttgtttaataaatctttgtctaacttaagatcatgctgatcttttccaggtattttattttttttattttttttgtttttgaracagagtctcactttgttgcccaggcaggagtgcagtggcacgatccggcaccctccacctcctgggttcaagagattcttctgcctcagcctcccgagtagctgggattacaggcatgcgcccagctaatttttgtatttttagtagagacggggtttctctattgttggccaggctagtctcgaactcctgacctcaggttatccacccgcctcagcctcccaaagtgctgggattacaggcgtgagccgccgtgcctggccaggtaataaaagagccacctggctcttttatttatagtttgtgaagagttttaatcatgatattatgatattaaattttctcaaatatttttactgcatatattaagggaatcatatgttttctcycttattttattaatttgtggtatatattgattgctgtttaaatgataaattgccctcacattctcatagtaaacctaatttggtttgatgtatcatctttttaatataatgctaaatctgacttgctgatattagttattagaacttttgcatctaaattcatgagagagactgccctattatttttttgtggtaactttgtcaggttttggcatcaagttttatgttgctctcagaaagcaggttgagacattttccttttttttttttctattctttgaaagactttagataaaattggtgttattttttcttacattttgatgaggaattccccggtgaagctctttgggccttctctgtgggaaggttttaatttccgatccaatttctttgatcagcataagctgttcagatttcctgttttttcttgggtcacttttggtatgttgcattttgcagtttgttcattttatgtaaactctcacatttaaagtttgaaatttttttaaaacaacctactgtcttgtgactaggatggatcagtgatgatgtctcattttttattctgatattggtcatttgtgcttgctttcactccatttctgtctcctcgatcagtcttggtgtgttttatcacttttgtgcctttttkcaaagaaccaacttttggctttgctgattttctctcgttcatttgttttgtattttcattgatttctgctcattattattttcttccattactctctgaattttagttgttcctttagcttcttgagatgaatactttattgatattttttagtcttcttttctcttaaatacatttaaagttaaaaattttccctctaaccacaggtttaaatgtgtcccacaagtttttctttttctttttctttttttgtttgtattttttcttttttgttttttgtattgttttttccttttataccccacaagttttgatatattttcattatcatttcaattcaaatattgttaatttccattgtgttatcttctttggcccgtgggtttgttttataagtgtaccaattaatttccaaaaatttgagtatttggttttttttttaagttactaatttatagcttaattccatatggtcagtgaatgactcagcatgtggtcagtttttgtaaatattccatgtgcattaaatgtggactttgcatttgttggctcttatattctacatatatcaaataggcctagtgtgttcatcatgttgtttaaatatcttacatccttagctgagtgtggtggcacatacctgtaatcccagctagttgggaggctgaggcaggagaatcacttgaacctgggaggcgggggttacagtgagccgagatcatgtcactctactccagcctgggcaacagagtgaaactatgtctcaaaaaaaaaaaaaaacttacattcttattgatttacttgtctacttgttttattactgaaatagattttttaaaatctcccactgtgattgtagatgaatttttccccttttattctatgtttctatatatattgggtggcaacaaatttaggactactgtatcttcctgatttagttgacttttttttattatgaaatattccttttaattttaattaaacttcttgccttaaaatctattttgatattggccgggtgtggtggctcacgcctgtaatcccagccgtttgtgagactagggtgagaggatctcttgagcctaggagtttgagatcagcctgggcagcatagtgagagcccctcatctttaaaacaaaattaaaaattaaaaaaaagtttactttgatgaatcctagtacaatagtaacttttttggttaacgtttgcaggttaaggttttttttttttttttttttgagatggagttttgctcttgtcgcccaggctggagtgcaatggtgccatcttggctcactggaacctctgcctcccgggttcaagcaattctcgtgcctcagcctcccaagtagctgggactagaggtgctcgccaccatgctcagctaatttttgtatttttagtagaggtggggtttcaccacgttggccaggctggtctcgaactcctgacctcaggtgatctgcccacctcggcctcccacagtgctgggattacaggtgtgaaccaccgcacccggcctgcagggtaagttttttctgtctttctgcttccaatctttaaatgaccttacgtttaaggtattcttcttgtaaatagcatagagctagatatttttaatccatcttgacaattgttgtctattgttattatttattattgttattttttttttgagacagagtctcactctgtcgcccaggctggagtgcagtggcgagatctcagctcactgcaatttctgcctcctggcttcaagtgattctcatgcctcagcgtcccaagtaggtgggattacagacgtgcaccaccacgcctggctaatttttgtatttttagtagagacaagggtttcaccatgttggccaggctggtcttgaactcctggcctcaagtgatctgccggtcctggcctgccaaagtgctgggattataggtgtgagccactatgcctggccaatgtttgtcttttaattggagtatttagtccatgaactttttttttttttttttgagacggagcctcgctctgtcacccaggctggagtgcagtggcactatctcagctcactgcaacctccgcctcctgattcaagcgattctcctgcctcagcctcctgagtagctgggattacagatgcccgccaccacacccagctaattttttgtttttygttttttgtttttttttttgagacggagtctcgctctgtcgcccaggctggagtgcagtggtgcggtctcggctcactgcaagttccacctcctgggttcatgccattctcctgcctcagcctcccgagtagctgggactacaggcgcccgccaccacgcccagctagttttttgtatttttagtagagacggggttttaccacgttagccaggatggtcttgatctcctgacctcgtgatccacctgcctcggcctcctaaaatgctgggattacaggcgtgagccactgcgcccggccaatttttttgtatttttagtagagacggggtttcaccatgttggccagtctggtcttgaactcctgacctcatgatctgcccgctttggcctcccaaagtgctggaattacaggtgtgagccaccgcgcctggcaagtccatgaacttttaatgtgattactgatctatttggatctcaatctaccatagtattttattgtcttatttgtcacgtatagtcaacattcctttagtgttagacacatatttacccttttcagtgctcttcattttcacatttccatctgcgattattttctttcagttaagtagctccttttggtacttcttttggtatcgctggcagtaaaatctccatatttgtttgactgaagacatctttatttcactatgttttttattttttaagagtatatttggtgagtatataattagatattagaatttattttctttcaaactttatatcattctgttgtcttctagggccatagtatcttgtcaggtgtgaagttttggccttattagtcaggtgttaatcttatgtttgtgaatataatatgtctttttcttcgggcttaagattttctttgtctttggtttttagcaattttagatcaatgtggctaagcatgatttttttttttatcctgtttggtgcttgtaaagcttctttaattgatgtttttcatctgttttacaacattggccaatatctctttaaatagtgcatcttctcagtttttctctatttctggggctcccatgtatgggtgtttttgtttttgttttctgtgacctatgtcttagtaattttctaatcttatttttttctctgtactttaatctggatatggaaaatatgcctactttccactccacgtaagatcttatttgtctagttggcttttaaatctattaaaattctaatttgagttactgtatttttttggttctaagatttccgtctcattcttttctgtatagattccagctctttggtctgggtttccatcttttagcctgttttaatggccatgccccattattgaaatagctgaatcccttggcatctgttctgttgtcttctttttcctcttggctttcagtcatctgtttctctttcctggtatgcctgtagttttttttttttttttttttttaattcaatgatgagtattgtgtatgaaaaaatatacggaggtcaggtgctgtggctcacgcctgtaatcccagcactttgggaggccaaggcgggtggatcatstaacgtcaggagttcaagaccagcctggccaacatggtgaaaccctgtctctactaaaaatacaaaaattagcgaggcgtggtggcgcacacctgtaatcccagctactcgggaggctgagggaggagaatggcttgaacccgggaggcggaggttgcagtgagccgagattgtgccattgcactccagcctgggtaacagcaaaactctgtctggaaaaaagaaagaaagaaggaaaaatatatgggttctgagtatgttatcttcctccagaggaaattttagtgtttttctggcaagtagatcgtgtatgggcacatcacctttattcagttgaggtggtctatttccggtttcccttactcctagggcttagctttttttaggaccttcagttgaaagtttgggagtgtgttggagatgggtctattaaggctcctgttccctggcaggccctgaaatccacattttgttctagcaaaatctctgcttggctttttcccctttagcagcttctttccgtttggtttctcagtccccagtcacacctgtgcagcttaggaattagcaaatgccgggagggaagattgcaagcagaacgttgagttcctgtttctatggaatcttggcccgtagaaagtctgctttgataccattaatgtccagtgtttgttccggatgagactgctgcggagtctagtttatgcctttctatgtggcccagtgtgccttgcatatgaataaggaaatgctctgaggccagaggctgcagggaagccagctcagagcatttgtcagtactctccaatcctggctatttggatccttctggaatgccttcaaaccatttgctctctttgcttgcttgtttctttttggtattttatccagcttgcatagttgttctcagagggcgggtcagcctggtaccttctgctgggccatagctagcagcgtaagmcttggagccctggcacttgaaaccccacactgtccaagcacaacttacccagccttgcctcttcacagccacctgttgtgtccaccctgtgsttagcctagactttccacacaaccttttcttgctgctctctcagtcctgtccattcccatcaaaaatcgaattgttcttcagacctgtacartctccacttctgattcctggcattgtgacccatgagattcttcctctgcagtgaattcatagcaataactgaccggccactgtagcatttcttgatgtattatatcatgtgccttgtatttagctttcatccagttgggggagggnggggatgttgtagtgtacctctttgtaccaagattgatttgctgcatatcttgcaggtgaaagcatgtattgccaatgtagaacccaaccaaacagtggagatcartgagcaagaagcattggaagagaaattggaaaatgtgaaagccattctgcaggcatatcattttacaggttttgtttgtttttttaacctaatttagtctgggtctgcctctagtgagttagtttgctagatgtgttatcagtcctggaattatttcataatttatagtattttacaccctctgccctcatcactcwcacacacacacacacasacacacacacagctgacgtgctatttgtaggcctatcttcacctacaagattgactggcccctttgtacagcagctcagttggtggctggcttattccactcatcttaacagttcktcatgtgccagaccttgtactagaactgtctttactgctggcttgttttctgccactagtgaaatagtttgaactttccaagtctccgtttcaccgtaaatagggatttattctcccatctatgccacaagatagttgtgggaagaactggggactctgacaaattacttcacactcagaaataaagaatagctataaattaaatttttggccttgcttatgcctgtaatcccatcactttgggaggctgaggcaggattacttgagtccaggagttcgagaccagcctgggcaacatagcaagacctcatctctactaaaaatttaaaaatgagccaggtgaggtggcatgcgcttgtggtcccagctgtttgggaggctgagatgggaggatcatttaagcccaggaagttgaggttgcagtgagctgagatcgtgccaccgcactccagcctgggtgacagagtgaaaccctatctcaaaaaaaaaaaaaaaaaaatttctcaatagtttgacatttaggttgttttttcatttttaccattcttccatggttttaacaactcagtctcaaagtgagccggagccaaggggaagaatgagcctatgatactcattgaacaaacatttgtgtacaaagtrtacatattctaggcactgtggaagctactggaggcacagatgagtaagacatcaccttggcctgctgtctattgaggtgtcttcttgtttgcctcaggcctcagtggtaaactgaccagccgaggagtttgtgtctgcatcagtactgcttttgaggggaacctattggattcctattttgtggaccttgtcatacagaaaccactccggatwcatcaccattcagtcccagtcttcattcccctggaagagatagctgcaaaatatttacagaccaacatccagcacttcctgttcagtctctgcgagtacctgaatgcttactctgggaggaagtaccaggcagaccggcttcaggtatctctctgggatgttatatgcctcatccgtgggcccaagatcaacttaaaagggggatgttttttgtattttcagtgtttcctaactgtgagttagaagtttgaccgttacctttccgatgcttgtttcttatttatataaaagcactatcccaccctcttttcttttgaaactctggatggcgttgaagcctgggtactggttaaaggattatgcacccctgaatggtggtcttcaagcttttatcstaagattgtacagagtgcagttgctatacttttgatccatcagggatttatggcgtgcctactatgtaccataccgagtgccttgctgaaccttgggtatagatctcattagagaagaaaggtttctgcagtgccatggaacaatgctgtccatcttcccctaaactctagcctacctttttgggttgcagttgagctaaggttgggtgaaaaaagtagataggaaattaatgcaaataggctgtaagtgcctcctacaagcttagcatttccccctctatggatttggagtaactctgaagctctcagctgtagatttaacttaaattgaaatgtggatgcagtcatgaagcatcttagccgtgtaacgtcagtgaagtttctgcagaaacagtctcttgcgaagctgtacccctggccatttaggcctataggcctttccaggctgccagtgactcttagttatcttaggcatctttttcattagtccttttttcagacctttttctgtccctcatttatttctctgaaatgtaatcgatgggcctctttttggttgacgtaattgaagggtcagtaaacaccacctttggaactgcagtcatcctctacttcgttttgttcctcacccctcttagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggtaagaagggtgcctcagtgcagaaattctcatatcccagtttatttgagtgaaacagggaaaataggtagaatccatgaagtagacctcttgagacactttctctgtttatatactntacattactcagaccggtaagatagaacattcttgtttctaccagtcttttccttcctctttgtaaatggtaaacatgattgtccccattttcccttctcctttgcccacccacctcagcagtgttctcgcagcctatgatttgttttcactgggggccctgcttcaggaaagacacctaatgataaggctgagtcatgggtcagttatggtggatggagccagaagactcatttcactgtgaagacaaatggacatgacacgtcagcacacacttactcctccctacggagcagtctctaaatggaaatccttccagactggctgagagagagattttttggtgaacctgtttcagttaaatgtgacatgggcaataatgaaaaattgggtgaaatgtttttaggaggcagaaattttgaagctgccccagatttcacaccatcggtctttgatttctctgcgcagttagattccaktccccagtctctagattgcattggtccagtaaggggcagccttagtccagaccaaaaaaaaaaaaaaaaaactgtatgggtccagtgggtccagaatatcagtgatccaggttccgattcccccagctgcactgagtgagattgaatrtcagtgatccaggctccgattcccccagctgcactgaatgagattgaatatcagtgatccaggctccgattcccccagctgcactgaatgagattgatggaatctttctttttaggagtggaagtattatccacttcatgggaggagcaacgagcatctcatgaaactctgttctgtacgaagcccttgcatcaagtgtttgcctcatttacaagaaaaggagaaaagttggwtatgagtctggtctcctaatagattgttttcactgcactgggagcacatcagaggtaagtaaccagtactgaagacagtaccaggtgggtagtactgtctgatgaagggtacatcacccttctgatgaaaacagacacctacctgttcatctggatggaagagcaggtttgagtatagacactggcatttttgaacaattcccatgatcacctggtcccttcttaaaatgctcaagatgttttttaaaggtattagttgatcatacattttagttgaaaatcatttgtggggcaataaaagccattttttgaaaaaggtgtatcactcaagaagtacttatggaaaaatatcaaattattgagggcattaacttctgggaaagaccaggcaattaagttgtcacagtaactgctactaatttaatgccaggaatagagatgccaaaaatcctaaaattttcagaaagggctctcacagaaatgtagcactccactcaaactgcaatagcttgattctgttgagaaacactgatctaaataaatggaaaaataacccacattcactaatgaagataataaggaagacccaatatttttttttttwwaaaaggaaagtatttttagcttttatgaaagctttaagtaatttttcctcattttcctgtttgaaacttttgaaaaggaagttcttcagtgtttggttaggcgcagtgtattctaggccactgctttataaatatggtgtgagaaagcagtaggataaaataatcagagttcagtgtgtctcatattttgtttcctaaaagtttagtagagctgtgaatgtactaggaagtcccctctgaaaaagcacagttagttagaaatctgcccatwaactcagggggactcaggcgccccccgggtcttccctctcctgcaggctctccggttagtgtcctgatttgccgtaaccaygggcctctgacctgctggcacctctggttccttggcgtgtgggtcactcacagatatgaaaacctgtgtctggctgaccaggttctcctgtagccctcccttgcccaggcacagataggagtcatgactggcccaaggccacgttcagacttaaccctgcaatggccacgaagtaacctccgtgtgggagagctccaggaacagtgcaggggattaaagccagcttggagtaccctttagaagaaagtttaagaataaaagagacagggccaggcagcaggcgttccggggtacagtgagctatgatgagaccttcaagctcttgccttccaggcctgtggtggggaccagtggcatgagtcagcaaagtaccagcactcctcagataagtgatattaacagaatttccacaatcactttcaagttgaataaagcttttaataaaacagtcttgttctttatcaatacctgtaaattctcttaaagcagtagcaaaggcgactgtagcaagagctcaaaaggcaaggcaatatcggaaagtgtatttaacagaagattaaaaatataaatgtagaagatctgtttatatatttttctttcagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagcsctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacrcasaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcaggagttgtccaccacctggtggggcagtgtgacagaggggccattggggaaggtggctagcttatcccgccccttcaagaagaaggtcagcagctcccccttccccttcacaaagatggggcctcgcctcacaaagcggaagccgtactctcggaggatgacttgggtttcttctaccacctggagagggagggggagcaagaacgtggcgttacggggggagcctagactgagggcgggtgggggctttgggtggttggagccgagcactgatccatgggtcccaagcagtacgggacactccccaaacctcccagggccaagcccttccacccgtggcgagcagcgggtgggaaggagaaccctggagtgactggctgggggcctcctctcatccagagacttctctcctaggatggccatggtcacctgggtggcagcactgttacctggaaactgccactgcctgctcttctgtccctttgcccctttcgtggagcttttctgccagacgccactgagacagatcacaaggtattagaaggttcatacccaaaggtaggccatatgcatctagaacttcagcccagattttgtggatgggtggaagtgtttcttcctgtgctgaggctagctattgcagagattcttttccacttgccccacgtctctgcctctggacttactgttcagggccagggtgggaggcaggggcacgtgggaaagcactgttccggttttgttctcatgccgagtctgagcacgtgccagctgtgccactggacatacctgaatgttgcccatgacccccgtggactccatcctgctggctacattgactgtattgccccagatgtcgtagtgtggtttccgggctccgatgaccccagccagaaccccgcctttgttcatgcctagggtagaggcataaagttcagcacagccacaggccacaccttgttatgggcctcagaagccatctcctctccagacctgtaccacaaagctcctaatgtaacacatcattgtcctcattcaacttggctgtatgctattggagggtggaaatcacatctcctgtttatccgtgtgcttgttaggtgtcagccgccaccccccccccatatgcagatttactcggcatggtagtggccagcttctaacacagctggtatttcaagtctcctgggacctcactcaggaatgataccccctcagtagaagcagcaggtgatcttaactcctttcaaagagcaggcctgtctgggaagccatgtcctcagcaggcacagcaacccctctggaaatggatcacaaactcacttctcagccaggcaggccaagcttctattgtaacagtaggcacagtatagtcggatcatcacatcagctgggtttttggtttagtcatctagagtcgtctggactaaaggtctttcaggtctccttgccctgtgagtgcgtgaacctccccacccgaattgcctcagttgtcctgagcctcatgtctctcctggtggtgggccaggcccctgcatgggaagggagcctgctgcggggcaggccagctgggggtgctcacctatgcgcagcatgaagttattgaaggactggttgttgatgttggtgagcgtatccttcatggccagcgcgaagtcggccaggtcagccaggtgctgccagcgctctctctcggacttgtcttcctgtgccaggggaccgtggagaaagtgtcaggggccgctcactgcagcagcctgctctgctgccttccctggcagtgttctgggggtggattccctacacctagatgttcaaggccttacttttcctcccacaaaggagtcgcagccacgctagctctgacttgccactgtgacaaagttcacgtagcaggtctaggcaaagactgggcaattgagcagaggagacggacctgtgagtctgaccacgaggcggaccccttcaccttggctgggcctggtcctggtccttaggttttgtcaggttgtccttgtttggatccctcaactaggtgataagcactggagggggatgacccgccttggacgtgtttctttaacctcatccatataatagggccgtgggatggttgtagaggtaaagcaggatgatggtgttttaagaccagagcttgggaccagggctcctacacctaattttctctcctggtagctgaacaaaggtctaaattagcttaacaaaagaacaggctgccgtcagccagagttctgaaggccatgctttcagtttcccttgttgacaattgctctccagttcctatgaaagcacagagccttagggggcctggccacagaacacaaccatcttaggcctgagctgtgaacagcagggggttgtgtgtctgttctgtttctctgcttgccgaactttctcaataaaccctatttcttatttatatttacgtggtgctggtggtgtgtgtctgggaccactttgcacagcagttcttatttcccccatgctaggtctgggctgccaatctcttgccttgggggcagagcctcatctctctggctactggggttagctaccttgttggagctggcaaagccattggtgttgacatcgggggtgactcctgaagccgccatatacgtgctgccaatggttttgatcttggtgatcacccggaacttgggattgtccaggagctgaggccaggattcaggaaagaattgtcagcagtcaagggagaggaatgacccaacccagtgacagatgtacctgtttacaaggaccccactaaacccaagagacactttcctatcaaagttgttacttagtctaccgcttatctgccacatgatcctgggagaacttcctaactttctgggcctgtttccacaacctcaacactgacataaaatcggcagtctcctaggggggctccgcgcgtgtgtaaaagcattctccctggtatacaggtcacccagtcaatgctgaccggctctgaatttgaggagacagtcccaggacagagaggtctcgagatgttgcttggccagtccttatccttatcctgtgaccctgtgggtgatttcccgggctcccacctcacctccccttccccagcccagcagttccaggtggctgcagaagtccatgtattgcggaaggggcttatctgggaaaatgaagccagtttctctggcctctgcagcctattgtaggatgtgatgtggaatgggccggcttcatggccagagtgcagggtgggatgggcactcacagagtcaaaatccgagatgatttcattgaggaaacgcagacactcaataccaccattgttgatgctctcctctgtgtagaagtcagcaaagttgggcagggaggcaaacatgactccaatctcatcatacgtctggctatacagctcctaaaaagaggtgcggacaacgtgctcaaagcatgtccgactgactggatgatgtgttggagaaatgcatctatcttccatgcatgacatgtgcactcagctttttggactcacacatcagtcagattattccagcatttttttttttttttttaagagtgggtcttgctgtgtttcccaggctggagtgcagtggcagtaaacaagcacaattaggtatgatcgaagcacactgcggccttgaacaccaggtatctgggaccacagacacatgtcaccatgcccggctgtagattattccaactctgaataatttaaaaatagctcatcgctacttttttttttttttttttgagagatggagtcttgctgtgtcacccaggctggagttgagtggcacaatctcagctcactgcaacctccacctcctgggttcaagtgagtctcctgtctcagtttcccgagtagctgggacgacaggtgtgcaccaccgcgtccagttaatttttgtattttttagtagagacagggtttcactatttgttgcccaggctggtctcaaactcctgacctcagatgatccacccgcctcggcctcccaaagtgccgggattacaggcgtgagccactgtgcccagccactactttgaataaattttaaaacagcttctctagttcctctaacagccccagctgtgaagacgagggtaccgtagagctgggaaccactctgtttggagaagttcacaggcaacagaaaggtgggctctagccaaagtcttgtcttctgacacatggcctcagagctgtacggcccacatcacgatgcctacagcagtgcactttataagaggccggagaaattcctcttttgcttatttgtgtttgctgtttaggttcagccctacctaggccccagtcccctgtccctgagaaggcctgggcccagcgggggctgcctgaaagaaagaacagatggagacaaatggcctcatggttccgggctgagaccacacccctcacctcatctctcttcttggaccccaggaaatggcgtgccacgtgctcaggcaacatgttggtgaccaaggcctcgttccagcgtcgcatctcatagacacgttccttctggtcgtggacctcaatcttccacaagaaaagtgtccgtgccagtttttctacctacagacacagacaaggcgaggcatgtgctctaagctggccactggatagaaggatgaaaaacaggaatggccaggcgtggcggttcatgcctgtaatcccagcactttgggaggccgaggcaggcggatcacctgaggtcaggagttcgagaccagcctgaccaacatggtgaaaccctgtctctactaaaaatacaaaaattagccgggcatggtggcgggcacctgtaatcccagctactcgggaggctgaggcaggagaatcaacttgaacccaggaggcagaggttgcagtgagccgagatcgcaccactgcactccagcctgggcaaaagagtgagactcagtctcaaaaaaagaagaaaaacaggaacgtgaatggaggaactccccttggaaaggctggaaggaagatggctaaatggcaagggaagtaagaccctgcaaagattgcacctcatcaaaaggccacccaatagtggtgcggttcccagcctccgtagttacagcagagatccaggaggccttccgtgtgtagggggcctcttgggacctaatttcagctgcaggtctgtctcgtggaggtggcagcagtggggatctcccaactcagggtggagtccccctttctagcaggcgccatttgggtaagaagtggcttgggaaggctgtacttccctggaaagccagtagggggcacttgaactaacattgggccctaagtacagaggatctttctcttccctctcttccttctcttttccttttttgtccggttgagtgcggtggttgtggcggggtggggggggtgtctcactttgtcacccaggctggagtgcagtggtgtgatctcagcttactacagcctcaacctcctagattcaagcaatcctcctgcctcagcctctcaagtagctgggattacaggtgcgggccaccatgcctggctaatttttgtattttttagtagagacagggtttcaccatattgcccaggctggtctcagactcctggactcaagtgatcctccaccctcagcctcccaaaatgagccactgcaccggccttctcttttccttttaacccaacagaaagtccatcagctcccttctctttctcttctggctctgtggtcagttgtgttaatgtccctcagcgccacggggagtgcgggggccatgagcccctggcctaggggatattgatttgattcaagatgtttgtgccttcactctatcccctcccaccttcactcccatgcttccttcaccatcctggagggggtcggacggaagaggtgaggaactgtcttcctgtgtgactgaggaaggagcctgaatagagaaggcggtggcctgaccaggctcacgtgtggggctgggtgaagggaagcccc

SEQ ID NO: 10604 - DNA, 13871 bp, Homo sapiens
ttacagcaaaagttgaactcccagcctcacagggtgtctgctgttaaagagagggcattggttgggaaagaatgggatcctataagttgggatggggatgtgtgagaagactctgatgaggctgggaacattgagctcttaaatctccatgagtcttgtttgccagtggaagtggtctctccaccttccaaggcagtggcgttctcacccacagtggtattggcctttccatctctttctgaaaggatgatctgtgcattgcctatggagaaggttagtggcctcccttgaggcagttgccaagaaagacaatgctgattctcctcaggactcatgcccaccatccctctttgcttctatccctgtaactagacttgagacccagcaggcccctaaaagtgatgtagagagtgtgacccatgaggaggtgccctatactctgatagagttttctaatttatataagcaggaaaggggggaaatatatggaaattgatactaaaggtgtagaataatgatggaaggaatagtgggataggctgaatttattgatatgggcccgctaagcagagattctgcatgtaacattgcagctcaggaagttagtaaaggcagtagcagtttgtttggttggttggctgaaacatagatcaaaagatgacccactgagggcaagttggataagcctcatctccctttggttaacataaaggaagggatttagaggcttaaagagactgtaatgctagagtggattttttatgtaaaacctactggcctacactgggaaggtccagatcaatctttcacgaatactttgagaaacagatttgtaaggggagttacagcatccttgaagagctctgtgattgcacttctctgtaggcctgaccttatggtgagaagctgtgtcactcaatgggaaaacttacatgcaatggggataactggatctggggtggcaggggccaagtggtggttcccaacagcaaaggtaaagtggatgtagttattgtaatgaatagaagaggcaaagcaacaatcagaatagtctgactcatgtagacctaaggcattgagtagtcaattacggtgttcctagatataaaatagataggaagcctattaaatccttactttactatataagcagaacactttcaggtcaagcaaacaaaaagtctaactccaataataaaaacagagaatcatggcccctcaattagttccagacatgagtcagtttaaaaaaccccttgaaagcagaggagaccaggtcccctccaggaaggaccctggtacaccaaaaatttgtactgataatgtttcctttagctttcccccaaagacttatggcattttgccagggtaactgtgcactggggaaaagaaaataatcagacctttggggactattggacactggctctgtactgacagattccaggagacccaaaatgtcactgtggctcgtcagcaaaagtaggagcttatggaggtcaggtgatcaatggagttgcagttcaggtctgcctcacagtgggttcagtgggtccccaaacccagtctgtggtcatttctctaattctagaatgtataattggcacagacatacttagcagtgggcagaatccccacattagttcctaaactaatggagtgaaaggtagtgtggtgagaaaggccaaattgaagccattagagccacctctacctaggaaaatagtgaatcaaaaacaatagaaattagtgccaccaccaaggacttgaaagatgcaagggtagttgttctcacctcatctttattcaactctcctatttggcctgtaaagaagacagatggatcttggagaatgacagtggattattgtaaccttaaccaaattgtgaccccagttccaactgctgtaccagttggcatttcattgcctgagcaaatgaacacatatcctggtgtgtagctattaatctggcaaatgcctcattttccattcctgtccataaggcccaccagaagctctttgcttttagctggcaagaccagcaatataccttcactgttctacctcagaagtacatcaaccctctggcactatgtcacaattaggctttcagggatcttcattgcctttcccttccacaagatatcatactggtctattatgttgatgatgttatgctgattggatctagtgagcatgaagtaccaaccagtctggacttattggccagaagtttgtgtgtcagaagataggaaataagtccccctaaaattcagaggccttctacctctgtgaagtttctagaggtccagtggtatggggcgtgtcaagatatcctttctaaggggaaggataaattgttgtatctggctgctcctacaactgagaaagaggcacaatgcctagtgggcctatgtggattttggaggcaacatattattaatttgcatgttttactctggcccatctactgagtgacccagaaagctgctagttttgagtggggcccagaagaggagaaggctctataagaggtccaggctgctgtgcaagctgctctgccacttgggccacatgaatcagcagatccatggtacttgagctgtcagcggtaggtaggaatgccgtttgaagcctttggaaggcccccataggtgaattgcagctgaggcccttaggattttggagcaaggtcctgccatcatccacagataactactttccttttgaaagacagcttttggcctggtgctgggcctcagttgatactaaatgtttgaccataggctgtcaggttaccacgtgacctgagctgcccattataaattgggtgttatctgacccaacatattgttaagttgggcatgcacattaacactttattattaaatggaaatggtctatatatgatcctgcttgaacaggtcctgaaggcacaagtaagttatatgaaatggcccaaatgcccatagttcactcctgctacactgtcttctctctcctagcctgcacctatggcctaatggagagtactctataatcaattgacagagaaaaagaagactggggcctcgtttacagatggttctgcatggacagcttgcagcaatacagtccctttctgggacatccttgaaagacagtggtgaagggaaatcttagtgggcagaacatatggcagtgtagctggttgtgcactttacttgaaaggagaaatggccagagctgtagccaatggtttggacaaatgatcaaggaatcagggaactggaaggaacatgattggaaaattgatgatgaagaaatttgggcaagaggtatgtggatacaggtggatacagtgatccattctgtgactagtagttaggctctttccccagccacctctattatcacccaatgggctcatgaacaaagtggccatggtggctgggaaggaggttatacatgggctcagcaacatgaacttccactcaccaaggttgagctggctatagcagccactgagtgcccaatttgtcagcagcagagaccaacactgagccccctatatggtaccatgcccttgggatgattggctagctacaaaatggcaagatgattacattggtggcaggatgattacattgtattactttaatcatagaagggacagtattttgtccttactaaaatagacactcacatagatttaccttccctgcatgcaatgcttctaccaaaactaccatctctggactcacagagtgccttatccactgtcacggtattccacacagcatttcttctgaccaaggaactcactgtatagccaaagaagtgtggcaatgtactcatgctcatggaattcattggtcttaccatgttccccatcatcctgaagtagctagctagcttgatcatgcagtcagatggtcttttgaagttgcagttacagcaccaggtaggtgctctgtagggctggggcaaggttcaacagaagggtgtatatgctctgaattaatgtccaagatttgatactatttcttccatagccaggattcatggatccaggaattatggggtggaaacgggagtagcaccactcaccattatctctagtgatccagtagcaaaatttttgctttctgttcccatgactttatgctctgctggcatggaggtcataattttggagggaagaatcattccgccaggagacacagcaatgattccaactgaactggaagttaagattgatactcggccactttgggctactggtgcctctgtgtcaacaagctaagaaaggagttgtgactctggctaagataattgaacctgactacaaaggggaaacttgactactactccacaatggaggtaaggaagggtgggtctgcaatacaggagatcccttcgggtgtcttttagtatgaccgtgacctgtgattaccatcatgggaaattacaaccacccaattcaggcaagactatgaatggcccagaatcttggcatgaaggttatagtcaccccaccaacaaaagaaccatgaccagttgagttgcttgctgcaggtaaagaaaatacaaaatttttaatagaaaaatgttgttataaatgctagctacaaccacgtgatcagttacagaaatgaggactgtagttgtcatgtatttcctattttgtgaaaaatatatgtgcatatgtacatgtgttgtttttgttttcttatttctttatcatgtaatacaagatttattgcatttatatcagtatttaagtatagttaattttacatcaacatgtttaagttatggcatatcagaagagtaaacattgcctaagggatttgcctcctattctgggaagagattagtgcatttttggttacacacgggatagttacatcatgttaggcagacgattaccctgttactgtctttatttggagattaataaatctccaaataaagataactttttttttgttttttttttgttttctttttccccaccagatcttgattttatttagtagtactgatcaagtttaactccatatcaaatgtaaaggttgatattatttatgatatctgtcaactgtacaaaaagtgaaacatttaaaaacaaccatctgaatgtcaagttttctctccataaaggatttgccaccttaagtactccccatctgcctgaaacatgagcccacatcaatggaggtaaagacctgcataacctacatcagccagtctgcatcctaaaaacctctcttgcttggggcaccccacactagctggtctgctgggagagtgagcaggcaagtttggggagtcaagcacaagcttgagcaagcagcacaataatccatcttcagaatcctcactttgggatggctccacaattcttaaggatatgcatatgggtgccaaattcacaagggacgtacttctaatgattaattttcttgtcaccactagttaactaggcaataatcatggtaaagtaactagaaagcacattccctgagggtaaagaattttatgcattttgtttactgctgtatcctcagcacatagtagactatctggtgaataagagttgctcaatatttgttgattgaattaattgtatgagtaaataaaatagttggagaaagtagtgctacaggaaagaataataaaaacatggacttaagcttagaatctcctttctagtctcttgcttctaggactcctagatcccatcttctaaaatagaagaaaagaaagtaaggcacttactagcatgaaccagaaggagtctgtgttagacaagtaggttaaagacaaaaaggcagggagcaccatactgtcttttgtaactgggaacagagagatgagtctagggaatcaaatcagcttaaagactgtggttcttgtggccactaccattttcttcagcttccatcatagttcttgacctctttattctgttgcctccacacagcagagggcaagactgatgagaactccaggatagtataattatagctcccaattgagaggaaagagtatttctcttactgtttgcatataaaatcctaggagataactccagttggtctaacttagccaattcttccaaataggccttaagctgcaagaaagccggacatttcctcaactaagaaactgcagcaacayggtgggacaaaaaatggataataacctcctagaaaggatcactgtggagatcarcataactgagacttctggagacagctgcaaacaaggaagggcaagagctatttattggccatgcagtggttgccagcacatccccaaagactggctctgtggaggactctggtgatcttcatgcctgagacctccacagccctgtggcagccttgaactccttagttccctcctagtatttagtggaggcatatggaccccagtagcttgtgccatgaaagataccagcagctttcaccactgaggtagccaacagccaatgccaccttgtgtccttgggtgagggagatattgctgcactccctgactmccaagaaagagctgctcttgtaccaccctgggacaaggcaaccactcttgccaaccttgggcttaccctaaccgcaartggtggttgctctagaccctggctcctatgcagcctccccatctccagcctcagacaccagagccaatccacagcaggcgcctccacaccccttgctgtaactctgcttctgcccaggctctagacactaaattcayggctgcccaacaagctcccatgcctcatacaccattaccaaagaggcagtgggaggccctgcaccatgaaaacaaggrcctctgctgtctcagacccaggaggcctgaaactccgtgacagcctggttctagacatgggcttcctggccactccctgggcaccatgcatcaggcagtgtccctatcatataagcacacctgtgagctatacctggcaccaagagggattccttcttctaagacttcctctattggagaaaaacagatcaggacgacctcagcagtcttcaccacctaagaccccaacagctgtcctcaatgctgtggacataacagcattggccactgggaccctgcaatcttcagcatcactgccctcagctgatgtagctgcacctagactatgtagactatgcccaaatcagaacgggaaccacatcatcccacccagtgcacaaatagtcttaacacatttaagaaagttgaaatcatctagtatcttttccaaccacaatggtatgaaactagaaatcarcaggaggaaaactagaaagttcacaaatatagtcatgtgtagtataataacatttccrtcagggactaactgcatatactactgtggtcccattagatagtaatctagctcaaaaagtcctgtttcctagtggcatggcagcagcctaatgactcagcacaacacattaccttttctttgtttagatacacaaatacttaccattgtgttacaattgcccatagtattcagtacagtaacaggttgtacaggtttgtagcctgggagcaataggctataccatatagcctgtttgtgtagtaggctttatcttctagggttgtgtaagtactctctattttgttagcacaaatgacaaagtcrcctaacaatgcatttcgcaggatgtatccctgtcgttaagtgatgcagactgtttgtggaaatcaaacatcatacttctgaacatccaataggtcaaagaagaaatcaaaagagaaaatagaaaataagagaaatgaaaacaaaacacaacttaccaaaacttacgtgatgcagcaaaagcagtactaagaaggaaacacatagtgatattaaaaaagaagaaagatcacaaacaactgaacttgacatctcaaggaactagaaaaagaacaaactaagcccaaagttagcagaaggaatgaaataacaaagatcggaacagaaataaattagaaactagaaaaacagtagaaaagatcaatgaaacagttggttttttgaaaagaaacaaaattgacaaaactttagctagacaaagaaaaaaggaagaaaaataaaatcagaaatgaaaaggagacattacaactgataccagagaaatataaaggatcgtgagatgactacgaaaaattatttaccaacaaattggataacctagtgggaatggataaatccttagacacatagcacctaccaagactgaatcataaaaaaccagaaaatctaaacagactgattatgaataatgagaatgaatcagtaataagatgtctcccatcgaggaaaagcccaggacctgatggcttcattgctgaattctaccaaatatttaacgagcaaatatcaatcattctcaaactttctcagagaaaaaaaaaaaaacttagaagaaggaatatttccaaactcattttaagaggccagcattactatgatagtaaggtcagacaaggacaaaacaagaaaattacaggccattaatgctgatggacataaatgcaaaaatcctcaaggaaatatcagcaaactgaattcaacaacagtttaaaagtatcctagtatcctagggatgtaaggatggttaaacattcacaaatctataaatgtatatgtaccatagtaacagaataaagaagaaaaactatattatcatctcaatagatgcataaaaagcatttgacaaaactcaatgtcctttcatgataaaattctcaataaattagtgatagaaaaaatgtacctcaacacaataaaagccatatattacaaacccacagctaacatcatacataacagcaaaaagtggcaagtttttttttttttctaagatcaagaataagacttgaatgcctactctcaccacttctagtcaagatagttctggaagtcctagacagaataattaggtaacaggaagaagtaaaaagtattcaagtcagaatagaaaatgttaaattgtctcttttttgcagacaacacggtaatttatatagaaaaccctaagaactccactaaaaaaccttacaacaaatgaattcagaaaacttgcagaataaaaaatcaacatccaaaaatcagtttcatttttgtataccaatttttgtacacaaataacgagctatccaaataagaaatcaagaaaataatcctgtttatgatattatcaaaaataacaaaataggaataaattcaaccaaggaagtgaaagttctatatgctgaaacctacactataagacactgatgaaataaattgaagaagattcaaataaatggaaagatattccatgttcacagattggaggaattaatattgtcaaaatgtccatactactcagagtaattgacataatcagtgaaattcctataaaaattacaatgacattttcacagaaatagaaaaaataatcctaaaaatcatatagaaccacaatgacccagaatacctaatggaatcctcagcaaaaagaacaaagctggaggtcacatattacctgaatttaaaatatgctacaaagctatagtaatcaaaacatcatggtactggcattaaaacaaaaacaacaacatataattgaatggaagagaaataaatctacttatatatggtcaactgagttttgacaaaggtaccagaacacacaacagggaatgagcatctcttccacaactgggtatcttcatgcagaagaatgaaattagactcttttctcacaccatatacagaaactgactcaagatggattaaagacttaactgtaggacctgaaattgtaaaacttctagaagaaaacataggggaaaagctccatgatgttattctgggcaattattttttggctatgaactccaaagcacaggcaacaaaattgaaaatagacaaagaaattacatcaaactacaaagaaacaatcaacagactggggaggcaacctacagaatgggagaagatatttacaaattatacatctgataaggggttgatattcaaaatacataagaaactcagtcaactcaatggtaagaaaacaaataacctgatttaaagatgggtgaaaggatctgaatagacatttctcaaaagaagacaaacaaatggccaacaggtatatggaaaaatggtcaacatcactattgattaaaggaatgcaaactaaaacctaaaagatattgatacacaagctaaaaagaaattatttagacaaatagtgagagtaaaagagtcctcagtaaggtttcccttttaataaaaagcagcccccaaatcatttgttttctaacaaagaggagcttgatttttcttttctaacaaagagcagcctgaaaaatcaagctggagacatagaaaagcaaggtagaagcttgcacaggtaaatgctggcagctgtgccaataggaaaaggctacctggaagccaggtatgttcaacatggaggccccatcttcctttttctttgtcaaccacatgtagtaaaggaacaggcaacatggtgctggccaggtagagaacccatctgcataataaaagattagggtggggcagccagcttctttgcacgttatgtaaatggtacaccttttgggcctggtgtaaatcagacactgcctccttaagcttatctataaaactctgtgcattggccaggcgtggtggctcacgcctgtaatcccaccactttgggaggcccaggcgggcagatcagaggtcaggagatagagaccatcttggctaacacggtgaaaccccatctgtactaaaaatacaagaaaaaattagccgagcatggtggtgggtgcctgtagttccagctactcctgaggctgaggcaggagaatggcgtgaacctgggaggtggagcttgcagtgagccaagatcatgccactgcaccccagcccgggcgacagagtgagactccgtctcaaaaaaaaaagacaaaaaaacaaacaaaaaaaccccacaaaaccaaaaaaactgtgcatttcaccacaggactggaagacccactcgagagctcccctctctctgcaggagagagagcttttctctttctttcacatatcaaacctccactcttagccttactctttatgtgtctgcatccttgatttccttggcttgaggcaacaaaccttgggtattaccccagatgactgatgccacttcaatatcacctcacatctgttagagaggctattatcaaaagacgaaagaaagtgttggtgaggaagtggagaaagggagcccttgcatgcaattggtggaaatgtaaattagtacagccattgtagaaagccaagatatgaaatcaacctaagtgtccatcaactggtgaattcttaaagaaaatgtatatacacacaatgggatactattctgcttcaaataagaaggaaatcttatttgtgacaacatggatgaacctggaggaaattatgttgagtgaaatagaccagccacagaaagacaaatactacataatctcacttatctgtggactctaaaatagccaaactaataaaaacagagtactatggtgtgccagtggctcgggggtgaatgttggggagatgttagttaaagcataaaaccttctggtataagatgagtaagttctggggacttcctgtacagcatgatgactgtagttaataatgtattttgtactcaaaatttgttaaaagagtagatctagagtgatttcaccatacacacacacacacacacacacacacacacacacaatgctaactatgtgaggtagtagatatgtcagttaggttaattgtggtaatcatttcacaacgtatatgtatacaaaaacatcacattgtataccttaaatttatagaattttgtttgtcaataatgcttccaagaagctggaaaaaaataaataaaatttaatataattttcatagattaaatgaatgacatgtccttcatggacatcttgacaacattttctaaacatctttaaagtactgtttggctagcaaaatcagtaatttttccagaagtctctcttaaggaaataataaggggcatacaaaaatttatgtaaagttgtaattacaattatgtgtactaaaaaatcccaacttaaaaacaggaactaaataatttgtggtatattaacatatagaatatatggctgacaaaaatcacattttaggaacctaataccacaggaaattgttcagagtgtatctttaattgaaaaaaatcaaggtttaaaacacatggagcatgatccttgttttgtgaaaactaaaactaaaacccaaaaaagctctaatagaaaaatatttaaaatatgcataatattaataatgtggttctttctatgtaaaagattaaaggattaccagtggattttattttattttcttcctggtgcttttctgttaatttgaaatttttatagtgaataatgtatttaatttgtcacaacatgaaagataaaaagatcttaacattcctatttgcaaatttttatccaatcttctttgtatataccttaaatagctaaccagccttctgaagcgctcctagttatatttggcaatttatgtagagatatttcaaagtgcatgtatcttatagaaccgtgtatttatttatttttttgggtgaagaaatttggtcctttaggttttgtttctgcaataattgcatatttctccccctttaaatgatctgcactgaaattcactgaaagaaagcattttctaggagtcaattgcagggaggccgcaataaacctttatggatgtgaaactttaaatataacagaagtcttgatttgctttcttttataaaacctaccatcaatgggatgttagcaagcactgtgaatggctcaataggatctatggatagttttctctattcatgagatgggaggaatataaaatgatttcatgatgactgattaattaaaggagtatagaagagtagcagaatggtgttatgcaggtgggaaaccagaaacgtttcgtttttatgcaaacaggcttagggaaaaaagacagaaaataaatagaggcagagcaaacccactgtgttactcaggaaaaggtgttactaagtcagtcttcaatgcgcaggaatgattccagaggcccaagatatttcgctgtttaattcaacacttagtgtctcccattactgattcattttttatgtttagctcttatatttgggtacagagtggcttattgatgttaatgagcccacttctgtacaccaaaagttgacagaaaaatatattatttactttgcagaggaacaaagcagtcagagaaaattgtggaggactagtaactcaagaacagatgtagatttaaacaagtgacaagtgcagcaaaactctttattaggattttaatgatcttaattttgcaatgatctgtcataatttcaacaagaaagcttaaagtcaaaagaagataaattattaaaaataggcttctagtaactactgtaagaaaacaacagcaatatgaagagataattatatacaatatagccgaaaagttggaagactgtgtgtctagtaatagggcatttgttatatgatacattataatcatatagtagtcacctactgtaatatgatataaatactaacaagatggttatgaatactgtacaatagcatgttaatatttatgctctaatattacttaaaaaccagaatattaggctgggtgtggtggctcatgcctgtaatcccagcactttgagaggctgaggcaggtggattgtctgaggtcaggagtttgaaaccagcctggccaaaatggtgaaaccctgtctcttctaaaaatacaaaaattagccagct

SEQ ID NO: 10605 - DNA, 67390 bp, Homo sapiens
  misc_feature (1)...(67390): n = A,T,C or G, or insertion/deletion polymorphism (see Tables 1-2)
gcgctcgactgacactatttttttgagacagagtccattctgtcgctggagtgcagtggcacgatctgggctcactgcaacctccgcttcctgggttcaagcgatcctccccctcagtctcccaagtagctgggattacggcgcatgccaccatgcccggctaatttttttatttttagtagagacgaggtctcaccatgttggccaggctggtttcgaactcctgacttcaagtgacctacccgccttggcctcccaaagtgatgggattacaagcatgagtcaccgcgcctgacctatgacactacttaaaatgatgaaaaatgagaaatataaacatctgacagtggagtgattcaattaattatggtctattcctacagcaaataacatgtagtcaataacattaacatattatgtggagaaaacactcactatgatagcaagagagaaagcaagacaccaaaattgtgtttacagtatgacctcattttttttttccccagaaaaatacagctttatgtgttatgaaaaggctgggagtaaattaaaacgttgatggtttaattttcctctttactcttttgttcatgttttaaagaacatgtattactttgttttttttttttgagacagggtctcactctatcacccaggtcagggtgcagtggcacaatcatagctcactgcaacctctacctcccggactcaaaggatcctcccatctcagcctccagagtagctgggactacaggtgcgccaccaggcacagctaatttttgttttttttttttttagagatgacgtctcgctatgttggaccaggctggtcttgaactcctggacttaagcaatccgctcgcctcagcctcccaaagtgctgggattacaggtatgagccactgcatccggcccctactttcataatcagaaagaaaacaaatctgatgtcttaaacacactaaatacaacgagaacaacaataaaacaagtttgttcacgccttctgtagaactgaaccttggggtgccctgatcgtggctcaaytggctgaatttcaggctctaactctccagatcattctctcgggcttcatcttaacttgccctcagtctgccacagataatccttaggaagtgaaggaaagacatctgattggcagtttctgcccttcctccaggacaggggagtccccatctggcccctgctccctgtcccagcctctgcgtctggtctctggataggcagtaaacagcagcaccacctccttacctccttcagtgaccgttttaaaccagtccaggagcttctccaaacaggtgtcatctgccaccggctgcctgggatctaccagaacagcacagagagccgggagcagctgggcgcattctgggtccatggtgaggccgcaggccctgcaaaggcaatgtgagagccaaacctcaatgcccactccagacccagctcgctctagtcacagcagcccaccatgcctgctcaggcctgggaaggggccccagaactttcatctcagaccaggagaaccatgatccccagaccagaggtctgtactgcagggatggatgcaaagctttggtctaggtggggccctgagcgctggtggcggggctgaaaggggcagatgagggtctagctgaaaccacaaggcctccggaactcaaagtctgtcacccttggtctttggtgcagtcggggcaacagcgtggtgctggcccaggctgcaggtgggccagagtcaggggcatctttgagttccggggtcagccatgtgtgcaaggggatgtctacccatgccccagggccagcctgggctggaaagtttctgtccctcccagcgtcaagtggtggctgcatttgacgtcctgaagccagcaggggggtgcggaggggaaggggcgcctgtccgtgtgtctgtccctctcagggtcagtggtggctgcatttgctgttctgcagccagtaggagggtgaggaggggaaggggcacctgtccgtgtgtctgtccctcccaggattagtggtggctgcatctgaagccggcgggggggagaggggggcggcggggtgcggaaaggaaggggcgcctgtctctcccaggaccaggtgtgcatccgtgcgtccagcctcgggggtgggcggggtggtcagcggctctgtctaaccggggcaccgtctgccaatgcccgggaaggctgcgtcccgggaagaggaaccctccccacactttgaagtcagttttggccgcgagcgccaggcccgagagtccagaaggggcgccagagcaggcggccacagtcgggctgggaagcgagcccaggtcgcgcacgccccgggctgggctgctccctggcccgcccgcccccctcggccgggtcttggcctccccgcgccccactaccacgacctcgacccccgaaggcccacgcgcctcaccgctcggttgcgtcctccgccgcaaccacccctcgcccaaggctccgcctccggacagtgccacctgccaggcccggaggaggcggaggacggagacggctggcgtggggaactgagactgcacccctggaggccgctctggaagcctcgagggcccagacttgaaggaaggagttcaagctgagaggggctggggacaggcaggcgccaagccggtcgctccgacagatcacccccgccaggcgcctagtggttcatgccgagcatccggtgggtgggcggggcgtctcgagggcggggatctctgaggaaggcgcggggttgtgtccggaggggcggggcttcgcctgcagggcgcccagtgtctgcaccggcgggagcgagaaaactatgtgccggagagaagcgtcctgatccgtgcaccaaagcccttggtcatttagcttcaggttctcaaattaagtcctccgcggccgcgctgtggctcatgcctgtaattccagccctttaggaggcgcagttgggaggattgcttgaagccaggagttgagaccagcctaggcaacaaagcgagaccccatctcttaaaatttaaaaaaaaaaaaaaaaaaaaaaaaaaaggccaggcgtggtggctcacgcctgtaatcccagcgctctgggaggcccaggcgggcggatcacgaggtcaggagttcgagaccagcctggccaacatggcgaaatcccgtctcgtctctaatttttgtatctctaagatatcaaaattagccggacgtggaggcgcgcgcctgtaatcccaagtactcgggagactgaggcaggagaatctcttgaacctgggaggcggaagttgcagtgagccaagatggtgccactgcactccagcctgggctacagggcgagactccgtctcaaaaaaaaaaaaagaaaatcagccagacctggtagcatgcgcctgtggtcccagctactccagaggctgaggcgggaggatcgcttgagcccagaagttcaaggctgcagtgagctatgatcctgccccggcactccagcctgggcaacagagcaagaccctgtgttttaagaaagcaaacaggcagaaaaactaggtccaaaaaattgagttcaaaacactaactgtgtgttcgagagtctcaaagccagtggatagacaaggctcatgttcccaaagcattgttttatagcaagattgttgggagccaacaccagatttaggaaacaaagcagaattcctatggatattaaaatttaaaaatttaaaagcactgactttgctgggtcacctttattttatttatttatttatggagacggagtgtcactctttttgcccagactggagtgcaatggctcaatcttgactcactgcaacctccacctcctgggttcaagcgattctcctgcctcagcctcccgagtagctgggattacaggtgcgggccaccacgcccagctaattttgtatttttagtagagacggggtttcaccatgttggccaggctggtctcgaactcctgactttaggtgatccgcccacctaggcctcccaaagtgctgggactaccagcgtgagccaacgcgcccagccgtgctgggtaaccttggaaaagcaacttccctgacgcttgcatgccccctgcacacacacacacacgtacatccttagaactacatgtgtgaaaaagtttgaaatgcacagttatcttccctgaaatttggttcctcattgtgaaatgagatactaacattcacccagttaggtaattgtggagtaaagaaaactcaacaacagcactgtgctaagtgcttcacttactgtaaacttgtatgattctacagcaacggtaggagagtaccactaccagcccatcagatgaggaaaatgaggcacagagaggctaactcataaggccttacagctactggattggcacagtttggatttgaacccaagcagtctggctccagatttgaatattgtattgcacaggtccacaattttttttttttttgaggtggagtctcgctctgatgtccaggctggagtgcagtggtgtgatctcagctcactgcaacctccacctcccaggttcaagcaattctcctgtctcagcctcctgagtagctgagactacaggcacccacgacccctggctaatttttgtatttttagtagagacagagtttcaccatattggtcaggctggtctcaaactcctgacctcaagtgatccacccaccctagactcccaaagtgctgggattacaggcgtgagccaccatcgtgcctggcccaggtccacaatttcttatctcaaacttttggggacaaatgttttttcagaattcagaactgttcagattttagaaatgtgacatggcacatgtacattaaatatgagattacagcagagtgtgacacacaccccataattaaacgtattaatagttattcagggccgggtgcagtggctcacgcctgtaatcccagcactttgggaggtggaggcgggcggatcacgagatcaagagagcgagaccatccttgtcaaggtggtgaaacccgtctctactaaaaatacaaaaattagctgggcgtggtggcacgcacctgtagtcccagctactcgggtagctgaggcaggagaatcgcttgaacccaggaggcaaaggttgcagtgagcggagatcgcaccactgcactccagcctgggccacagagcaagactccgtcaaaaaaaaaaaaaaaagaagttattcagtgaaactcactcatgtacaccccgtgggataaataagcactataaatagcctcagctcagagttttcctcccggagagttgaggttaggactggtctggccttcaaatgagttgtgaagggctttcggaagtttgtggaattcagaatcacagataaaaggtcgtagataggcgctggctctataattagataagagaagggcaaaaagtttgcgaagcccaagggtgggagagtggcaagaggtacttatgcacagggagcacgtagagcaaagcgccctgggtgagaccctgaaagcaaacgaaagtttattatgtgtgtttgtttgattgagacagggtcttgctctgtcgcccaggctggactgtagtggtgcaatcatagctcactgcagcctcgacctcctgggctccaagcgatcctcccacctcagcctcccgaggagctgggactataggcgtgcaccagcatgcctggcttttatttttattttatttttcgagagacggggtctcgctacattgcccaggctggtatcaaactcctgggctcaattgaatctcctgccttaggctcccatagtgttgggattacagacgcgagccactgcgccgggccggtttttttccccctctcagcccccgcgctccgccccgggaactccgggagcgctcctggtcggccggccggcgcccgcggactctgcgcacgcgcatggtcgccccagggggaacgcaggtcgcttacccggctgggtaggtcggcggcctggttgccatggcagcggggtcgcgggccggcgccagggaaggccccgaggctgcgggcggccagggctgcccgcggattcccagacccggacgcccgagccagcaaccctgaggggcggccgggcagcgccgccaccatgttcctgggcaccggggagccggccttggacacggtaagaacgggcgagggggcgacgccgggcgggcgtccgcgaggcctcggctcgtctccgtcgcccgcagcctcggggccccgcgcaggggccggcccggggcgtgaggacggggcgcacggccgggtgacagctgccattattgttaccgcacaagagcgcgctgcaggccccgcgccgcctgcagcctcgcccgcgcccgctttcgcagaggccgccgcttccaggaagctctccgggacgccgcgccctcgcctctgggcgcctgcgagtctgcggcccgcaggtgacggagctcacggtgtaagtgcctccgggcacccccgatctaaggcgggatccacggatcccgtgtggccccaagccttcggggtgggagggaggcagccccagggtctgggaacccagcttggtcagaggaggcttcctggaggagggtggggcccgatgtactccccagggcgagggtgcatgggccttaggttagttactttgcccggtaaatatctactgtgtgttagagacacgggaataagctgcattccagtggggggggggggggcggagggacaaggtaataaacaggtaattaagatcgtgtcagaaagtgagaagtgctgtgcagaaaatgaaacaggcccatatggccgggagccgtggctcaggccggtagtcccccggtagtccctgcactctgggaagccgagatgggaggatcgcttgaggccaagagttccagaccagcctgggcaacatcgcaagaccccatctctacaaaaaaccatcacattagccgagctgtggtggtgcctgcctgtagtcccaactactcaggaggctgaggtgggaggatcgcttgagcccaggaggtggaagctacagtgaactgtgatcatggccctccaaggcctgagagacagagtgaggctgaggtgggaggatcgcttgagcccaggaggtggaggctacagtgaactgtgatcatatcacggccctccagcctgggcaacagagtgaggccctgtctcaaaaaaaaagaaagcccgttgggacgcgggcaaggagactgagcagaagatgggcatgagcctgactatggggagtcctgctggccatgcagggaatttggattttattggagaaacagaggaagcctttggaaggtttcacatcaagggaactgtgctcaccttgcttcctcctaaggagaccacagggttcagcacagctgcacccgcagtaggggcttggtgctgctggccaacttggagcagctgaagttgcctgcttgttccccagggcaccacgtcctgtctcatctggagggcctgcctgtctacactggccttcagttactgcttcttcatctttaagaacaaaactgcttgttgtgattataaaaataatttatgtatattatttattttttattatttttttaagacagagtctcttggccgggcacggcggctcatgcctgtaatcccagcactttgggaggctgaggtgggcagatcatgaggtcaggagatcgagaccatgctggctaacacagtgaaaccccatctctactacaaatacaaaaaattagccgggcgtggtggcgggcgcctgtagtcccagctacttgggaggctgaggcaggagaatggcgtgaacccaggaggtggagcttgcagcgagccaagatcgtgccactgcactccagcctggcagcagagtgagactctgtctcaaaaaaaaaaaaaaaaaaaaaagacacagtctcgctttgccacccaggctggagtgcaatgatgccatctcagatcactgcagtctctgcctcccaggttcaaaggattctcctgcctcagcctcctcagtagctgggactacaggcgcctgccaccacacccagctaatttttctattttcagtagaggtggggtttcaccatgttggccaggctggtctctaactcctgacctcaggttatctacctgccttggcctcccaaagtgctgggattacaggcgtgagccattgctcccagccctatgtagatctttgatttctttcagcaatggtttatatttttcaatgtacaaagcctatgcttttgttaaatttattcctaagtattttatgctttttgatgttattgtatattgaattttcttaacttcatttcagcttatttactgctaatatatacaataattttttttttttttttgagatggagtcttgctctgttgcccaggctggagtgcagtggcgcgatctcggctcactgcaagctccgcctcccgggttcatagcattctcctgcctcagcctcccgagtagctgagactacaggcgcccgccaccatgcccggctaatttttttgtatttttggtagacacggggtttcaccttgttagccaggatggtctcgatctcctgacctcgtgatgcacccgccttggcctcccaaagtgctgggattactggcctgagccaccacgtccggccttacaataatatttttatatgaatctcatatcctgcaaacttgctgaactcatttattatgtttactagttttttagtagattcattaggattttctatgtataaaatcatgttgtctgtgaatagagatagttttacttccttcttttcaatctgaatgtcttttatttacttttctcacattaatgtcctggcaaaagactcaagtataatttgaattgaagtgatgagaaaggacagccttgtcttgctgctgctattagaagggaaacattccgtcttcctctgttaaatattgtgttgccctggatttttgtagatgccatttattaggctgaggaaattctcttcatagattattgagtatctttatcatgaatgagtgttagattttgtcaaacataccttctgtatcttttgagaaaatcatatgtttctttttcttcattttattaatatggaatattgactgatttttgtatgttaaaccaatctttcattcttggtcttggggtgtgtgtgtgtgtgtgtgcacataaatatataccagtaccaattagggtacatatatatatatatataaaatccttttcatgcctactagcattttgttgaggatttttgcaactgtattcataaagaatgttggtctgtagtgttcttttcttgtgatatttctttgtctgcttttggtatcagtgtaatataggtctcatagaatgaattgggaagcatttccttcttttctgttttttagaagggtttgtgaagcattggtattaatttctctttaaatgtttgatagaattcaccagcgagaccatgtggttctgggtgtttctttacttctataaggtcagtagtgaggccccctttttttttttttccccctgtattttggtaatttcgtgtctctgggttttttttcttggctaaaggtttgtcagttttgttgatcttttcaaagaaccaacttttggtttcattgatttttctattgtttctattttctatttcatttattcactgtaatttttattcctttcttttacttcctttgagtttagttttctatctcctggttctgaaggtggaagtttagattattggattattgccttgagatctttctttcttttttttttttaatataggcatttacagctacaaattgccctctaaacatggcttttgtgtttttgattatttgtttttgtttttcagagacagaacctcactctgttgtcgatgctagagagcagtggcacaatcacagctccctgcagcctcatactcctgggcttgagtgatcctcctgcctcggcctcccaagtagctgggactacaggcgtgtgccaccatgcctggcgaattttttaattttttgtcaacactgggtgtcactatgtcacccaggctggtctcgaacttctgggctcaagcagtcctcactccttggcctcccaaagtgttgggattacaggcatgagcaggtgctcagcttgcttttgtttctttgcgcctggagtgcagtggtgcgatcatggctcactgcagcctcaacttcccggacccaggtgattctcccacctcagtctcctgtgtagttgggaccacagacatgtgccatgatgcccagctaattaattttttgttgtgtgtgtgtgtgtgtgtgtgtgtgtgtgtgtgtgtacagggtttctccatattgcccaggctggttttgaactcctgggctttgagtcccaaagtgccgggattacaggtgtgagccaccacgcccggccctgcttttgttttttaaggtggaagattaggttatttatttgatgtgatctttttaaaatatagacatttacagctgtatgtttctctttgagccctgctttaggtacatcccataaattttgatttttaaaattcactcactttcggaggccgaggcgggcggatcacgaggtcaggagatcgagaccatcctggctaacacagtgaaaccccgtctctactaaaaatacaaaaaattagccgggcgtggtggcaggcgcctgtattcccagttacttgggaggctgaggcaggagaatggtgtgaacccgggaggcggagcttgcagtgagccgagattgcgccactgccctccagcctgggtgagagagcgagactccatctcaaaaaaaaaaaaaaaaaaaaaaatttcactcatcagccgggcacagtggttcacgcctgtaatcccagcactttgggaggctgaggtgggcggatcatgaggtcaggagttcaagaccagcctggccaacatagtgaaaccctgtctccactaaaaatacaaaaaaaaattagcctgacatggtggtgcacacctgtagtcccagctactgaggaggctgaggcaggagaattgctttaasctgggaggcggaggttgtggtgagccaagatcatgctattgcaccccagcctgggcaacagagcaagactccacctcaaaaaaacaaaaaatttcactcatctaagatatttttaaatttcccttgtgatttcgtcttagacccattgattatttaggaatttgttgtttaatatccaggccaggcacagtgactcacacctatagccccagcactttgggaggctgaggcgggtggatcacctgaggtcaggagtttgagaccagcctggccaacatagtgaatataaccccatttctactaaaaatacaacaattatccgggcgtggtggcggcacctgtaatcccagctactcaggaggctgaggcaggagaatcgcttgtacccgggaggtggaggtggcagtgagccgagattgtgtcactgcactccagcctgggcgacaaggcgagattctgtctcaaaaaaaaaaaaatctatacatttgtgaattcctttcttttgttgatttctagttttccttgttgtagaagaatatactttgaatgattttctcttttaattcattgaggcttttttgtggcctatggtctggtttatgtttaatgtacacttgagtagaatgtgtattgtgctgttgttgagtggggtgttctgtaaatgtctgttaggtttttagtgtctgctgatcaagtttttctaactcctygttgatcttctgcctcgctctcctgtctgttaggagcctggccctgccaacaccttgattctggacttccagcctcccaaactgagacagttaatttcagtgtgaaaccaccccatttcttctgttacaaccaccctgacacaggctgattgagcttaacctactgtggaaataagtggcaacctcagatagtgcttgaaggaggcggaacagattggccattttgtgtgagtgcatgtgtgcgtgtgtgtgcgtgtgtgtgtgtgagtgcatgtgtgcatgtgtgtgaktgtgtgtgtgtgtgtgtgtgctgtgtatggttgtattctgctgactgyagtcatggatccttggactgttgtgtgattttaggtgcgtgcatgagtgtgtgtgcgtgtgtgtgtgtgcatgcgtgtgtgtgtgtgcgctgtgtatgattgtattctgctgactggtgtcatggatccttgggctgttgtgtgatttccggtcctgactgcgtttcacctcttccctgcactatgaccggcaggctggaggcagcacggctggaagggagtggtggagagggcagccgttgtgggtgagatcaatgcattttgtttactacacataaaatctcattcctttgttgaatttcaggtcattcaaaaagtcttcaagattttattcacagcaaggaataatgacagatgtttacagagaaagttgctgctgcttttctagacagttttcagcagtttcccctctgttctctgcaggcacgtccttgtgatgcccagggctgacttggcttttctgatcccccgctaacctgtgtgtccagttcccggcctgcccttcctcaattttgtncataatttcaatacactttgctaaaaggaaaacttctctctataattgtcatatgctgtttatgtcttaaaaggtcaccttaaataggtgrtataaaaaatgatataaaaaatttcagtcaatggctgatttttttaaacgctccatttatttggaatgcaccgtctttcctttgcccctcgaaatgcagtcacattgcacttgtgtcctggcctgtctagttgcaccttatccatgttatcatgcagccaggcatttctaatacagtttcacactgctagcaaaattggcacttcatgtactattagccttgtagaaaataagtttgcttttcagaacgcagtagcatcccattatgatactgcgtggactcagctataccagggacaggtagcacaaatgtcatcacctccaccccaagctgtagaactattggctcataatggggcattcagctctaacttccagtgtccgcattggaaagcaccaatatgatcttccgagggactttaaacattttatgcttctctttttggatttcaatttgagtgaatgagttaatacagaaacabttttgtcttcaaaaagcttcctttttttttttttttggccatcctcgtgctgaaatcagacagtacaagtcttatttcattccctggaccaggacaaagtcactggaataagaaggcaagaacctttataggcccaaatgccttctcattgtaatgcatatgttttggtttttgttggttttcgttttktttttttttttttttcccagctggggtcttgctctgttgcccaggctggagtgcagtggcatgattatgactcactgcagcctcgacctcctaggctcaagcgatcctcccaccttagcctcccgagtagctgggactacaggtgtgtgcaaccacagcctggcttattttttaaatttttaagattttttttgtagagacagtgtctcaccatgttgcccaggccgagtttgctttttaaaagatgactctcacccgttcttaccaggagacagtcacagattcgttgtgctttgatgtaaagatgaataagagtgagaacatttatgtaaaaatgaaatgctttcagcaagaactggttttgtttttctttgtcaagacacaattctgtgggaaatagtgttactagatttgcagacatttgcacgcctgctgggcggcgttttgtgttttgttccccccacccacccattccttctgatgagactgaggaactggctgctgcccagctggagtgttctgagtggcctcagagctggatttctggagtttctgtttcagcagctgtggacgggctgttttcgcttttgtaaacgtgatggtcggaagcccagcaggtgccgtcgagttacagtgtttgcctctcttcctccagggagatgacagtctgtctgcagtcacctttgactctgatgtggagacggtgagtgccgctgggtgtcagccgtgcgacctcgggctggttgcgctgcccttgcagactgcactcggaagcgtaaaataggccgttctccacaatactgtgtcgagagctggaatgcatattccgaatgctccttggtgtttgaaaagtttccagcccttaggtttaaatacctgtggtgataactttaaaacttttatctggacgtgaatcctgagcagggctcatgtgagacagattgctagtccctggcctgcagctggttttgccctgcaccccacgccctcatcctgacacttgaggggaggaggagagcccctgctaatgccgtcggaaggacccgatgggagaaagcagacctgggcagccgccatcccaagctgaactgctgcctggcctcccagcccggaaaggagaggggcaggagtggtgtccgatggcccagtggcacactgtggccccggactgggctttgggtttgtttggcaagctgtgctgggtagaaaaggaagtgtgccaattgctcttctcgtgtatgagcraaaaaagcttttcttactggagacgcagatctagcaaacctgcagccagcagaacgaacccggcaccagcagatctcaattccacgtttgctctgtggactcaagggggagcctcagctccactgtctncctccagggacctctgttcgcaaagttaaggattttccctccatgtcacagagggcaggggatgctcctctgatgttccccggaggaggagggatccaaaccaagccccagggaaaattccccccgcgcagaacttggggctcaatgtttctgctggaggggaagtgaggagacctggccgcggtagccttatctgctcggtctagtgcaaggtgatgaggaagttaaggttggaagcatggcagcatcttccccaggccacggcacgacgggttgtgtgtctctaatgcaaaatccaaaatgctccaaaaatggaaactttttgagcaccctcatgaggccacaagtgggaaattccacccttaagtacttcacacaagctttgtttcatgcacaaagttattaaaaacacaatataaaattaccwttgcactatgggtataatgtatatatgaaacataaatgaattttgtgtttagacttgggtcccatccccaagatacctcattatatggatgcaaatattcccaaatcagaaacactcttggtcccaggcatctcggatatgggacactcaccccgtagtaagcagtggaaccagatctggaccccgttctgtgagatctggaccccattgggtgtttggcatcgtggttgtcacaggagaccaccttccagacagggtctccctttgctcggcyttcttccwtagtgggctttgcagttgacttatgtgcagggattcatctgaccacctccacctgagtggacagaggtgcgctgggctcccargctggctgtgcgggcggtttgggtgggggcagatccgccatttgtgtgggaccctcagtctgaacgtcaggagcccgggcccgatggttttctgtaattggaacttgtgctctgagagcccagccctgagcactgacgtgagtgcatttttgtggggtctgcatcgggccctgcgtgtcctgttcctggaccctccttacgtccccgtaagctcacgtcctcttgctgctcttacacgacccctgaccctttctgaacatggtagggtcttgtgatgcaccactgtgggagctcagcaagccttatgccatttcttctttctttcagaaagcaaaaaggaaagctttccacaaacctccacccacatcgccaagtaagtatgacgaggcctgccttccctctcacgccgacgttccctggtgtcctggagagaatgaagggtatttgctttgtacatttaggtagctgagacctgacgcctcagccagttggccccattcccactggggtctcccagttcgcgctggagtctccccctttcatgttggggttcatgctggggtctcaggagcacgtggagtccctgntggtgccagagtgacgagccctttctcagggctgaggctgccaccaactccccagtctcccccgacagtgcctctaggccttttgttttctttttcttgctttctcaaaggcttacctcttctgaatgctgccagagttaaaggatttttgacctgggatttgttcctgagagtcgaagttactgagaaggtgtagttggtgggacgggtggcaagttcacctttttcccctttggatcatcctgggcttgttttgctgccagggttctattcttcctcaccctcagcaggaggagggcagcatttgccaccctgcttgtccaggagggtgccgcggaggtggggttagtccaggtggccccgaggcccctctgtctctaatgccgctctcgtgtacagcagcccgtgtgccgaccttgtgcrtacgaatgtgttcgtgaccctgtaaatcctaggccggcntcctgtgctaccccaaagcctgtggccttccctggctgtgccatctgtagatgtgtgtctattttatatacgcgtatcatatatttcaaaggttcagtcaagtatatgacgcactcagagaatataaacaaactttgctactagcccaaggaaaacataattaggtaaatccctgcacagaaaagaatgcatgttatatgttacaaatcaatataaacactagaaggaaatcacctagcaatttggatttttgatgtcctttctctccttccatggagaaaattgagaattgatataaagtaaaaggccaggaccgggggtgcctcctgactcacactcgggacctgtttttctccgggtttctagtttcgtgagtgtagggaccatgtctgtcctgttcactcagcaagtgtttttctccaaggcctggtcaacctgcttgtaggtttgcagctnccaccacgttccgaggcttttcatcgtcctggtcactctgccaggagggcgaggcaggcgatgatgttttcctgctttccgagtttgtcgttttccgggcagtatcaaacgctggcatctctccaccaccctgtctccgtcctctcttcttccctccccgcttttatccccgctttcatgctttcctgaggaacccttcctactcgccgataagcccacacactcttaggagggaaatgtaatgtgtagggcttttttctgctcactcatttacttgtataaatgacaacttaaatctttacgttttggaagaatttgagactatctsggaggccaggttctgtggtcccgggtaagtgaagatgcagcagggtccctgcgtctttattccctcattcacagttacggtggcgaatttcacataaattgtgaaaccgcgggaaaaacttagaaacttaaacattttgaacatattagacttaaattttcagaccctactgacatacattttgcaatttaagatatataagaatgttttaagagtgccttagtttttgcatacgtttattatcttttttatacttaaagagggaaaatctcagataaagaattttaaaacatttcccttactttcatayaaaatcaagaatgccctgaaacagtaagatttttctcatttattttagatattttacatattaagttctaaatattgctctgtcactatgtagtgacattaaaaatgtgacatgttaaaaaggcacaaaacgatgtgttcactgtggctgtgagtgtgtaagaacacgcacatctctcaaaattgggggtgagaaattaaatgctataataaatgttggtagaattcatatatttcccattatattcttcccattcttttcttttcttttcttaagaaaagcctgttacccaggctggaatgcagtggcatgatcatagctcactgtagcctcgacctcctgggctcaagagatcctcctgcctcagcccccttgagtagctgggaccacaggtgtgagccaccacacccagctaatttttagattttttatagagacagggtcttgttgtattgcccaggctggtcttgaattcctggcctcaagcgattctcctgccttagcctcccaaggtattggtattataggcatgagccaccatgcctggcctcattatgctatttctttataataaaagttaaaggagaaatgtcagtatataggtaaagtaactcttttttcatttttgccagaatgtttgactagagtcaccacgctcgtggattttgttttcctatttctgtctttctgaagttcatgtgttgagctcacatgttgctgtccggcacctctgaatccacgtgttggcttttccagagtcaccttatctctctaagccragaaaagtggcctcctggaggtccctcaggacggcagggagcatgcctctgggcggccragcgtccctgaccccgcagaagctgtggctgggaaccgcaaagccaggtatgtggttgtcgcactggagacccttcctgcttgagagaagagttcgagaaatttcagggagtggtttgagatggagtttttaatattccttgtttgaattacattgtctttagttttctcraagacatcaaatatacacatcrtagttttatgtcatgcataaatgtggtttcgccaagtggcgctttagcctcccttggtcccgtgtggtctctacrtgggagtggtgagttgtcttgccagagccaactgttatagtcttaggagtttggtgggctggtcagtgtcatgctggcaacctgatattagacatggtagaaatatgtataccgtggaaataggcaaacattgtaatcaggactntattaattgatatttgggagctggttggttaaccatttaccagcacgacactgacggctggygtctatcagtgattcagctttcttcaatccaggaaagttgattagaaacaaaacctcccattgtgtgtgcttgtatctgtcatattaaacccatgcacattcaaaccaggaagtctgacccaggccctgaactcacccctcacctgggagmatgcgtggacnggcgtccccggyggcactcctgactgtctgacagacaccttcagagtgaagaggccacatctcaggcgctctgccagcaacggtgagcatgccgatggtggcgaggctgaggccaaggaagagcagaaaggaaaggacagtctctgggctggaggcgtccttcgtcagagcaggatttctggcttcgtgcatgagctccgtcactgggaggttttgggaggtmgtgggagcagtgactcacacagtgactcacaaaaacccgcctgccccagaaggtagctttcctngtgggtgcagggatatctcgccaggtgtcatctgtacctccctccctaaacatagaggcgtacttaaatttattcattgagtaaatgatattaggaacaaatactaataaataaataatgataaaaagwncaagtcgcaccaaagagaatcagcttgtttctgtgtttatgttcctgcctagtctctttttttttagagacggaatctcgctgtgttgcccaggctggtctcaaattcctggactcaagtgatcctctcaccttggcctcccagaatcctgggattacaggcatgagccaccgtgcccggcctctctctttatccacgtgtttcccacctatcctccttaaggaagaacagcctccagggtgtattgaaaacctcctcactgtactccaggaattgattaccttcctgcttttactggttgggagttatcttttaggctgaaatttagatgtttaatatactaggtatcattaaaaccaaagtaagcctgactgtttttacattggaatgggtgttgagatgctctgtgcattttttgtgtttggtatttgtttgttttgctatttaaatctgaacatgtccctcctccttccgtgagtcccttctttcatccttttactgtcatgaaactyggtcttcacatgtttatttatttactttttgcttcatctctctctatctaccatttttgsttttcttgctacttggtgtgaagtatcatgatcaggctggaaaacatggaattattttggcttttttattttcttcttttttaaaaggaaatgttactaacttccaggttttccttaaagtatagccaagaattctttctrctttgtagatagtctttgaaacgatttgtttatstttctctaggtcatgtcccygggactcctgtctacagagaaaaagaagatatgtatgacgagattattgagttaaagaaggtagtatttcrgtttgttctctattgatttgaaacggtgaaagcttcctataacaatgtattagaacatcagtgcctgtgctgggaggtgcccagatgggaagagcgggagcgttagggtcgaacctgagtttgagccgtggcgtagtgccctaggagctggtgtccctggttaaaggccgtagcaccagcacataaaaggcagcagagctcatgttccatccgtgctctgcttctccagcacgatggagaagactggatgaggactagattagcttcagagtcgccttgcgtcctgagatngggtactgtgataaggtcactggtagagtcatcagtaaccttccatgcatgccacgctttatgttatcaagacatctcacatgccctgtctcaggccctctacagaagctctgtgggacgggcagaaccacttgttacaaccackgtctgctgatgaacttgagactcagcgacgttagtggtctgtccaaggttaaccagtagcagaaccaagattcaaggtcacctgcctcccaaggccaagactctgtacttccccatggcccctcccatttatgaaagcatgaactgcattgagctgtatcgtcattgtcactgccaccagcaccgtgaccatcacactggctttcagtatccntaaatgtttgcccctggagaaatcatctgcgttcatttccttccataattttagtctgtttatasagctactgtctccaccagttgatgtgtgtctgagacactgcgttcagttggggcaccagagggcaatagggcattggcagcctcgtccccagagcacggaagaggatctggaagccgtttccattggggagctgggaagaaactggggaacctggtgtagaccattatacaaaagacagcgccttctctgttggccagagagaacagtcagacttgaggctgtgtgagaagaacgctctaaccacgagagctgtctgacagaggctgcgctgctgaggagcaagtgcgcaccctggccatggagattttgagcacaggtggcagctgtgtgtcggggatgttacagaggggatcctcattccggttggaagactgcgctgaatgaactcagtgtggattggggggattatctcgtttgggattttctcagtctcttgaatctataggtttgtcttttgttaaatctgggacattttcagtcatcaagtcttgagttgttttttcagccttgccctctttggttacggctgctcaggtcccttgtctctgttcagtgttttcccctccgtcttccctcgtgaagatcgggtagcttcactattctgtcctcgagctcacggatgctttctgctggcctctgcatcctgcagttgagcccgttgtttgttgggtgtaaccttactgtctcggttcagttctgaaatctctgtgcggctccttctgtcttggtcttcgctgagacgcccaccctgtgcctcttcacttgtttcaagcgtgcctgtcattggtcactggcgcatctttgtggcggctgccctaagtctgtggcgggattccaatgtccaggccatctcagtgttgacattatggcttgtttttcttcattcaggttgagctattcttggttcttagtataaaaagtgatttccttgaaaccaggacgctctgagtgtttcatcgcgagactctgactcttgctcaatcctgtgttgtggcaggcctcctttcacgctgccctgtgggtcaagggggtaccgcctcgttatcacccgcgagggtggaggtccagttcccactcagccatcatcgacacctgcaccgggaggggctcctcattcccactgggcagggtgggagttcaggcccctcactcagcctctgctgatgccgccctagctaggagggaaggtgctgacaccgccctagctgggagggaagggccacctgtactgctcctgctcagcctttgctgatgcagggatggccttgttgccgccaggtaatgatggtcccgactctgcccgacctcctctggagccccaccagtgcgggaggggagggmactgggtgcagccgggcaagggtgagtgtctgggctccccacacagcctgtgctgtggggaggactgtggtgttttccgtggtctgcctggggtagagcggttcctgcctgtcggtttctgccttgtcggtctgctcctctccctgacctctggctggagagaagaggctttgcgtgggtttttatggtctgcacccattggcttttttaggcwgttggtttctccagcatccagctcagatgaggcagaaagaaaactgaaggagctccctgccgtgtcgatcgctggccccccggctcccggcccatccgcctccttctccacctttccagtcttaggttgcattacacatggagcgcaggtgttgagtggtactgacaggaggaattgggaggagtgaatctgcttcacgctcttggaagcggcagtcccgttactagagctcccatcttccttgactgctgggccttcgctaatttacttcacaagctgagtaccggcttgctatcangcctcctgaatctgtgggtttgtctgcaacgatcttgccagctgtggatgtggctgaagtgccgagccgcccccgyggggtgtgcattccagattgtcttttgctcagaggtccagtctctggaataccacagtcttttgcaaggagaaggccgtgtatgaggatggctggcggttagatgcaggctgaggctgggagctggtgagctgcggcacagcccagcctacacgctgtttctttcctggactttaccacgaaaatagtaggaagaacataatttcaaagtacaggatagttgtagagattgaataaacttagttttgtgagaaatccactacagagtctttttttttctttttttttgagacagagtctcactctcgtctaggctggagtgtagtggtgcagtcttggcttactgcaccctgcccctcccaggttcaagcctcagcctcccaagtagctgggattacaggtgcgtgccaccacacctggctaattttttgtattttttgtagagatggggtttcaccgtgctggccaggctggtctcgaactcctgacctcgtgatccacccacctcggcctcttaaagtgctgggattacaggggtaagccaccgtgcccggccccgactacacagtcttttttgtccccactcacgtcaccacaaattggtaaagaatttgtccacagataaagattgggaagcactgccttccacctgagctgtaactgaggatgagcatttgaaatgcatgttagccttggatgagttttattgataaaaatgcgaacaaaacggactttcttgtgtggtcatgggagaaaacgcgtggtgcggcaccgtccagccccggtgttggcggtattcgtttaggcgcgcattccgtgggacggggtttctcatcacgggttccgttggtatctagggtgggaccgttcttctctgtgggggacttcctgtctatccagccttccacgtccccacccactaaatgccaggcgtgccctccggtgccctcacgtgacatccagatttccccccacccaccacacacagagccctgagtgggagccacgcagctttccaaatcccccagctcagtgcttccctgggcctgtgcgcggtgtggtgtgcgtggctgtgtgtggtgtgtgtgcagtggtgtgtgcatggctgtgtacgtggggacgtgtgtgcggtgtgtgcgcagtggcgtgtgcttggctgtgcccgtggggatgtgtgtgcggcgtatacacattggcgtgtgcgtggctgtgtgtgcggggacgtgtgtgcggcgtgcgcgcattggcgtgtgcatggctgtgcgtgcggggacgtgtgtgcggcgtgcacgcattggcgtgtacttggctgtgcgcgcggggacgtgtgtgcggcgtatacgcattggcgtgtgcgtggctgtgtgtgcggggacgtgtgtgcggcgtgcccgcattggcgtgtgcgtggctgtgcgcgcggggacgtgtgtgcggcgtgcccgcattggcgtgtgcgtggctgtgcgcgcggggacgtgtgtgcggcgtgcccgcattggcgtgtgcgtggctgtgtgcgcggggacgtgtgtgcggcgtgtgcgcagcttcgtgtggatggctgtgcatggcccttgttttcttcagtcattgcacgtgcagaagagcgacgtggacctgatgagaacgaagctccggcgcctggaggaggaaaacagcaggaaggaccggcagatagagcagctcctggatcccagccgcgtaagctcctggcgcttcacggacggggcaaggggagggtcctcggggcagcatctgccagccagccctgctgggggctacaccgaaggccgtcttcatgtctcaatctgcttaccacagggcacggattttgttcggactctggcagagaaaaggcccgatgccagttgggtgagtatggtgtgtgcaggacagagcctttccccagacgctagttactggggacagccacagagggacgcctttccctgcagcacccacgcgtgaagagcagcaggcaggggggaggctgcggacccccaaacccttctccactgacacctggggacaccacggggaggggggccagcaggctcaccacagaggccaagcaagacactgtaggaaaaacccatcacaacgggcgacttccccctcacacctgagaaaatacattaagcttaacaagcgctcccagcgctttgggaggccgaggcaggcagatcacttgaggtcaggagttcgagaccagccttgccaacgttgtgaaaccctgtctctactaaaaatacaaaaaagccgggtatggcagcatgctcctgtagtcccggctactcaggaggctgaggcacaagaattgcttgaacctgtatggcagaggttgcagtgagctgagatcgcgccactgcactccagcctgggtgaccaaaaaaaaaaaaaaaaggtgctacagatgtaaatcagggaaccagggcagcaataacgtccttcagatagatccagacccccctcagatactatgtgacaatatgtaagaagttgaatgaaatggaagcagggaagatgttgcggttcggtggtaatgctgtggcgatcagctgtaggtggcacagtacacctcctagcagtcaaggaagtacttctctaaagtgggacatgctggaagaaaaccgaaagggatacgattttgagattattgaacgcaaagaataaaataacattaatgatgtgattaatggatttgataatgtaaaattaaaagttacataataaaaagccatgggactaaggtagcaaccagatcactgtaatgggggaggagaaggatattatggatcaatacaacaaagttttctgtttagaaaatacaaaaaaaactataaatctctaaagaaaaaaggccgtgtcctctgaactatgtcacagatatagaatgtagaaagattgtataatcattacatgtttaaagtagatggtgaaagcctagctcggcacctaggacggcacaaagtaaatccttaacaaatgcctgtaagtagtgggtacttttgtaaagaaaaggctccatgtttttgttgttctggtggtgtgtktgtgtgtgtgtgtgtgtgtgtgtgtctgtgtgtgtctgtgggtatttttttttttcttgagacagggactcactctgttgcccaggctggcgtgcagtggcaggatcatggctcactgcagcattcagctcacgtgatccctggctcaggggatactcccacctcaacctcctgagtacccgggactacaggcacgtgccaccacaggcagctaatttttttttagttttggtaagatggggtcttgcgaagtttcccaggctcatgtgatccttctgccttggcctcctaaagtgttgggattacaggcctcagccactgcacctggctgaggttagtttaaagtaggaattccagatcctagggtatatgcagtattcattatcatatggcaaattgtccatcagtgtggctgtgccctgtggcctgccgtgtctacgtgtcatcacctgccttcaagaaacatttgcagatgtgcctgaggaggcctggccaaggatttcgattggaggattgaccagaatcacaaaaatgggctacaacttaagtatgtgtcagtaggctacagtgatagattttagagcatagccaaaaaaaaaaaaaaagattttaaaagtgtctatctgccgggcacagttcctcatgcctgtaatcccagcactttgggaggctgaggcaggtggatcacctgaagtcaggagttcaagaccagcctggccaacatggtgaagccccatctgtactaaaaatacaaaaaaattagccaggtatgatggcgcgtgcctgtaatcccagctactcaggaggctgaggcagaaggatcacttgaacttgggaggtggaggttgcagtgagctgagatcgtgccactgcactccagcctgggctacaagagtgaaactctgtctcaaaaaaaaaaaagtgtctatcaatagaggctggatagagatactgtgggaaatagtgtggattcacaggcgccagcagggacagagcaccaggagggtttgttgaatgttagaataaaaaaaaagaaagatgcagagggatgtgtgtggcagagccccgtttctgtgagaacagagggcctgactccctgaatgcacacacacggccatgcacagaaccaggtgctgaggggcacgcaagcggaaacaggatttggttggccgaagaggggagtggccaggtcagagtattttagcctctataacatcatcttttttttttgagacggagtctgctccagctactcagctactcctgagtagctgggactacaggcgcccgccaccatgcccggctaattttttgtatttttagtagagacggggtttcaccgtgttagccaggatggtctcgatctcctgaccttgtgatctgcccaccttggcctgccaaagtgctgggattacaggcatgagccaccgcgcccagccctgtaacatcttctttttttaaaggaaaatgtattcatctatgactaacataatttatttgtttatgtatttatttattttgagactgagtctggctctgtcgcccaggctggagtgcagtggcgagatctcgactcactgcaccctccacttcccatgttcaagcgattctcctgcctcagcctcctgagtagttgggattacaagcacctaccaccatgcccggctactttttgtatttttagtagagatggggtttcaccatgttggccaggctggtctcaaactcctaacctcaggcaatctggctgccttggcttcccaaagtgctgggattataggcgtgagccactgcacccggccaactaacataatttaaaatgactttaaaatccartttaaaagttgtctgttcaagcctggtgtggtggctcacacgtataatcctagtactttgggaggccaaggcaggcagattgcttgagtccaggagttcaacaccagtctgggcaacatagtgaaaccccatctctatttaaaagttgtctatttagaagaaaagaatgttcttttttttttttttttgagacggagtctcrctctgtcacccaggctggagtgcagtggcgcaatctcggctcactgcaagctccgcttcccgggttcatgccattctcctgcctcagcctcccgagtagctgggactacaggcgcccgccactgcgcctggctaatttttttttgtattwttagtagagacggggtttcaccttgttagccaggatggtctcgatctcctgaccccatgatccacccgcctcggcctcccaaagtgctgggattacaggcgtgagccaccgcgcccggcaaaagaatgttctttaaagaatataagaatattgtctcctctaagcaagacattcacagaaaaggaggtgaggaggccgctggagctgttctcccttccccaaatagaggggagtggctcctcaggcccctacggccgcgctgtctcccaccctcactcactgccccatggagactgaactgggcggccctaggggcttcaggtctgtggtttatccagctggtgatggggctgcttcttttatttaatataatcaagggcacaccctgctctgtcccccaggtgtgcagtgtgcttgggggagggctgccagtcggtcagtgtgcccacgatggctgccacctcctgctccagcyrgtgtcgcacccctgccattcacccagccttactcagggacaggacagcacagtggggccctccctcttccctgggcccgtagtctagaagagagcacagygctggagggaggaaggacagtgaggtgtgccrgtgctctggcaggaggggacagccgcttctactgagggagagagggcgtggcctgcctgatgggcacgttccccgggcaggtcattaacgggctgaagcagaggatcctgaagctggaacagcagtgcaaggagaaggacggcaccatcaggtgggcgcagggctgcaccctctcccctgccttccgccccgtgttctgcttgctcagacgcccgcctttgttcctcccccaccccgtcctgtgtccctactcccagcccaaagccgaaggtgaatgttagctgcctctttttaatttttttattgtctttgtttcctccagataattccctttaacttcttcctgttatatttaaaagatgctttctcgaaacctgcttgttctgtggacccctgtatctttccaggatgaggttttaacgcctcagtcctgcgccgrccttgtgctgtttttggcgtggctactcgcatttctmtacctgactttcgagtgcgaagggagagtctttctgggcrgtgttttggtttctttaagggaaactgaggccacacgtccattgccttatgtctcctgttcgtacaatagttcccccctcgtttcctgccgaattttgtcaacttaagtttgcagattttgtcttatttcagtgcagaacctccatgactttgctttcgtttctctatcgatgtgtctatctaaagtctactctcttttgagaccgaggggatggcctgacagtgccagggaaaagtgattctctcttccttacaaaaccatccattcaaagacggcttgtcctttctaagctccaaggcctttccgcaccattaatctagtcttttaaagacagcatcttacttggagaagaatatctctggaaaagctgtttactcactttggaaagcggctggtctacacaggagatgctttccagcgtgaggaattctcccatcaggctcgaaacgagtcacttgttcaaggaacaagtcaaatgaaggcccgttcaggcttttccctcccatcctgggtcttttccaaagcctctcctcttctgaacgttctgggaaactcttcctcttgctctgtcccctgggaacgctggcacatccctattaacgctgaacttgggttttcagcaaactccagaccgatatgaagactaccaacctggaagagatgcggatcgccatggagacatactacgaggaggtgcgccgtgctgggcggcggagcggagggcgggcaccgagctgggcggcggggcggagggcgggcaccgagctgggcggcggggcggagggcgggcaccgtgctgggcggcggggcgggcaccgagctgggcggcggggcggagggcgggcaccgtgctgggtggcggggcggagggcgggcaccgtgctgggcggcggggcgggcaccgagctgggcggcggggcgggcaccgagctgggcggcggggcggagggcgggcaccgtgctgggtggcggggcggagggcgggcaccgagtgggaggggaccggcgctggccccgggtggtgggccgagcccaggtggcccagagctgtgctcctggagcctgctcctgcttcagcccaacggaaagatgaagtgcggccacttagttcccgcttctggccgtaggcagcggtcaggactgtgatgttkgtcttttcagataaggtcttctccatgctagccttgtgttttcatgcatttcaatttggtatttacaggtgcatcgtctccagaccctcttggcaagttctgaaaccaccggaaagaagtatgatggccgcttgcaagctgtgttttgtgtgttgccttcacgttgtggaagctcctctgagaatgtgtggctgtcacgtgggtgcggcatatactgcccttagcttggcagtgctgccaacactgcacctgttctgttcagggttagagttgacacgtttccatttgcagtgttcacagactcctcatagtgaccacgtgttgatggccaacgcgtgttcaatgccgcccgtgttcgttatagattctacatcctgccttccagcttagagctagaaagtgctgtttcaaagcagagccacctttttaggaagacattgcacacaaggacaagtttactttgccacctaatgttttcctaaataagtttatcaggagaaacaccgaggttctccttgtctggtagatctcccacatccctttcccaaagcttccatctgcttctgggtggctgatctctgatcatggctttggccacgtcactggcctctgcagcagtttgctgatgtcgtggactgctttcctttttctttacccctaatccttaaaactggttggaaaactttttctgtaaaggaccagatgctaactacagtcgattctcattattcagttataaaatgtctgcaggtttctgtagtgtagtggtaatcacgtccgccttacagagttataaagtctccatgaacatagaacgagcgaatactaaaccactgctccaatgggaggtacagggctcctgcgagcttctgctcataacatttttttttttttttttggcaaatgttgcccaggctggagtgcggtggtgtgatctcagctcactgcaacctctgcctcctgggttcaagtgattatcttgcctctgcctcccaagtatctgggactgtacaggcacatgccaccacacccagataatttttgtatttttagtagagatgrggttttactatgttggcaaggctgttctcgaactcctgacctcaggtgatccgcctgcctcagcctcccaaagttctaggattacaggcatgagccaccatgcccagcctggtcacagcattttcatcagctagtcaatgtataacctggctaacatgtgtctctgtttaaagacaccctgtttaatagtgattgtggattaattttcatcaaactcatggctggcctgaacgaggcttcttgcacgcgcataagcgtctccacgggggcccacacagccttcctgagcttagaggcactggacggcactcagcactgcagtccagcccacgcaaggcagcgtcacgagcaaacagcacagaaacgtgagagccacagcgccaggcaggccacagaaagcacacttgtttttacctgagctgaggtgaggagctgagcaccacctgggtcagccccagctgggaacgtgcgcgccagcgactggcatttttcatcacctgtgcacgtgcaagaatccccacaaaacctgcatgagtattgattttsggctgatggatccattttagcagcaagcacatttgcaattacgggacctgcagataatgaggatcgactgtactttacacctcctgggctaagaggcgaaacccgagctatcctgcaggcacctggcgtaacaagatgcctttccacagcccttctagtgatggcatggaaagtataatactgatggttgaacacggtattttgttacacaggtttaccttgcataaggatggggttccattttgggtgtaacattttgcttatttagagttcaaagttattactgcctattcgatttcaaatactcacctgcaaaaaccactctgagctcacaaccaacagagcaagctgtgattcacctgtccctcgtttcaagcatgtgtgaaaccagcttagcaatgcaaacctcagtccacgatttggttgttncaggcccctgggggagaagaagacgggcgccaaaaggcagaagaagatgggcagtgcyctcctgagcttgtcccggagtgtccaggagctcacggaagagaaccagagcctgaaggaggacctggaccgcgtgctgagcacctccccaaccatctccaagacacagggtaccttcctgaaagccactccaggagggaggccagggaatggcagggcatggccactgggtaggcccaactgaggacaggcaccacgagggcagatgtgaacccttgggcaacgccagttcccacatgtgccagcacctgccgcgggccacgcgatgccccggggatggagccgcaaacagaagctcacagacatccctggaggagacaatgctgtgggagggagagaggagctgggtcagatgcgtgacatgtgtcagatggctgtaagtgccatggaggaggggaggaggacacattttggggtgaggcaggtggtgtgtgcagctgcaagcagggttgacaggaaggcacccccaagacggtgacagctgagcgggacctggaaggggcgagatagccatgaagacggcagcaggcgtgggacaggcggggcagagctgagtgcctgggagacacgtggagtgtggcccctgaggcccagcggggcgaggcagggtgccatgggagccttaggggtgctgtgggagtgttaggcagagggtggaggggggccgtgctgcttcccgaggccccctggcttctgtgcagagarggggatggtggcagacagaggcttctgcgcttgtctagtcgggctgctggtggcctggatgggggcagcagtgggtgtggtgaaaggtgttcagggtctggttgcatcttgtagctggagcttagggaaactgcagagagggtgtaggctctgagagggagcagccaggctccaaggctttttgtcccagcagctgaaaaagacagagttgctatttcctgagatgggggaggcagaggggcaggtttggggaaaggccacgggaggtctgagtgtgtgggagtgcgggccaggcagtggctgtgtgggggtgcgaggcagaggcctgggctggagaactgagcatgtgggtcaccagcacttaggtggatcgagtgaggtcacctggagtgagaggagcagggggtcaggccctgaacttggcggtatatgggggaggcgaggggcagccagcgaggcagaggggaggagtggctagcgaggggctgtgcatgccaggaaggggacaggctgagaaccgattgttggatttggcagactgacagtcatcggagatcttgatgagaactgtcttaatggcctggccaggtggaatcgggaaaggatgtcaccccgagatgcttggaggctgttaatacagacatctatctcttcacgatccaagggggcagagactgggccagygctggcaaaattctcwggtagccaggacctgtcggtgtggctctgcagccccgcaggctgctccggctgcggaagaggagcctcaggccatacctgagaagggtggccctgctggcagtgcccaccaggatgccgttttgaaaccgcattgcttccatcaggttatgtggagtggagcaagccccggctgctgaggcgcattgtggagctggagaaggtgagcgggcgtctcagtgccactgtcgttggggaccaggggcctcatgctgtggggacgggctcacagggtgcggaaggtggcgctgagcatggcactggctgtctgccaggcagcgccacacacagaccgcaaggagacttcttccaggtctagacaacgctgaaggcagctctcatgcccctcgctgggctgtgagcttctgtgcgtggccgcaggcagacgcgcttcgcactggagcccctcacagtccagcccgcctgtgcaggctgtgggctgtgcactgcccgctgatgaccaggcactgcttcccaccactcaagtcgtgttggaatccacaggaaattgttgacccaactcctggccaggcagaaatgtcgggaaatgaacatttccccacatcccctatgcgactgcaaagtaggaattaggctgattctattggaattggacctttgttttgtttttgtttttgttttttttttctttttttttgagatggagtctcactctgtccccaggctggagtgcagtggcgcgatctcaggtcacggcaacctccgcctcccgagttcaagtgattctcctccctcaacctccccagtagctgggactacaggtgcccaccaccacacccrggtaattttttgtatttttagtagagacggggtttcaccatgttagccaggatggtctcgatctcctgacctcgtgatccacccaccttggcctcctgaagtgctgggattacagacgtgagccactgtgcctggctggttttttttttttttttttttttttttttgaggtggagtctcactctatcgcccaggctgcagtgcagtggcgtaatctcggctcactgcaactttttgcctcctgggttcaggcagttcccctgcctcagcctcaccagtagctgggattacaggtgcccaccaccacgcccagctaatttttgtatttttagtagacatgaggtttcaccatgttggccagactggtctcgaactcctgacttcaagtgatctgcctgtcttggcctttaaagtgctgggattacagtcgtgagccaccgcgcccggcctggacctttgtattttaaatagtaaattagagcatctgtgttgtttggccaagcaaaataaacctagagggaaaaacgtttttaaaaaatagttttttacatatttacaacataaaaaactagccaggtacaatgactcacaccagcaatcccagtactttgggaggctaagctgggaggattacttgagcccaggaatttgaaaccagcctgggcaacatagcaagaccccatctctacaaaaataaaaacaattagcctggtgtggtggtgcacacctgtattcccagctacttgggaggctgaggcaggaggaacgcttgagcccaggagttcaaggatgcagcaagctgtgattgcactccagcctaggtgacagagccagaccccgtctcaaaaaaaaagaagaaaaggttctatamattgtgggcatttaaaatatagaacttgttgggaagtcaaggcacccagaggtggttcggaagcacagtgggcagcacgtccaagatccgggagaggcaggagtggagggcggggacgggctcagcggcactttgcaggcgacaccaggatgtcactcgagactgaaagcatgaaggctgaaaatgtcggcagttccaggggacaggagggaagatgtgcagagtcgtttgagtcccctcccctcgtgccctcctctctgttttaatgacttctgcctgcgccctggcttggcgggggtctgcgcgtgcctcacttctgattaaagagactgagcagggatcatgctcttccagtagcttgtgcccggcagcttctctgggtaactcgggtcccctcaaagctttctcatggccctgctggagactcagtttgccctggttcagtgtctcttttctgggtttggtaaatagaaagtagaaatgagaactagtatctaacacatgtctgtgttgcctccagaaactaagtgtgatggagagctcaaaatcacacgccgcagagccagtcagatcacacccgccagccygccttgcatccagctctgcgctgcacagacagccacgaggggaccgcaacaaggaccacgagcgtctccgaggggctgtgagagacctgaaggaagagcggaccgcgctgcaggagcagctgctgcagagagagtaggtcctcccaaggccccgccagtgtccccacrggcacaggtgctgcagagagagtaggtcctccccaggccccgccagtgtccccacaggcacaggtgctgcagagagagtaggtcctccccaggccccgccagtgtccccacaggcacaggtgctgcagagrgagtaggtcctcccgaggccccgccagtgtccccacaggcacaggtgctgcagagagagtagatcctccccaggccccacmagcagcctcaccagggaagcagctctcactccctatggaaactgattgttgccggggttaaacayttgtcaatttggaaaactgttcagctcgtagtagtcactgcataaatatttttatgtgattctaaaactgcttacattttggtggtaaaataaaggcagctttagtgataaaaagatactggccgggcacggtggctcatgcctgtaatcccagcactttgggaggccgaagtgggaggattgcttgaggccaggagtttcagaccagcctgggcaacacagcaagactccatctgtacaaaaaatttcttaaattaactgggcgtggtggctcatgtctgtagtcccagttactcaggaggccaaggcagaggatcacttgagcccaagagttcgaggctgcagtgagctatgatcatgtcactgcactccagcctaggcaactgagtgagacctcaactcaaaagtgtagggaacggtgggagagcacatttaaatctctctaccctgaattccagaggaatcttcaaattgtctgttagagaggaattgactttcattggtttatgtaaaatcaattcgattttatgcagcatggtcttaattcagtaatatgtttatgggggatatgatctattaatacgtaggaaataaagcataaatgctccagcctgacgcagtggctcacgcctgtaatcccagcactttgggaggccaaggtggcaggattgcctgagtccaggagttcgagaccaacctggacagcatggtgaaacctcgtccctacaaaaaatacaaaaattagccagttgtagtggttgaagcctgtaatcccgcctatttgggaggctgaggtgggagaatcgcttgagcctgggaagtcgaggctgccgtgagctataatcgtaccactgcatgccagcctgggtaacagtgagactctgtctcaaaaaaaaaaaacgaaggaagacataaatgctatgaaatagttggtgtgaccacagggctgggaaggcagggcctcaccgggggttctggagttccatgacctgtggccgtggaacacccggcctggctcctgtcctcctcctgttgatagctcctcagggctcggctccttcatgaatcagccacctccatcatctttggaatgatgtttctctctagtttgcaagaactacagtgactgcccctcagagtggcctgtgaggccagcagcagcaacaagagctaggagctggttagaatgcagccaccgaggccctaccccagccttcggaatcatactctgcttccagtgggatctgcaggtgattttttttttttttttttttttgagacagaatctcactctgttgcccaggctggagtttagtggcacaatctgggctcactgcaaactctgcctccccagttcaagcaattctcatgcctcagcctcccaagtagctgggattacaggcatgtgccaccacacctggctaatttttgtatttttagtagagatggggtttcaccatgttggccaggctgagtctggaactcctgatctcaagtgatctgcctgcctcgacctcccaaagtgctgggattacaggcgtgagccaccgcacccgggcctgcctcggcctcccaaagtgctgggattacaggcgtgagccaccgcacccgggcctgcctcggcctcccaaagtgctgggattacaggcgtgagccaccgcgcccggccctacaggtratctgtgtgtactttagggactgagaaaaacttggccggtgcctcccggccagctacgttctctgctgcctgctgtgaacagtagaaggccaacccgtcaccactgtccttacccctcacgtgaggtctcggagtgcatttatgccaattgataggtcctttgtaaaaattagtatttcacgacaagcttttccaattaancaatcattacagagttcatagacattaggtaaaaaacattaaggtagtcattatgaaaggtaaatcacttctggaaggatctgtgatgctgtcaagtggcgtgacaagagccacctcttaggagcccttaccgtgtgacaggggctctgcgaagcactctagggttgctggcatttaatacagagactcacaggccctgagcagtcggggctcgcagacagcatacagtccatctgagactcggacagaagtctccgtcgaaggccagtgtgtggccatcacaccgcatgggacgcaagaaacgcatctgggagcagttcagctggagccccgcacaggcagtgccacggtctaggcggggcaggcccctgccccattcacggaccccgcgcctgcctgcagcaccctcacacgggtgcgaggtccgtgccaatgagtggcggctggaggggcaactcctcattctatggcctgatggcagggccttctctggcttagtccggttgatcccctgcacacagcaggtgctcggttcagggcaggcagygccctgaggtctgtccttggcaatgtgtgattagaaatgggccttttgtgctcctcctgccccaccatccactgtcctaaggaagggctgagcactgtcattttctgaagtgccttcctgctctgacataacctacagtttttgtgaacgctgacgagtctcctattcttgtgtgcagtttggaggtgaagcagctcctgcaggcgaaggccgacctggagaaggagctggagtgcgcgagggagggcgaggaggagaggagagagcgagaggaggttttgaggtatgtgacccgggtcagggctggagaggacccaggcgagtccgcactcctgctaccactgcrgccccccgtggcgtctcagccttgctgccagccrgcttcttagaaaggccacacctcctcacagtctttcatggttttctgtcacccagcccgggactaacctcttggtgctgagcagggcctgccctctggcatcgtggccacctctcaggggcgtcctctgctctggctgtgccagcacctgccccttcccaaccagctgtcacactggcctctggtcagaaccacccaggtgtgggccacatccttaagaggggccgcccgtgccctcacagtaatgccattcgcgagagccaggaagcagcgcccaccccacggcccatcaactgctggtggacaaacaccctgaggtcgaccacgcgtaggcgcagagtggacggaagccctgaccggcccggcccggggaccctggaaaacctggtgctcggcaaagaaagccaggcacaaaaggccgcgtagcacacgattccttgcgcaggaaatgtccagaacgggcggacccacgtgacaagtgctgctgctaggggctgggaggggagcgaggactgctgacgagcatggcttcctttctggggcgatgtaaacgttctggaattagagaggggtggtagctgcacagcattgtgaagatgctagaattcactgaattataccctttaaaatagtgaattctatgtgatgagtcttaactttttaaaatgcacaaaaaactaggttagaaatctgagcagacatatttagcactcagaataattagtaagacatagactaccggaatgaagaaaacrgtggccgggcacagtggctcatgcctgtaatcgcagcactttgggaggccgaggcgggcagatcgtgaggtcaggagttcaagaccagcctgaccaacatggtgaaaccccgtctctaccaaaaatacaaaaattagccgggcacagtgacaggtgcctgtaatcccagctacttgggaggctgaggcaggagaatagcttgaacccgggcagcagaggttgcagtgagcagagagcatgccactgtcctctatcctgggtgacagagcgagactctgtctcaaacaaacaaaaaaaaagaaaacatttcattttcaggagaaatctgactgaattctgtcagaagacttgaattaaagtaaatctgaaagggcacatgtgcagaaatgaatttttttttgttttgcctttagtacctggaatgaatatctaaattgcaatgccttctgttcatactgtttactaaaaccccagtggtcagtggtccctgcttatttatctcaaatgcttgggctcaagcgatcctctggccttggcctcctagagggttgggatcacaggcgtccggcctggcctcctacttacttatcattcacacaacggattctttttttagttcttagttgtttcaggagaggtgctgggccctgggggtcctcagccacggcctcgtggggcttccagcccagagcaggagacaacaggaagtcccggcctgcratggtttctggtgttgtcaggtcatagctggagccctgtggctcagggagacrtggccccaccagctctctacaggctgcctggtgtccccctgtctccgcctggaccgcccgccccaccctgccctgtgccggccttcatcacatagtgacaggtgaggtgtctcatcttttccctttccgccttagagaggagattcagacacttaccagcaagctccaagaattgcaagaaatgaagaaagaagagaaagaggattgcccggaagttcctcataaggtacagtgaccattcagttgagtctcccgtcaggtgcggtgagactttggtcgtgacggttctgaccgtttccctgtccagagttttttctgaccagccactgaaaatcccactcccctttatcatcaccattgatttctataactcatgtcgtgtgtatcgaagtccgggttttggattaattgactgtcagcaaattgacttctcgaactgatatttgagtctcaaggctggtgagtaaagagttttccaaatcttggtcatgcggagggtgtagttatgcggcyggagctgtcactgagaggcaggaggggcttggggggaaaggacgaaggctcaaccaggcccctgcatggacctgggcatgcgtcctctcctctcatctaagttccagaacacaagttggcaaagcctcagcgggcactgccctctgggtggggtggggcttcctgtgccctccctgccgtcactcagctgtgcacgggttgaacgtggagtgactgttagcagggacccggcaggtgagcagggaccctagatggatgctctcctgcctctccactccctcagcgtgtgtggacgctacccgggggcagctagtcgcggcggcgtctctgtggctcrgaggtccctggctctctgctgcctccctggagggtcgcagccatgctctgctcaccatggccggtgctgcacttgcctccctggagggtcgcagccatgctctgctcaccatggccggcgctgcctgcacttgcctccctggagggtcgcagccatgctccggtcaccatggccggtgctgcacttgccttcctggagggtcgcagccatgctctgctcaccatggccggtgctgcacttgcttccctggagggtcacagccatgctctgctcaccatggccggtgctgtacttgcctccctggagggtcgcagccatgctctgctcaccatggccggcgctgcctgcacttgcacttctggtggtagaagggcgtcctcacaaatccccttccagtgggtaggaggatccttcagaaggcagatgtgagcccatgcatgttcagacgaaaagcaaggaacttggtgtcaccatcctgaggctgcagtttgctctaagaggagctcatggataaaaccagtagaagccaccacctatggtcccagctgctcgggaggcagcggtgggaagatcgctsgagcccaggaggtggaggctgcagagagccaaggtagcactgctgcactccatcccgggccacagatccagacccttttctcactaaaaaaagaaaagaaagagagaaagagaaaagaaaaaggtctgaaaatagaggagagagagagagagagagagaaaacaaaagtgtctgaaaacactattgaaatacagccttttctgtgtggtggggttataagcatttttttttttttttttttactttcttttagtattgtctgaatttttcgtaataagcatgtattagctttgtgttattttcctactcaggaaacatttctattttagagaaaaggaagagtgggattaattgagtgatcagctctccaagtaggggatcagctctcagcattcacatgggaatgattaattgtaggttaaatggagtgaggagagtcggtttaagagttgcctcaaggaatttataancgtgtgaaaatttagacttttttagctgtctgtagttgtgtgagtaaatgttcatttatcttcggagaagctgattttcctttctgatcacattggcacaggcngcggactaacagatgatctcactttagcggaacagaggcctgaaaatgtgtcaggactgagggaagatgaggctcttcttagggttacaaaatcagaatgtggaagccaagggccggaatgctggtgccaagcaacttgttgccacagctaaagagatctggaaacagctggctgtgtggatgtacccagggcatcttcgtcagggatgttaagatgtgcagacacccaagtgaccatcctaggaagattacactcccaggtccctagaaacaggaggcagggcacgcaaggccacgcaggagcggcgcgtcggccaggaggcggcagggtcgtgcggaagacctgggccagggcctttatcatgagaaggagagggcgaggtgaggtgagccggctggttagggccggcgggctggaagcttgaagaatttcagcaggatctgggccacagggtggtcttcagctgtcccgcacctggccctgggtgattaaggctgagaaacactgccttctggagtgtggggcccaatacaggaggcgattctgagtatgggcaccagattagctgctcgcataggatggccgtgcccgaaggcaggcccttcactgtctaggaattggccaggcccagaggggcagcaaggccccagatgcccaagcatcgttaacacacagaanatgaaaagccagagcaagccgttctgtgtttgttgaagtctgtggacaggccacctgcgcctggcgcctggcccggtgtgcactgggagcagtcttgtgtctccctccggggagggctttcagcaacagcgtgctctccaccgagcttgcattcttgacacgagaggccttttcatttgtattgggtagtgtcctatggatgatacatttggagtcatcagtgttagaaatcataatttttcttttttctttttagagacagggtctcactctgttgcccaggctcgactacagcggcacaatcatggctcactgcagctttgacccctgggctcaagcgatcctcctgcctcagcctcccgagtagctgagaccacagtggtgtgccaccacacccgggtattttttaaattttttmatagagatggggtctcgctatgttggccaggctggtcttgaactcctgggctcaagggatcctccctgcttggccccccacattgttgggattacaagcatgagccactgcgcccagcctgaaatcatggttatttcaatggtcgttatagcaatcctggcttgtttctaccttaaaaaccatgctagaaatatatatcaatcccagaaatcccatgtttataatttagagtattaaactagaaaacagaaaaggaccccagaaaaacagacaattcttgcaggaacaaaatgtgactgagtgtagtgagtgtgtgacggccgtgtgaagaagcgtcctctctccctcccaggaggcactgccagacagagttaagggagtttaatgagaagcacgtctgcacttgtgtgctcgcctagacgctgtctctcagcagtacaagagaccgctgtcatgtggtctgcagaccagtgtggaacagctctctcctccacattagtgagactcacctgataagcgcagccgcaccatgccgggtaatatcctgtccccttgccggatactggttgtccctgccctggcttcattgtcctcttactccttcaatttcctgcaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaaggtgaggctccccggggcgacccgggctgctccstgtgagtcttcgtgctccaaggcaagccactcactctccaggaatgastgggcctggagggccagccaggccccaggtgtctgagcaccgtaacatacagaaaatgaaaacctcattcacacgctgacacctccgttctgggtgcgttttgtgcagtagtggataactcgccagatttctttccatccagttttcttccagaactattcgaaagtaagttttagacgttatgaaacatcggcatgtatcttctaagaaaaagtgtcttctcctacctgaccacagcaccgtgactgcacctagggctgccagcagttttacatcctcacctaacggcccttcctattcacatttcccaaatgtccccatatgccgcctgccgctatctgtttcccgccagcattcggtcacggsggttctcagtccacatcccatcggagcctgggggtcggttggttacgtctccttagtgtggttcacagcagcccccaccctttcttttctttaaccaacagttcaccctgaccgattttgtttgtttgtttttctgagttagagtcttgctctgttgtccaggctggagtgcaatggcatgatcttggctcactccaacctccgcctcctgggttcaagtgattctcctgcctcagcctcccaagtagttgtgatacaggtgctcaccaccacgcccagctaatttttgtatttttggtagagacaggatttcaccttattagccaggctggtctcgaactcctggcctcaggtgatccacccatcttggcttcccaaagtgccaggattacaggcatgagctaccacacccggccttttttttcttttttcatagagacagggtctcactccatcactcaggctggagtgcagtggcacaatcacagctcactgcagcctcgacctcccaggctcaagcagtcctccggcctcagccycccaagtagttgggactacaggcaggcaccaccacacctggccaatttttgtagagacgggtcttgctgtgttgtccaggctggtcttgaactcctgagctaaagccatttacctgcctccgcctcccggagtgctgggattacaggtgtgagctaccacacctagattttttttcttttctttttttttttgagatggagtttcgctcttgtggcccaggctggagtgcagtggcgggatctcagctcactgcaacctccgcctcccaggttcaagcgattctcctgcctcagcctccccagtagctgggactacaggcacacaccaccatgcccagctaatttttgtatttttattagagacagggtttcaccatgttgtccagactggtcttgaactcctgaccccaggtgatccacctgccttggtctcccaaagtgctgggattataggcgtgagccactgtgcctggcctttttttttttcttttcaaagacattttctttggcaatgggcaggccaatgtgttacagaacgttccctttcctggatctgtttccttgtggggtcataaacttattcctctgtccccttaatttcccataaatgagaaataaggtctccagctctgattcacccgggtttgcttttggcaagaatgtctcacgtcgaggctgtgtaccccatcccctcgggacgtggatggaccaggccggcccctgtttgtgtttctaacctggccatggctgctggctttcgccattttaaagaaacgagtttcccttggtaactggccggcagtctacaggggagagtttagctccctgaggtctgtccccaccacctttccccttgtggtcttagtgtccttcccgtcacagctgtctccgtctgaaaagcagtttccttattagcggggccaactcctcgtcctcccgaaagcgtgggagaaaacttagtgacttccctttaggtgctaagcagatgctggcttgtctgtctgtctcactcttattcagtgtatatatttctttgcttccatcgtatattctgctggtccttgtactcagttcctccttaatctcccaagggaaagatcctgtgtacagtagtacaaatgtgggkcgtgcactctgatgtacctgtcatccggccgtggtggtcattccgtgccattaagtgcacattgattaacttggcatcaacatctggggaggacttcgctcacatctataagaacacatgctccgagggaccctctctactgattgtgacgctgrgtgtcagctgcagcctgagaaacttcccaagacacccaagggtgactgatgaccagtcaggktggggccagtgatccagacccctgaaccaaagtccccttcataacgtccccagcaggcagcctcagcctccgagttctggggcttatccagagagcacagtggtccggacacctgtgctgtgagagagctctcacattgggcccacatccacctccataggtgcacagcttggcctaatggagtcccttctgcacagccaggggactggcacacggcacagagacntcccttcatctgcagcttgggccacctcatgtgactcctggagaattcccgccatcctaattctgcctctcacttycgtcctccttacaaaggcgtttgtttgctgggtcccggcagctcgggagggaggagccagggcagccaggcctcttgttggcttgatcgacacctgttggcaagatgaaggaatcaaaaccacattcatccttctcgtgttaattcatgtattttttctttctttttttttttccagaaaaaaaaggctgttctggatgaggtaagcgaggtttatttcttgtttcaaaattcggatttgtattttgttgaaaagtaggtgaggggatatttaaagatgtgttgattccttttctttttttttcgagatggaatctcgctctgtggcccagcctggagtgcagtggtgcaatcttggctcactgcaacctccgcctcctgggttcaagcgattctcctgcctcagcctccctagtagctgggattacagggatgcaccactgtgcccagctaatttttgtatttttaggagagacggggtttctccgtgttggccaggatggtctccaactcctgaccttaggtgatttgcacatcttggcctcccaaagtgcaggaattacaggcgtgagccaccgygcccggcaagtccttcttttcatgaaaccaaaccagaccccaacgttaagtataaaatacatgagaaatagagacatcaaataaatatttcgataatttcccactttcaaaatctcttcattcattccttccttccattcattcattctkttcatgcacactcactgatcaccagccctgcgtggggcagtctcagaggccctgggacgcaaaggctcaaacacacaagtgaacgagtggttacagcccggggtggcgctgggggtggccagccctgcacacaaaggccaggaggtccctgcgaggggtgacatgcaaggtgggcctcgcaggatacatcagagctcactggaccgggaagtgaggggagggcatcccagcagagccggtgggacaaggagtctgagacggggccagggcatggaactggaatggaggttgagtatgtcacccacagctgagaactgacagattgatgaacagtgcagttccagccatgaccctttttagggaggagctagaaagtgagatctttattttgctggagtcctggtggcctctgagatgctcccctytcctctagggccccttcagggacagcagtgtatttccacttagactgcaggagaggaccccgccrcagtcactcagagctggcgctgggccycagggcttctcacgctgccttcctcctcacccacagctgcttctkagtggcagggcagactcagcacccgcttgtcctcacactccccaggtgcatctgatgtcagcagggttgacagctctgccgtcagggcggggcttgacttccccctgccccacccatgtccccttccccttggccacattactcatccacaagtgtttgctgggctcctgccatgtgccgggcaccagaggagcttgtaacagaccagccagacactgtccaaattgcacggggttcatactctgcagtcaggacagccagtatggtcgcgggtgtgggcggcycaccaggctcagtggcctgcgcgcagctgcagtgggagcatgttgccatctgatggccaggccacagccacacgagcgccctccacgagcagacagctggactgcccacctggcccaccacactgcccctgaggaagggacccctgctcgccactgccctagtcctcagccttcggttctgcagcccctccgtgcctggcctcctggtccctagacctgccccacagacacacccttgtccatacccatctcacacatctgcaatggcaacttccaacatccccgtctctgacagtccctcccatcctccagcagccctcaggccctcatcccgaggtctccagcatgtcagcctcccacctgtccacccaccacagcctgcccaggctcccggtccccacagcccgctgcggttcctagcacacgcccctgcctggcatctcactttgtggttattcttgccagcctcccgtcagaatgcaagctctgtctttttgccaccacacctctggtgcctagactggcgcctggcatgtgggaggcatggggtaaatgccctccagtgagcgggtgaggggatccgggctccttgtccgatcggccagtcagtggtgggtgccgtctccccytcctgcttctctccctggcgccccccytgcctcaggggcctcgtctctaagtaaagacagcagtgaggctgcctgtgtggggctgtggtgagcgtggggtttgccagtgtgtgcgcagtgtgtggcgtgacggagatgcgtgcccctctcacccctccggctggtgcagagcctcccgtacctggcagccactttaccggaagcttctgggcagcctccacatggtcaccacactctggcgggtcgttcaccgttaatagccggcgctgcctcgccctcctttgctgagctcttttcccaccctagctttaagacaaaacaaaggtgctttctgttccaacagcggcaagcctgctaaactcacgtggcatggggctcggtgggcatgcttgtcattcttctaacgagtttgagagatgcccatctatcaggctgggagggttcacagggctagaggcagatcgttcaaaaataagtgcttccccgaaaatggagygtgaacttctcacggagcttccctgtcttttttttttttttttgagatagagtctcactgtgtcacccaggctggagtgcagtggcccaatcttggctcactgcaacctctgcctcccaggttcaaacgattctcatgcctcagcctcctgagtagctgggactacaggcatgcgccgccacgtctggctaatttttgtatttttagtagagacaggtttttaccatattgaccaggctggtctcaaactcctgggctcaatggatcttcccaccccagcctcccaaagcactggatgacaggtgtgtgccgtgcccagctaattttctgtagagacgaggtcttgctgtgttgcccgggctgatctgaatttcctggcctcaagtgatcaccctgcctcagcctcccaaagtgctgggattacaggcatgaaccactgcacccagccacatagcctaagaaaatcatttcaggataaataattctcttaagatcacttcagaggtcttgtggccccttgcttgatttagaagacatctatggaaagtagatgaaaccaataaactattccaacctgaaaaaacgctccaacatgaaaacctaaccatgtgtgaaataccagctcctattagccgctgaaagggactgcagtgagcagcgggcaccttgccattcccagagtccccactgtgctgacaggtgccatgccctgtcagctccctggggcgccngtgagtttctcccagactggggtgagtgggagcacggacggctctttgagagaacgtggctgcacagcagtgaagggagtcacgttccctgctgccgtggcagctctctcctcggcgcctccctctcgcccgccgttgccccgggcactcacacccacttttctctccctgcttccttccctgacaggcggytgtggtgcttcaggcagctttcaggggacatctcacgcggacaaagctcttagcaagcaaagcacatggctcagagccacccagcgtkccaggcctcccagaccaggtaatgtcggggtgctggacgtcccagtggccatctgcagagctgctcgtctcgcactccatccatcgagaaagcgtagggcacccctcagcctccacatccccgcccgcccagcaggcgtcccctgcgctccatccctggccacgcaggccatgcaggcttctctgcgcaggcccctctgcacaggccccggatggatgtggcgttagggccagattgcgttaagctgccggagagtcaagtagctccatgaagatgtagctaaaaactactaaagacagatgcaggccattgcggcccctcctctgtattgaggaccaggtttttgtttaagaatccctatagtaggccgggcgcggtggctcacacctgtaatcccagcacttttggaggccgaggcaggtggatcacaaggtcaggagatcgagaccatcctggctaacatggtgaaactctgtctctactaaaaacacaaaaaattagccgggcgtggtggcgggcgcccgcagtcccagctactcaggaggctgaggcaggagaatggggtgaacccggaaggcggagcttacagtgagycgagatcacgccactgcactccagcctgggcaacagagcgagactccatctcaaaaataaataaataagtaaataaataaataaataaataaataaatagataaataagaatccctacagtttaaaaattcagaacctgccaccaggaggctgttcactgaccagcaattcccgggaggcagggccatctgaaaaggaaactgagctcttcctgtctccctgacgcccagggtgccctgggggttgagtgctgggagccagcagggggctgccaaacagtcgtcttccctgctgtccttgcaccccagagctctcctgtgccccrcgttccragccccatcgcccaggccncgggcagccctgtgcaggaggaggccatcgtcatcatccagtccgctctgcgggcacacctggcccgggccaggcacaggtgagtcagggtcacggggacgtgggacacagacatggcacgagaggctgcccaccgcactgggcccggagcactgggtgcagggcatgtggcggaaactggagcagcgcctgccgcctgccagcgggacctcggtttggagccagagtaaaggcttcacatcctgaggactccctgctgcaccacggacgtggagtgggctggaaggtgtgatcctcgggggaggcctttccagagtcgcttcttccctaccgggaggagatgagaagaggagcttcacacaccgtgtagctcaggtcaccatcagtctgtggcctggcttttggctgtgctgataggtcatccctgtgaaagaaaactgtgttgtgacctccgtgttggacacggcatatgacaggcgacgcgtgcagggtctagatggcagcgttcccacaggcctcttggtgggtttgctaggactctcggttgcagaaatcaaaaccccttgaagtgagcctggccggggggagtttacagtaaggggaagagacggccccgctccgtcacccccgtctgcttcaccccgcatggggtttgttcccctcttatcacagactgctctggttctcagcctcngtggtggagccgcgcggccacccagcacttccgagtgggcagtttctccctccaaggccgcatctgcatctcatggtcctgaccccatgtgacctgggacacacngtgggctcagsagtcagggacccatccctgggcggcgagccccagccaggaggtggagggccatgcagcctgcaagcatgtccccggggaatggcagctgggctgacccagacaggagacagggaacggagccgtctgaggccagcttataaaaccatgccggcctgacctcagcatggtccccgaggagatggacggggacgtgtctgaggctcttcaccgccggacgtttctggaccctgggtgcatattgggtacagcgctggtcgtggggctcgggactggctctgtgtttgctttcattggaatacttgcctccaagcaaattactgaggctgctgtaaacctcagagaggtttgtactctctaaangcagaatcagctggcgttttctgtttttttccagtgctaccggtaaaagaaccaccaccgcagcttctaccargaggagatcggcttcagccacacacggggacgcctcctccccacccttcctcgcagctcttcctggtaatttcattcatttggattctggcaccagggcagctggtctgctgaggtctcagccaaagagtggccacctccaggaagcccgggckgtgtcgggacggaagggaggagtgtcccatctggagctgcctctgaactaagcgtcrccttatgccaggaaggcccacaacagggccccgccttggcscagcttgtcctttgtgcctggaattgccgaggtccttgctgtctttattttttgctctcagctccaacaggaccgaggtggcttcctccttcaggccagcatttctcctgtttgtttgttgagtaaaaccgtgttattgtttccttttctactttgttaaagtccaaaaacagtcagtgaagaagccgctggcactgcaggatgccacaccctggtgtgaggcctcatccctgctctgcccggagctgacggggatgccccagcagggccctgcctttctctggccgtcagtcccttcatgtttaaagtagagaacgggctagacagctsgaaagccactctccaccccaaatctatgctgctctgcgtggacttgagatcccgtgtcttatcctgcaattagaaaccccccattgacacctcctgtaaagggaagatgagtgcggaggcacrctgttgagacycgggactgtcgggagatggagaagggcagccttaagaccctgttgaggaggggagtgtggcgtgcggggctgtttcacgtgggaagtgtcaggcgaagggctttgctgtgctgagtccttaggtctccagggtggagtcagggaaggaggagagagaacagcaaggaaaaccacaaaggaagaggctcttctgagcccaaagggtgagggtgaggaaggccagggggtgaaggaagggtgaggcctgcccaggacccacatgccttaatttgaatgtcccttcaggacyggcccagggagccggcagccccccagtaccactccagtaagtgtgggggcccgtggcgggcggaggcctcgctttcctgggagatccctcctgtgctgacgcggagtcacggagttgggaagaggccgttttgaggcccgcatcagacctggagcccgagagccttccctccccagggggtcccgctaggggctgtgttttagagagtctcctgcacgagctaagaaccgtataccacgtttgacctggaaataccacgtatgaaatcacattttattttcattttttaacctagtttcgtcagagctagaaaactttgaactttgatattctctccaaaacttccatttgtaaagctcaacacaaagatgagcagcctggggtttcggggagaatgtacagacacgcaaagcggtcgggccggcctgtgactcgtgggctctgcaaaaggctttcagttgttctccgggagccgattctaccggcttcgccagaccctgcctttggtgacctttagaggctttgatcagggctaaagcgtgcgttgatgctgcccttttctcttgctcaacgcaagtgattttaaagacgcaagttcatccccgtgacccagggattcagctttattgacctaaggaaatgtctctgtgaaaagtataaatcaagcttttgtttgagctgattggttgtttttgaagataaccatgaaagctgtttttaatttcataaggttcccctttaatatgaattttcttgaaagttgcaggaaaaaaaagctgacacagttacagtatctgcggcatggccgaattgccatttccttccctttttaaaatctcacatgagcagttcattacttttttactttcgtctttcaaggcagcgacactcaggctccccggcaaggagctctggggctgctgctgtggtaggacccgtcccttcttcagctctggtacccacctccatcccgtctgtaggtggcgtcccattctagaatggattaaaagtttggaacgctctagatgcttaggaaggagcatccaagggggaatggccgagcagcttgcaagctcacagcgatcygtgccttgccccctcctgccctcyataccagtggccagcgagttaacagggaagttggcttttttttttttttttttgaagtgcagtctagctgtgttgcccaggctggtctggaactcctgggttcaagccaccctcccacctcggcctccagagtcctggggttacaggcatgagccactgcacccagcagaaacgctcctacacacgggtagccacccacccaggccccagactcctggactgctgctgtgggaatggctttcagggaatgactccagtgtggactcgaggttcctccatgctggcaaatgtctgcttttgcaggtgttttgactgggggaaatggtgagaatactcagagctgagtttgaaggtgaggagagtgaggctttctggcaggtgtgtaagttggtcctgaggctggagagtgaggctttctagcaggtgtgtaagttggtcctgaggctggagagtgaggctttctggcaggtgtgtaagttggtcctgaggctggagagtgaggctttctggcaggtgtgtaagttggtcctgaggctggagagtgaggctttctggcaggtgtgtgagttggtcctgagggcggagagtgaggctttctggcaggtgtgtgagttgctcctgagggcctgtgtgccccatggcttactgcttctcggggtggctgccgtcttgcctgccggggaagagcagacagtgtaagggtgtccgtggtggcagcccctgaggtcagcgtggctgacccctctccctgtggttcatttcngcagacccctcnccctcagggccacaggccntggcacctctacctggggatgacgtcaactccgatgattccgacgatattgtcattgcaccgtctctgcccaygaagaactttccagtttaggtccccgtcactgtctccacgcngtgatggcagcgctgccgaggacataggaaccacgactggaaagataatttatcgtgttaggagaagaacgatgatacctacttaacacctcagcatctgcgtcgtgtctctntgtgcttttgtttgtggaaggagacccaaatgcctttactttattctctggggagggccagcggctcgcatccccctcatctccagctgcagctcggatggtggattttcagtgccaacagacacatctgccgtgaactcgcakatgccagggagccctgtagtgacacgttctctgacagcaccttgccgcctgcccacgaccttgaccgtgaggagctgctatccgcaaccagcgccgacaccatgccccctcttcctggtgacaccctcaacaaccaggatttgctcsatctcagcccagcaggccaggcagacacaccccgctgtgccttaggaaggtgtgagaccggcttcccccatccccacagcaaaacacggcctgtcccaagccagtgaggagctaaagacacccaggtccccaaatgatcttactccatgccccacccgctcacaccgtcctttcccgtcacccttgctatcccctggagcactgccctccagagctgcccttcccaggaaggaatttggttggattctgtcactgtggagaccaagattttttaaaattcccaattacaaaagcagcatcacacttgcttctgagaacagcagggtgatgtctgttcccaagctggtggcgggagccttagcctgtgtggggccacccggggaagaggaggagaggagggtgaggaggcaggctcgccgttccaagggacagcataggctcgtggtggggcgtgttgcatctggtgtctgggacagtccccgtcaccccatgtgtgcggcctctgcactcccaagctccatggctgggctgggctgggctsggcygggcygggctgggcygggcgtgcggagcctgtggagccagcagctgcagaggcctaggagggagttcctgggggaagcgcacagtgtccagtgcccatctcttgcttgtgtgtgagattagcccttgctggggcgtcaagaggaagagccttagacctgggcgggccttcaggggcatctagacccctgcacagcccaggcctggtgtctgcatttccacagcacccctgtggggactcctgccggggctggccgctgtctcaggagagacccaatggttagaaagcccctttttacacagctgacagcttctcccaaggcttccgtccacggggacaggcttaacccctgggcgccttttctgcagcatggcggccttctgagtcacctaagctgagcctgggncattctctgtggcggtcagaaggccgatggccccaacacagtggcttgtgaaagggagagaggaggctctgcatgtccacctgctctatgggaggaggacacaggtgtccccagcccagcctgttctctcccagtcactcagggatggggccacccaaagtgcaggacccgccccaccctgcggttcgaagcctggcccctgtctccacttagcttctgtttctgcagtgggtggaagcgagtcagcggggggcctggcttgtgtacgtgttttccttatttggtctgtgggttgccaagtccatttttttttccactgaactggctggtaacttgatggactgtgtaactgacacaggccctctttagacccctgccttcaccccacccgcccgggtccactccctggggcgctgtcccaagccatccctgcttgccagctcaaagcttcaggtcctaggagccagtccrcctcgaaagccctgagaaagtgagacacctgcacattcgctgggggagaccctccgttctcttgtggcagctgctcccacttgttaaaccaagctgtttctgcgggacgtgctcactcttgggaaccagtggcctagagctttgggttacaggcatggagagggctttcctgcctcaggcttggaggccaatgttccatacataaaccgccatgtcctctggtgcagctgggctgctcttttaaaagccagcatccatcttgaagctcgctgggtaaatggyaatgcattctcaagccagtgtcttcagctgatgcccagtgtccagtgctggtcaccagtcccctttgctgggtacagcctgcctggctgttctgtggtcctggaacgctgcagtgtggttttgttccatggagacagtaccaagcggagaggcctccttgcccacggccccagggcctgggggccaggggttctggccctgcggggacttaggcaggaggggaagagaamcccatggagccatgggaggggtgagctgtgggcggggcctagtcatgggaggggtgagctgtgggcggggcgagctgtgggtggggcctagccatgggagaggtgagctgtgaatggggctagctatgggtggggtgagctgtggacagggcctagccatgggaaaggtgagctgtgggcggggcctagtcacgggagaggtgagctgtgggcggggcctagtcatgggaggggtgagctgtggatggggcctagccatgggaggggtgagctgtgagtggggctgagccatgggagcagcaagctggtggagtgggctgggcggagctgtgggggctgctggcagggcctargaaagtagacaactcccgggggagacgaagtagagagtgagtccccaagaaagggactcctgccccagcgtcaagtgccaaagcaggccccatctaccacttcagggtcgacgttggtggcaggtrttgttcacggtgtactgattgtcactgcaacacctccacatcaccttgaacttcaagaacagcagcaaagctgtatctgctatcagaggctgttaggtagtccagctttaaaataacacactctttctctatcccatgccctttaaacaagcagccacaggagatgtcagtctccagggcctggccccactgtgttgacagcagtcaygtctgttgagctgacactgctgaggctgaagctggcccygtgcaggtggctggtgagccacaggtgcagtacccggaggtgtgctctcccctagaggcctgtccccaactcctcccctagaggcctattcccgctgctcacagacctcagcagaggcaccagctggagggctccagggacatccttgganatacaggaggctttcctggcacagggcacagctcttaggaggcctttgtaggacgctgtctccccagcgtgtcctgctcatccaggatggggagaaagaggaggaggccccaggctcagaagccagggacagactgccgacgattaccaaactgaatccaggcagtgccatgaccctgggtgtcccttggttcacatcacccaccagacagctgcggagagagtgcagggaggggctgggaccaaacaggccagaaaccagcagaaaagaggcagaagtgaggtgggtgtgcctggggcacgaagccagcgccggggggatttcagtggagccttacagccaggctccgtgcggactgtgatgccagagaggcgtgcagcctctgggcaagtcgggagagggcttgggtggtccccacaaggcagaagaggtggaagggccagagaagaccaccaagaccaccgttcccgcaggcctggggtgagtgacctgactgagactagcgggcagagccaagcagggctaaactccaacccagggccyggtgttgracraagtagctttttctttgctcgtttgtctgtgtattaagaagagactaaaatagccaaacgacgctggtcgcatgcgctggctgtggtctgtctgctgaatgtctatttttgtctcctgacgagacgtgaggaccatgcccttgatccctccgatggaccagaaacccccttccttgcaaaaaaaaggcaattgaattaggaaaagatagnccaacctagctcagatccaccaagataagcacagcaaagcttggctgcatttttgaggaataaaaacctgcagaaagcaccgataaccttcaagatctgaatgagattctattataacccgtctaaacgattgcaaaattcctcctttggttttggaagcagcgtttgctctcccgtggctcggattctctgaggaccagggagttgacacacaaaccccgccatgggtccgagccagctatttctcaaggctcccacctcgccaagctcccaagggcctgctggcagtgcctacgctgtgccaactaccctgtctggtacagaccacggctgggtaagcacccttaaaagcaacagaaatgacgtctggaagctgaaatgtgaaactgtcaagatggcttaggagaggaaggagtggacccgctggtctttggcattttgtatttaraattattctaactttatacataatgtataggccgatcttttggaagggataaggttttcattcttgtgcaactcattattctcattattggccttttaaataaaaagttgttttgcagtgtgccttgagtgccccgtgaagacttctctttaatgacctccaggtgtgttcctgccccacgcactcgggctgaacaaacgatccgcttcagaaaccccgcttctctgggcttctggcattttgccgtggtcgtaatgcaggcttggggttggagagccagctggagggacgggtcccgccgccagctccctgccacgcatgaactcggatacatctgttgacaccccggtcccccgtcgaatatctattccttagatatgaggacacaaaaatgtgcgtgcgtgagggagttatttctccatatttgatttcatttttgtttcaggagcagggaaagaataatttactgaggaatcaaacacagatggaaacgaccaaaaggagctgatatctgggttttgttttccaatattttgttgcatagaacaaggagcatctgtggctttgtgtgcttgtggctgcctgccctggggccctaaatcctgagtggagtttgtccgaagcctccacagttactgtggttggctctggcatttgcccaagcctattttctctctatcgatcttatatgtgtgtgtgtgtgtgtgtgtgtgtgtgtgtgaaaatatatgtatatttttaaattgagatagggtcttgctgtcttgccctggccggagtgcagtggtgcagtcatagctcactgcagcctcaaactcttgggcttaagcaatcctcttgcctcagcctcccagatagctgggactataggtgtgcaccactgtgcccaaccactttttaaaaaatttctgtcacgcctgtaatcccagcactttgggaggccaaggcaggcggatcacgaggtcaggagttcaagaccagcctggccaatatggtgacaccccatctctactaaaaatacaaaaattagccgggcatggtggcgtgcgtctgtagtcccagctactcgggaggctgaggcagaattgcttgaacctgggaggtggaggttgtagtgagccgagatggcgccattacactccagcctgggcgacagagcgagactctgtctcaaaaaaataaaaataaaaattctgtagagatgaggacttgctaagttgcccaggctagtcgaactactaggcccaagtgatcctcccacctcagcctcccaagtggctgaaactacaggtacgcacctggctaatatacaaaatttgaggggtggggcacagtggttcgtgcccgtaatcccagcactttaggaggctgaggcagtgaatcacctgaggtcaggagttcgaggccagcctggccaacatggtgaaaccccgtctctactaaaaatacaaaaagtagccgggcgtgatggcacatgccagtaatcccagctactcaggaggctgaggcaggagaatcacttgaacccgggaggtggaggttgcagcgagccattgcactccagcctgggcaagaagagcaaaactccgtctaaataaataaataaaattttattttggtggaggttgcagtgagccattgcactccagcctgggcaagaagagcaaaactccatctcaataaataaataaataaataaataaaatatatttttctggtagagatggggccttgctatgttgcccaggctggtgtccaatgcctcgcctcaagcgatcctcccaccttggcctcccaaagtgttggaattacaggtgcgagccaccgtggcctgccccgagcccatctttacactccgatggcctgtgtgctgtcctggcaagcggttcatttgcagacttgcactttgcagacgagctggtagggcctgagggagcctgtggcattggagagcatggtgcaccaggcactcgcccgctgcaagctcgctgcccccgcagtcgccagctgtgatctcccctaggggttcagacccaggagcagagaggaggcagcctgtgggggcttctcagctagaactggcgagaggaggagagagaaggtccaacctcaggcctccacccaccgtgggccggggtatggatagacatggaagtatgtgagcgtggacatccatgcrcacgcgcacaggcacacggggagaaccctcttcctcttccccatccagccctctggtttttggtgctcccagacgtgcgctgagtgcatgagggcctcctcaaagaccgagtgagggtcaccacaagctcttgccaagacagttttaaatatgagattcctccaaggtccctgggggacataggaaaaaaaagaagtaagcctctgagtccctcgctcctttcagcactgctgtcgggcttggaatatgaatgacgggctgcagaacagggtggcgtgtctctgcgtgggtgccagctaatggcctttggccagcacctccccactggatcccgggagcagggcccagtgtcagccccgagggccagccccattagatggggcctgcctcaggaacctggggacgttaccatggtgctgtgtccctttctgaataagaggagagggtgcccctgagctattcgttaattaagtcccagagcagcctgggattcaaaggacagagtccagcgctgccagggctcccacggctgccattcatggcagccctgtctgggggcttcctccccaccagcccttcccttcccaggcccggctcgcaaaggaatgaaagcagggaagggtgtgagtgggtgggctggggcgaagctcgcataaaatatacaaagggagctggttcccgctcattgcagcctcgccccgccccattcccttctctcacccacttccccctccagcaccctgtgggctgctggctccactatgctcaccgctcctgctaccctcgcccgagagtgcacccttcccgcctcatcactcctccctgctttcgggatttctcttctgctctggcacccggtcctaccctctgcctgttgagtatgggtgtatccacggctccgtccccaacaccccagcctgcctggatcgtccactgggcgtccgcacgttcttgtctcagatgcctccaattcagcttggctcggcttcaatttatcttccctcatgacctgctccctgttcagtaaaccacatcacaagccacatggttgtccctgccagaaacctagagatcatccccgtctccctgcccgttctcaccaggccccacaggggctaccccctcagcagccctcaactctgctgccacatctgcagtgaggccaagtgaccccaccagacagttcccacgggctccaagacaaaattgaactcctgaacatgccagactgctgcatgtccacgcacacaaagacacgtgcacacacaaaacaccacaatgcaacatacatgcaaacacctgcacatgagcagacatatgcctgcaaacacatgcccacacatgaaacaatgcaaacttgaaaacacacacaaaaccaacatgcacacaccaatgcatgcactctcagacacacacacacttcgcacagacgtgcacacaaacacgtacaaatacacacaaacccacatgcaaacatacaaacatgcatgcaaacacacctgcaagggcagaaacatacacaaatttgcatcccacacacgtacacacaggcacacacacatgacaacatacatacacataaaacgcgcacacacacacacacaaacatgcacacacacgcgcgcgcacttgaagctcaagccagcctgagctatgtgaggctccacttttccaaagaggagactgcaaaaaagaaaacccatccagccaacttgaaagtgtgagctttttataggtgtggacgaaagtgtcagatgccaacttgtgaataattaatatgttaatttggtcacacatcatgcatatttcaagtcatagctaaaagaagacactgatctaggagcatgcctctggtggtgctcccaggacttggctgcaccagcagcttcgtccccatgttttggatcctctaacacagtttcccgtgcacgacatctccacttccatctaagctgtttgcaatccacgtgacggctgagaaatctgctcctgccgggcgcagcggctcacgcctgtaatcccagcactttgggaggccgaggcgggtagatggcttgaatccaggagtgtgagaccagcctggataacatagtgaaaccccttctctacaaaaatacaaaaatgagctgggcatggtggcatgcacctgtggtcccagttctttgggacgctgaggtgggatgattgcatgaaccggagaaagtggaggtcgcagtgagttgagatcgcgtcattgtactccagccagggcgacagagcaagactctgtcccaaaaaaaaaaattctgaacagggtgtgccatgattggagcatttctccccaagccacgagtgccggtgtgctggacctgaggacggtggtccaggtggtgtcactttatgatcgcgtttccacagtggaaccgctggctgtatttttaaacgttttaaagtctgattcacaaagacagccaatgcttgcaaatgtgaggttctgctcctggaaaaatgactaatctgagttaaatttatttctgacatctttttagtggattctgccaggcgacctccatacacattgctcccagctttcagactcctccgtcggttcccaaacagtgtgtggctgtcaaaataaactaattgagagcctcatgctatgagatactttctaaggacttaagaaggcagctccctcttttgtgaaggatactttaaaaattttatgtatttattgattttacagacaagatcttgcaccccaggctggagtgcagtggcacaatcacagctcactgcagccttgacctcttgggctcaagcaatcctctggcctcagcctcccaagtagctgggactacaggtgtgtgctaccatacctggctaatgttttcattctttttccttttctttttgagacggagtcgcgctctgtcgcccaggctggagtgcaatggcgcgatctcggctcactgccatctccgcctccgggctcaagcgattctcgtgcctcagccatctgagtagttgagactacaggcccacaccaccacgcccaactagtttttgtatttttagtagagacggggttttgccatgttggccaggttggtctagaactcctggcctcaagtgatccacccatctcagcctcccaaaatgctgggattacagctgtgagccaccgcgccaggcctcatttttatttttgtagagacagggtcttgctctgtcacccaggctggagtgcagtggtgcaatcatagctcactgcagcctcgacctcctgggcccaagcgatcctcccaccgcagcctcctaaagtgctaggatgacaggtgtgagccaccaggccatgaaggataatttttttgggggaaggggaatcccccacttctatttgaactgtcccagaatgaaaccagggccttcttcacccctcagcctcagcctgcagaaccaccctccaatgccaagctcagcggcctcccaatctcagcccctgcctcatcctcccacctcctaagcctgatgctcctccctttctgaccctgagggatgctcccactccgatccgatgcctcccctcacatactcacctggctgtttcccatgggccatttctattttacagtcacattttgtttctttttttgagacggagtctcgctctgtcgcccaggctggagtgcagtggcgcgatctcggctcactgcaagctccgcctcctgggttcacgccattctcctgcctcagcctcccgagtagctggaactacaggcatctgccaccacgcccggctaaattttttgtatttttagtagagacagggtttcatcgtgttagccagcatggtcttgatctcctgacctcgtgatctgcccgcctcagcctcccaaagtgctgggattacaggcgtgagtcaccacgtccagccaacattttgtttcttaaaaaagatatctggccaggcatggtggctcacgcctataatcccagcactttgggaggccaaggcgggtggatcatgagatcaggagttcaagaccagcctggccaagatgatgaaaccccgtctctactaaaaatacaaaaattagctgggcgtggtggcgggtgtctgtaatcccagctactcgggaggctgaggccgagaatcgcttgaacct

SEQ ID NO: 10606 - DNA, 22321 bp, Homo sapiens
cacagagaattgtaaggagtcatgtgacagagaggaccaggatgccatgaaaatggacttggctaaaaataggtcatttaacccttggctgactggcatctctctagattttcagttatacaatgttcaatctgctgtgcaaggtaattccatcttgcaaaggatttgatgttacattctaccacacatacaactgaattaaacttttacggaattggaaatgcaaataattgatcaaaataaatcaaacaagaaaagaataggaaggaataaccagtgatggaatatcaaatatgaatggaaaacagaataggactgctaaaaagaaaaaaagcttcagaagcacataatagccgtgttatttagaatcatagtggtgtgcaaatgacttctatcacatctcattcaataccagagcaaaagatgttaagtttattatgtaatgcccaccaaatagctagcttttgaaaaaaacttgtttctcaatttgagctaaccatttcaggctactgcatcaaaccaaagttattggcatcatgctaagctagatgtgttgactgaagtatgagattcacacttttgtaaatgaaaagcaatttgattaggcaatgttttcctaagtgaaagcaagttattagagaagtaaagaaacaaaagaatggctactccatatagtggagtttttgttttttttttttaagtgtaggcaaatgtttagtgaagatgatatttcaataagaaaattggtgcttgggacgtgcttccactaaatttgagatatcttagacaaaacaaagtcttattttcaagacattatttttatcagactgaagtcttggaactatttgatctagttactctatgttctcaactgtgttaactaattgaaaacaacattgttattaaaggtattcacaagaaaaattcagagttactgttgcatatcctttctctgtttcaaactgttttctcctaagcacccaaggctctgtgatgtctgaaacagttaatcattaattttaaaagataagcttatcgtggaattagaaaaaaaaactattttaaaattcatatggatccaataagagctcatatagcaaagagaatactaagcaaaaagaacaaagctggaggcagcacactaccccacttaaaagtatactgtgaggctacagtaaacaaaacagcatgatactggtacaaaaacaggcacatagaccaatggaacagaatagagaattcacaaaaaaagtccgcacatctacaaccatttgatcttcaacaaacctgacaaaaacaagcaacggggaaaggattccctatttaataaatggtgatgggagaactggctagccatatgcagaaaattgaaactagaccccttccttacaccttacacaaaaattaactcaagatagattaaagacttaaatgtaaaacacaaaattataaaaaccctgaaagaaaatctaggcaataccattcaggacacaggcatgggcaaagattttatgatgaaatcgccaaaagcatctgccacaaaagcaaaaattggcatatgggatctaattaaacaaaagagcatctgcacagaaaaagaaactatcagagtgaacagacaccctacagaatgggagaaaatttttgcaatctatctatcttacaaaggtctaatattcagaatctataaagaacttaagcaaatttacatgaaaaaaacttcattaaaaagtgaacaaaggacatgaagagacatttcacaaaataagacgtacatgtggccaaaaaaacatgaaaaaaagctcaacatcactgattacagaaatgcaaatcaaaaccacaaatgagataccatctaatgccagtcagaatggcaattatttaaaactacataaacaccagatgctggcgaggttgtggagaaataggaaggcttttacactgttgctggaaatgtaaattggttgaaccattgtggaagacagtttggtgattcctcaaagatttagaaccagaaataccatttgacccagcaatcccattacagggtatacatccaaaggaaaataaatcactctattataaagatacatgcatgtgtatgcttattgcagcactatccacaatagcaaagacatggaatcagcccaaatgcccatcaatgatgtactgcattaagaaaatatggtacatatacaccatggaatattatgcagccacaaaaaggaatgagattcagtcttttgcagggatatggatgaagctggaagccatcctcagcaaactaacacaggaacagaaagccaaacaccacatgttctcacttataattgggagatgagcaatgagaacacatggacacaaggagaggaacatcacacactggtgcctgctgggggagggcagtggtgggaggagtattaggaaaaaatagctaatgcatgccagggttaatacataggtgatggtttgataggtgcagcaaaccaccatggcacacatttacctatgtaacaaacctgcgcatcctgcacacataacctggaacttaaaattaaattaaattaaaagacaagctaaaagggttaacgaaaaataattagataaaaaaattttgattttcaaaatcctgaaacaagagttttaaatttgcttttaatatatattcaaatcctttaatactgttcccttccagagatgctgcttaatttcctctcttgagtgtggcttggacttaatgatgcatttctgatatggtctggctctgagttcccaccaaattctcatcttgaattgtcatgcaaattgtaatccctatgtatcgggggagggacctcctgggaggtgattggatcacgggtatggtacccccatgctgctcttatgatgctgagggaattctcatgagatctgatggttttatgaggtatttttccccacttcgatctgcaattctctctcctgccaccatgtgaagaaggacgtgtttgcctccacttctgccatgattgtaagtttcatggggcagccttctcagcaatgcagaactatgagtcaattaaacctctttcctttataaattacccagtctcaggtatttctttatagcaatgtgagaacggactaatacaacttctaactggtaatgctgacataagagtttgtgactctgggtgtagaacataaaactcactgcagcctcccccttctctctcaatgtctctggaatcatgagctctgggggaagccacctgctgtgccataagcagccctgaaggaaggtccatgtggctgagaactggggccttctgggaacagaaaacaaggaactagggcttttccaacagccatgtgacccatccatgtttcatgtgaatcctcagtcccagtgaagcactcagatgatgcaggcctaggctgacaactggactgcaaccttgtgagaggccctgagcaagaagcactcagggaaacctctcctggattcctgaccattggaacctgcgggagatgatgaatatttgccattttgagctgctaagttttacataatttgttatgcaatagtaaataactaacacattttcacaaaagaggatgtagtattacacattaatttgcatttgctctaaatttatcattattattaatattattgttattgagacagggtctcgctctgtcgcccaggctggagtgcagtggcatgatcaccatgcactgcagtgtcgacttcctgggctcaagggaccctcttatctcagcgtcctgagtaactgggactacaggcatgaagcaccacgcctggctaattttctaaatttttttgtagagatgggggtttctccatgttgcccaggctgatcttcaacatctggagtcaacaaatctgccttcctctgccttccacggtgctagaatcacaggtgtgagccaccacacctggcctaaattaattataagacattacacatgtaacttagttttaaaaggtaaggagaatgtccatggctgaagaggatgcattttattaccattcacaatgatcactttacttgaacttcaatttccaactgtgtccaaattaaacacaaaaggaagatccaacccttgctgggctgattctttgatggcccccaacagccacctcccggtcattcactttcccccagttattcaagcaactctagtgtagatgctgctgtgaagggatttagcagatataactaagggcctcaattagttgactttaggctgggtttatcctgctttgactgtcctaataaggtgagtccttgaaaggtctgtgttctttctgagcatagagatttgcagtgtgagagggattcagcatgaggggtttcctctaccgtgggctttgaaaatgaagaggctgtgtaggaaagaacactgttaggcaccaggaattgagcacagccctgcctattctctgtattgacagccagcaaggaacagaaacctcagtcttacaactgccagaaactgcattctgccacctctgtataagcctgaaggaggattcaaaatgaaaacacagcttttggaagcccagaacagggattctatccacatcttgcccagatttctgaccaaggaagtataagcagataaatgggtgttgttttgccagtcgtggtagtgcacgaatgaattgatgaattgatatgcacactaattacataaaataaaatatttcttaactttttcagtattttacattttataattttctgtgatgcaatttaatagactcatatttcattcattcagtcaagaaaaattaatttaatccctacaatgaaccaggtgtgccctcatatgcttacgtgcctgacattccagaagcttcacaagaccaaggtggagccagtggaatgttttaggtggagaaatgacacactctgactcacaggagcaggaccactgtgcagagaacagtcacgtagcaggtaatgggacagtgctagtgtcacaaataaggagtgacaaggtggtggggactaaggggagaggagggcctgagggatgagaggaatggagggaagggctggagatgcaggaggtgaggaaatggagcagagggaaagaattcgaaagcagcagaactcaggtttaaacacattgttttatatattttaatacatcaatctacagagccttgcagggtgatctttgcagttggcctttaataccttatgtgggtctgcctaaaaactaatttttttatgttaatcaggtttaaaaaatactaagtgttcatataaaatatacacaacacttagaagtggatacttcctaaaaacaggcagtgcatgagcactggtgaggggcattgtgactgcattgagtgcttgccactgtgaggtgaataaagtctgtactggctcctggttacaacatatagtaacacagtggctaccttgtattaggagatgtcctggactcacacagaaactcagggctatggaatgaaggtaaatttaaaatactacaagcgggagtcacagatacattgtctgggaaagtgaaacttaggagctttgtgattcctgttgtaatgcttttagacacatttatatgtcaagggaccaaagtcacatttttggccaattagattcctgatcattaggagttaccaagattctgctacccactgtagttaataaacaaaaagcaaactggtctctattctatctcatgcactcaggcacaacttttccagatttaaaaaacaaacaaacaataacaacaaaaaaccctgtctctacacctccattcccagggcaagctcactctctggcaacaagctccctggagtgatttttcttctagaagagtccacggggacaggtaaggagtaggaggcagggagtccagttctgggacggggattccgtgatgcaaagtgaagagagaggaacggggcccatttcgagggtttctccctggtttctcagacagctcctgggccaagactcggaaackttgagacagagcgcttggcacagaagtagcggggtcagggcgaagtcccagggcctcaggcmtggctctcaggatctcaggccccaaaggcggtgtatggattggggaggcccagcgctgggsattccccatctyygcagggtttctcttctccctctcccaacctgtgtcgggtccttcttcctggmtactcaccmggctgccccagttctcactcccattgagtgtcgggttyctagagaagccaatcaatgtagccgcggtcccggttctaaagttcccacgcacccaccgggactccgattctycccagtcgccgaggatggtgtcatggcgccccgaaccctgcttctgctgctctcgggggccctggtcctgacccagacctgggcaggtgagtgcggggtcgggagggaaacggcstctgtggggagtagctagggkcctgcccggcgggggckcaggaacccggttgcggtgccgggaggagggtcgggagvgtctcagccccctccttgctcccaggcttccactccttgaggtatttccacaccaccatgtcccggcccggccgcgcggatccccgcttcctctccgtgggcgacgtggacgacacgcagtgcgtgcgsctcgacagcgacgccacgagtcccaggatggagccgcgggcgccgtggatggagcmggaggggccggaatattgggaagaggagacagggaccgccaaggccaaagcacagttttaccgagtgaacctgcggaccctgagcggcyactacaaccagagtgaggcctgtgagtgacaccggccgggggcgcagvtcactacccstcyacatcccccacgraccgcccgggtctccccgagtctctgggtccgagatccacgccgaggcagcggvacctggagacccttbacccgggagaggcccaggagccgttacccggtttcattttcagccaaaatccccgcaggttggtcctggcgdgggcggggctcggtgggcggggctggccgcgggggcggggccagggtctcacacccatctagaggatgtctgtctgcgacgtggggtcggacgggcgcctactccgcgggtatcaccagcttgcttacgatggcaaggatthcatcgtcctgaacgaggacctgtgctccttgacagccgcagacacggcggctcagatcacccagctcaagtgggaggcggcccggggggcggaggttcatcctcacagggataggcacctattagatgtggtgtggttttcctctctactcttagaccctcagccagtatcactattggcattcctgagccactggctcagaatttcagtacattatctgcccgcgggacacacctcagaggdaaggggatgaagcgtggkccatgatgaccatggmaycccctggtcttatcaccacctgcacctcccaggggctgccagccacacagagtcatggacaggtctctacagacacaacttagtgccagcttggatgaaaccctctgaggaatggstgccatctttcaggatgtggtgcatgtattgaatcaaagatgtctctatagtgctgtgtttacagaaggaagaatacgtgggtccaaaaaccaagaagtagaagcaggtgtggctccatatctaaacccttatattcaccttcagggtgattttgcacttctcatctccaatatctgggctctgtaggggaggaggtcctggtttcccaaagggggcaccctggcaaggagacatttaaatgagagtccatggaahtacachttatggctgcccccagggatgtttgaatagtatgtgtccagayacaagmaggtgagaagaggaggaggcagggctgctatcacacaaggagggcaggagatgtgtgtgtggaaataagagatccacttggagaccttatggttccccttgtcctgttgtaagtgtgagcagaatcatccagcaacccagcctgagagggtttcatattcaagagcccagaaccctcaggaaggaaggattgagygatactcayaggtaatgtcccaaggctgtgctcctgtgctctgacatcctcagcaggattggtgcaaagccctgcttcccatgggctgttcccagccagtgactggtcacagcaggcdttaaggcaagccattcctgggagacacgggactcctctgatggcyaactgtagctggaagdctcctccacggccttgctcaactctccttagattgcctgtgctctaggatgcgtcdaacaaactttctctccttctgtccagcacttggggtcacacttgcatcgtggtctgccgccttttccagggatttctggctcacttcccatattcccttacgggtgtgtcccctyataagatgtcgcagactttaagctcatcttggcatctgctccttgaaggacttggactaaaaattatttccatctgcatatcaataactcttattccaacctgtaaaatccttctctttatccaacttctgccacccccacagaatctattttacttgtgtgtgtagtatctctttgagttaacagatatttgttctattaagctactaaattttgaggtagtttgtgacacagcactwgataactattaaggctttcttaagtttccattattccatggatattatctacatatcttttaatcccttgcattttaataacattagctatacttgctgtttccaactctttcctcctatttttgaacattttaaattttgtctttctctgtccttccttccttctttcctcctttcctccctcagagctttctccctccctccatttttttcataaactccaagtgtttaggccaaaaggaagcattatttgaactttatgctaaaagtataatgccgtaatttataatataaaagtaaagaaaaggaagttgttaatggaatatgaaaaaatgcctagggtgattctatagccaagacagtaccttttaacatttaatttctgyctccaactgaatgttttcagaacacatgagcaacacaagctctttcccattcttggtacaagcacttgagaaatcaaattagccttatctagtatgattaatgtccatacatcatataatcccaccatctgcctcctgatcataccccctggggacattcttggctatgtgtccaggagacatgtacaccaatgtttatggcaaaaactrgaaacaatcacatatacatcaatgggaattaacaaaatwgtcgtataataataaaaagtaaaacttcagcagcaacagtgaatgaacagcaccctcccacatcagagataactctcctacacataacatgcatcagcatcacagaagaatgcacattgtgtgagttctctgtacggggaagttwaaaaaagcaggtcaaactgtgatttggatatatatatatatacttattgtaaaaatctttagagacaatgaaaaggaatagtaaatacaagactcaagatagaagttccttttggggaatagaattggacaacagccgagggtggcttcataggttttgttttttatgccaggaggggatgtccaggtagttaagttacttgatcataaatctttatttatttatttatttatttattttcgagatggagtctccctcttgttgcccaggctggagtgcagtggcgtgatctcagttcactgcaacctccgcctcccaggttcaagcaattctcctacctcagcctcctgagtagctggaattataggcatccaccacgacacccaggtaatttttgtatttttagtagagacrgggtttcaccatattgtccaggttggtctcaaactcctgacctcaggtgatccrccaacttcggccttccaaagtgctgggattacagacatgagccaccattccyggcccacaaatctttaaagtgtcatttttcaaaatgcaccttgtgygccattcctgactgattatttggaaatgaaagagaaaagaaaataccaaagttcatctcaaggatccttagcaataactacacacgttaaaacaaagccacagccaattgtaaagagtcatgtgacagagaggaccagratctcatgaaaaatagccttggctagaaagaggtcatttgaccctgggctaattggcaactctctacattgtctggcatacagtgttcaatctgatgtgcaaggcaattgtatcttgcaaagaatttgagaatktgatatgttgctcacattttaccacacatacaagtggattaaacttttacacagtaaaaaaaaaaagcattgttgagcaaaataaattaaatgaaaagacataaaggaataactagtgatgaaatagcaataagaatggaaaacatgaaagagatgcttgtacagcaatgatagcagcacaaaagaacagtgtttttcagaatcatacwggagtccaaatcacttctacyacatctaattwaaaaacacagtgaaagatgttaaactttcataggatgcccactgaatagccagttattgaaaaatcttgttcctagattggagtaaacaatttctgcytaccctagccaaacaaattattgtcatgatgctaagctagtgtatagacagaggtgtgagattcacatttttctarctgcaaagcaccctgattaggcaaatatttttgtagatgcttgagtaagaaaattggcattttgggcattcttaaaccgaattagaaacttctgaagagaaacaaacrtagttaygattgtaaaggcattattgtatggcaccaaagtcttgggacactttaatttagctactgtattttctcaactctgttgcaacttatcaaagagaayattaatattaaaggcatttacaaaaaaaatctgagatattgttgtatcttctttctctgtctcaaatatttaatcaactttacagaagagaattttaaagtattaaaaaaagtcagatacaagaagtatttgatttacaaaaccctgaaacaataatgttaattttgcttttaacatgtttataaattctttgatactcctcctttccagaagtgcagcttcattccctccctgttcgtgtrgcctggacttaatgactcacttctaactgatagagtaatgctgacwtaatagtttgtgattctgggtgtagaacataagactcacygaagtttctactttggttctttctttctctggaatcatgagccctgggggaagctggctgttgtgtcataaggaggcctgtggtccatgtgactaggaagtgagtcctcctgggaccagacaataagaagctaaagcctcttccaaaagccatgtgagagattcttgtgtcttgtgaatcccyggccccatttgagccctcagrtgattcagccctggaagacaactagactgcaacrttgtgagaggccctgagccagaagcattcagagaaacttctcctggattcctgaccatggataactgtgggagatgataaatatttgttgatttgagctgctaagttgtaggtgacttgttatgcagcagtagataactaatacagcttcacaagagaggatgaatcactgaactttttcatttgctctaaattcattataagatattaaacatgtcatttgcttttaatatttaataaaaatttccatggctatataagatatattttattatcattaacaatgatctattttttgatcttcaacttgtatgttctatttaaacatgaaaggaagatccaggctatgctaggctgattctatgatgacaccccaataaccacccttggttwctcaggttaccccagttactcagttgacactaaagcaggtgctgctgtgaagaggttttgcagatatatttaaagtccccagtcagttgactttaagatgaggattatcctgcttagacggtcctaatcaggtaagctctgaaaaggaytgggttyttcctgagaatagagactcacagtgtgagagggattcagcgtgaggggcttcctccactttgggctttgaaaatggagggatcatggggaaagaacactggtggccaataggaattagaagccctccccactgtctactctgatagcccgaaggaaacagggaccttaatcctacaattgccagaaaccgaattctgccaacaaactctrcayaagcttgggggagaaccccaatcttaagatgaggatacarctttgcgaaactctgaacaaagagtctatcacrttaggcctggatttctgatgaaggaaatgtagacaaataaatgggtgctgttttcagccactaagtttgtggtaattggttatgtactgccaggaaataaataaacagattcaaaggataagtatatgacattttctccaccggaatgaattcatgaactgatatgcatagtagttgcataaaaccaaatatttcctaacttgctttgcattttccatttcatgatttttgtgtgatacaattttgaacacaattatatttcattcattcattcaacaaaaattaacttagtgcctactatgtggcagatatacttttatattctgtagatacaactttgatcaaarcaacccaaagcccctgtgcttgtgccttccattctagaggcttcttgagagtaagatggagccattagaggcttttaagtgaagaaatgamacaatctgactcacattagcaggattgctgacctttgtggggagaacagtcatgggcagcaggcragggacagagctagggmcagggacagagctagggccacaattcagtagtgacagagtagtagagactaaggggagaggagggcctgaaggatgacaggracagagagaagggctggagaagcaggaggtgaggtaaaggaacagaaagaattctaaagcaatggaattctcagacttaaatacagtgttttatagatttttaatgcatttatccgcaaagcctggcacagtgttacttgcaccttggtctttaatgcattctgtggggctgtctaaaasctaattgcctctctaagataaaaaggttaaaaaaggccgggcrcggtggctcacgcctgtaatcccagcactttgggaggccgaggcgcgtggatcacaaggtcaggagatcgagaccatcctrgcyaacatggtgaaaccccgtctctaataaaaaattacaaaaaaaattagccgggcgtggtggcggtcgcctgtagtyccagctacttgggaggctgaggcaggagaacggcgtgaacccgggaggcgrtgcttgcagtgagcgagattgcaccactgcactccagcctgggcgacagagcgagactccgtctcaaaaaaaaaaaaaaaggttaaaaaagaataccaaatgtctcaataaaatatacacatagcttagatgtgaataattcataataataggcaagtgcatgggccggccattatagctcatgcctgtaataccagcattttgggaggytgaggcgggaggattgcttgagcccaggagttcaagaccagccagagcaatttagggagacctcatctctacaaatattatttttagaaaaattagccaggagtggtggcacaagcctgtggtgccagctacttgggaggctgagggaggagcattgatcacatgagccaaggaggtmgaggcttcagtgagtcatgagcgtgccactgcactttagccagggtaacagagtgacgmcctgtctgtaaataaataaaaaataaaaaaattaataataaagggagtgcatgagcactggcgaagggcactttggctgcattaagcacttgcaattctgaggtaattaaattctgtacaggctcctggttgcaatatacggtaatacattgtgctttgtattgagatgtcctggactcgcacacacaaactcagagctatgaaataaagatactgtaaaaatacaacagaccagagtcacagatacacagtctrggaaagtaaaacttcactttgtgagtctaattgcaatgcgtttagacatatttatatatartggggccaaaaatcatctcttttacaaattagattcgtgaccattcaggggctaccaagattgtgctacccactgtagcacaatcggagacccacsccgaggctgcgrgactcgtggagaccctcgacacaagaaccccaggtgcctatacccgattccattttcagttcaggcccaaatccccgggggattgatcggggcagaggaggagctcagtggctgaggctgaccgcgggcttggggacagggtctcccacctccagtggatacacagctgcgacctggacccggaccggagcctcttcgcgcggggatgaacataccctacgatggcgccagttacctcgtcctaaaccaggmactgctctcttggaccgcagcggahaaggcggctcagatgttytggaggaggaacatgcagagctgctcaaaacctacctgccsggaaggtgggcggagtggctcagcaaaggccttaagaatgagaaggagagkctgcaatgcgcaggtaccagaggccacgggkcgcytccctgatctcctgcagatatccctgagccaycttccaaaagaagggcaggaaaatgggaccaacgctaaaatatccctctccctcttgtcctgaggcagaagagtcctcctgggtttctaaatcctataccagagagtgactgagggcccgccctgcactctgggacaattaacggatgaagtctctgcgggaaaggaggggaagacaatccctggaatactgatacgcggtmccctttgaccccccagcagccttgggcaccaggaattttcctctcaggccttgttctctgcctcatactcaatgygtgtgggggtctgattccagctcttctgagtccctcggcctccactcaggtcaggaccagaaatctctgtttccgcctcagacactagaactttccaaggaataagagattatcccaggtgcctgtgtccagaatgytgtctgggttctgtgctcccttccccaccccagdtgtcccdtccattctcaggatggtcacatgggtgctgtgtctcatgaggaatgcaaagtgcctgaattttctacctcttgccctcagatcccctgaaggcacaggtaacccwccaccccatctccaactatgaggccacgctgaggtgctgggccctgggcttctaccctctggagrtcacactgacccagragcsggatggggaggaccaaattcaggatgcagagtttgtggagaccagacttgcagggtacagaaccttccagaagtgggcagctgcagtggtgtcttctggagagaagcagaggtacacatgccatgtgcagcaygaggggttgcctgagcccctcacactaagatggggtaaggagacgaatgagvggtcatgtctcttctcaggcaaagcagaagtccttctggagcctttaagcagggtcrgggctgaggcctgggggtcagggcccctcacgttcacctcctttcttagagctgtcttcccagcccatcatccccgttgtgggcatcattgctggcctggttcttcthgttgctgtawtcactgtagctgtrgtcgctgctgtgatgtggaggaataagatcccaggtaggaaaggggtgagctctgagtttccttcttccattggtggatttcaagccccaggtaggagtwggctcatatcttgcctagttgtgaggcaccatctccacacacatttaccctgttcagaggccctgtctatcaacvcttactcttttgtaaagcacytgtgaaaatgaaggacaaatttatcaccttgattgtggtcatgggaacctgactcccagcagtcacaggtcaggggaaggtccctgctgaggacagacctcaggaggacaaytggtccagcctcaacacatcctcttccctygggttttctgatcctgacctgggtctgtagtcacagttctggaaactyctctaggatctcatgccctgcctcctccctggcctctcacagtttgttttctttccacagatggaaaaggaggcagttatgctcaggcttcatgtaagtgtggtaggggtgggaagagtgatccctgagatccttgggatagtgtagacaggagcccatgggggagctcagccaccccaaaattcctcctttagtcacatcacctgtgggctctgaccagattttgtttttgttccaccccaaacaggaasagtacccagggctctgatgtgtctctcahggcttgtaaaagtgacaccttagagggcctgaagtgaaagaggagttgggcagaggggacacaactaagctctggagattctttgatttggaatttttcaaggtgtggtgggctgttcagtgtcacaacttactgtgactgacctggattagtttatgactatgttttttctaagattgccttgtgagggactgagatgcaagatttgttcatgcctcctctttgtgacattaagggcctctggcttctctttctgccaaagcatctgaatgtgtctatgtctacagtaacaggtaagaaatgggagaccagcccatcctcatgtccaccatgacccctgatattgtttggatctgtgtccccacccaaatctcatgttcaattgtaatccctaattttggaggtggtgtctggtggcaggtgatcggctcatgaggatggatccttcatgaacggtttagaaccatctctttggtgctattcttgtgataattctcataagatctggtgtttaaaaatctgtgtcacctccctgctctctctccctcctgctccaggcatgtaagtaatgtctgcttccccttagccttccagcataatcgaaagttccctgaggccctctcataagatgagcagatgccagaatcatactttctgtatagcctgcagaaccatgacccaatttaaacctcttttctgtttttgttttgtttttgttttttgaaggaaaatttatattattttaattatttttacatacagaaaactcaacagcatacatttcacccaatttagtggcatgttctttaccctttgcctttttgagcttggcaatgcaaaccacatacttgagacccaggacactgtctccccagtgacggcggatctcatcatatctgtcattgtaattggtcctgagaacttccaccagcttagccaaagcacctttgtcttccgagttaacctgtgtgaaggtgacagtggtgcaggtcttcctatggactagatgtcccagtcttgccttccctttgataatgcagtaagggaccccattttatgacacaggacaggcaagaagacaaccagcttgatgggatctacatcatgtgcaatcaccaccagctgagctttcttgttctccaccaaggtggtgatggtgttaactcctgctcgaaggacaggtggactcttagtggggaatgtcccctttgccagcagctttcttcttggcccgggccaacagcctctgcttcttctcttggtttgtctctggtctgtattgtgggccagcttaagcagcagagtagctgtttggctgtctggtgcctgggtgaactggttaatctcaggaggcactttcagccacttatagaggatggttctctgctgctgcaacctgatatagcagggccatttcacaaagtgggtgaggtctcttttgggctggatatcctgtccagtgccaaaattcttaggccttttctcaaacaagggatttaccactttcttggcctcctgcttcttcacgacagcaggggctggagccaccttcttctccttggccttctttccttttggcatcttggatggtgggaggagaaagaaagaaacctattttgtttataaattacccagtctcaggtatttctttataaaagtgtgagaatgaactaattcagaaaatcggtaccaggagttgggtattactataaaaattcttgaaaatgtggaaacagctttggaactgggtaacaggcagaggttggaagagtttggagagttcagaagacaagaaaatgggggaaaatttgcaacttcctagagatttgttaagctgttgtgaccaaaatgctgatagtgatatggacaatggagtccaggctgataaggtctcacatggagatgaggaacttattgggacctagaggaaaggtcacttttgttatgcattggcaaagaacttggaggcattgttccccctccctagggatctgtagaactttgaacttgagagtgatgtataagggtatctggtggaagaaatttctaagcagcatagcattccagatttggcctgcctgcttgtaatagcctatgcacatatgtgtgagcaaagacatgacctgaaactggaactgatatttaaaggggaaatttaatatccaggacaattcctagtggagctgcaggaacaggacccctgccaagactactaaatcatagagccactggcaatatgcaagctcagcctggaaaagccataagcattcaatgttcacccatgagagcagctatatggattatgttcaccaaagccacggatatgaggctgaagatggcattgtgagtccattgcttgcagcagccagtgtgctcagggttcaagatatagagtcaaaggagattattttagagctttaagttttaatgtctgccatgatgagtttcaaccttgtgaggacactgcattcatttcttttggtccatttatttcttttggaatggaaatgtataggaaatgtctctaccactgttgtattaatattttagaagtaaataactttttttaattttacaggtgcacagctataagaacttaccttgagtctcagatgagactttggaatttagagttgatgctggatcaacccaacacattttggacaattgggagaagattattgtcttttgcaatgtgagaagaatgtgagctttggctggctagggacaggatgcaatgatataaatatttatccccagatacctcatgttaaaatctgatccccaatgttggacttagggcctaatgggtggcgtttgggtcttgggggccaatcttttatgaacagagagatactgccctctctcgggagtcaatgaattgttgccctattagtttccaaaagagctagttgttaaaagagtctcgcaccttcctactccctctgttcctctcttaccacgtgacttctgcacataccagctcccctttgccttctgccatgagtggaagcagcctgaggccctcgctaaatgctcaaacatttccagacatcagaatcctgagccaaatgaaccttgtttatataaattagtcagtctcagacatttctttatagcaacacaaaacggaataagacaaccctctcatcataggtatgtgtctgtggcagccagcccccattctcaaggtatccaggatccactcagccaagagtcctttcctcagtattctaaagacactctaatcactcaagagattctaaggtttttaggagaaaccagggacaagactaaatgtttttgtgataactcatattatccccttttctttgaccacatatttttcatacgaaaaggattataacagtaaagaagcattggcatattatccaagtctcattcggtcattcaaaattaggccagtttatcatcctcttgtatgaatatgtctcccagaatgacatcactcagctttgcagacaccactcaatcttaacaggttccaaaaacaagaatggtctcagggacacacagcttcacccttttaggcatccagtatagttgacctaagagacaacatctcttgctcacaccacttttgaggagataagctaatattgaattttcctcattacataaccctttgatttattcacctaccctcagccactattcctccttctgtccctttatatcagtcttttccagttctagaagtgacattaggtttggctgctgtgctggcctagactgcatgcagcaacagtattctaccatgtcttctcttaatctactcttgatcatagacggtaggttacataggttaggaactagtgcaggctatctgaccaccagtctacgtagctctacttacagttaatcccgactttgccagatgaaatgaaggcacagcgcaatccttgatttgcttgggaattcttacataaaggtataaaaatatagttatggttttttccttagggataattcctgtttctggcagttcgatttgcatccctgttcctggtaccactgcaccctgtgtaaaaaaagaaataagaaatgaagtgtagtcattattccagcatcctccccttaagaagaattgtatgtacagtcataacagcatcaccctgatccatcaggaaaaagagaggaagctacctagtggagtcagtttcgcagctccacccatgttgacagtaagcacattcatgaagatataaaagccagtccttcatgtttatattgcccaacaattatattggcagtttttagacaattagacaaccaatgtttcaactgactatttctttttttttttttttttgagatggagtctcactctgtcgcccaggctggagtgcagtagtatgatctcggctcatgcaacctctgcctcccaggttcaagcaattctactgtctcaacctcccaagtagctggtaatacaggcgcccaccaccacacgcagctaatttttgtattttcagtagagacggggtttcaccatattggccaggatagtctcaaactcctaaactcaggtgatccgcccgcctcggccacccaaagtgctgggattacaggcatgagccaccgcgcctggtcagccatttcaatattctatcaaagtttcccctgaatagtacatttccctgtgcactgttggctttttaaggctgtaaagtgtgttttcttgtgtaaagaaatgtgactcaacagtccaaattggtgtaatctccatttttctggttcttgtatagcctttgaagcattgacatctacccctggttgatcatagcccaatccagagtcagtgacttccctgtcaagatccattggcagctcctttggggttgctggcattagtctggcttgccagctatgaatgatcaaagcttcccactacagaatctgtcacagagctgcctctgtctgttttcttgaccaaaagtcaaaacagacagtatgagaaatgagataaattaccaaaattgtgaacacaagagagagtatcactaatgaccctttagaagttaaaaaacattataagttaatactctgaaaaacctgaagccaatcagttagaccacttagataaaatggacagatttatacaaagatagaaattgctgaaactgactcaaaaataaatagaaaatctgaagagaactgtacactaagacagtaattttaaaaccttctcacaaagaaatgccaaagcccagatatcttcactggtgaattctatcaaatatttcaaaagctctttcagacaagaagagaggaggcaagactttctagctcatttacagaactgacattaccctaatatcaaagtcagagcaagactgacaagaaaagaataccatagaccagtgtcaccaataaacataaatgaaaacatccttaacaaacattggcagacaatagaaagccacgtaaaaaaggattacattccatgaccaatgggattcatcccaggaatatatggctggattaacaattagaaatcaattaatggaatgcactgtagtaagggaataaaagacataattatctcaaaagatacagaagaaacagttgacaaaaatgttaacaccactcatgttcataagtttcaacaaaataggaatggaggggaccttcctcaccctgataaagggcatctataaaaaacccacaactaaaatcatgcttgctgaagaaagactgaatgcttttctcctaagatggagatcaatgcaaggatgtccaatccaacacttctatttaacattgtactggagattgcagctggtgcaataaggcaaataattaaaagttaaaggcatccagataaaaaggaaaacataaaactctattcacagataacatgaccttgtctgtagaattcacaagcagataaaagcctgctagcactaaaaaatgaatccagaagctcccataggatataaaatcaaattaaaaattattaacatatttctctatacaagcad

SEQ ID NO: 10607 - DNA, 28397 bp, Homo sapiens
  misc_feature (1)...(28397): n = A,T,C or G, or insertion/deletion polymorphism (see Tables 1-2)
acaggacatggcctggtgtggaagaaatgctatctcaatgtgtaaaaggtcattcagtggcatgatttagagagattagagtatccatcccagaactgaaaatgaggcctggagtctgttttgcctttgttcaaggccgtgcttcagattagtgcacattcatattttcttcctcccacatgtctgtgagtcctgagatgtgcgggggatactggctccttccataggactgtcatcagggtcagcagggctcagtctaggggccttacacctgggagcatggacacaccacctacactaccatggaagtatgcagcttgaaggacactgcctgtcttggacttcagttctttgtcttcagtatggggatgatatgacctgcctttacagcagggctcttaaggtcaaattagatcaacggatctgtaattgctttggaaaaatgagactaaaaattatacagtgaatgaggaagaaatgaaaaaatgtcataaaagaccctacattttccaaaacatctgattctgtggtgtttatactgaatagtttcataaactttcaaagaatattactccttaatttaaagacctataaatgtgatcctgtacgacctcctaatctaataaagaaaatgtaaaagtggcatcatttgtttatataaatgttaaaatgtaaatagaagactagcatgtaaaattcaagagaagaaaataattatgcagtagaaggggccagtataggattgcggggaaaaagctcacgttccctgccatagtcaccaagacagcatggtactggtataaaaataggcacatagacaaagggaacagaatagagaacccagggataaacccaaatacttacagccaactgatcttcgacaaagcgaacaaaaacatatggtggggaaagacacccttttcaacaaatggtgctgggataattggctatccacatgtaggagaatgaaaccgggtcctcatctctcaccttatacaaaaatcaactcaagatggattaaggacttaaacctgagacctgagactataaaagctctagaagatcacattggaaaaacccttctagacattggcttaggcagggatttcatggccaagaacccaaaagcaaattcaataaaaacaaagataaatagttgagacttaattaaactaaagagcttttgcacggcaaaaggaaccatcagcagaataaacagacaacccacagagtagtcacaatctatacatctgacaaaggactaatatccagaatctacaatgaacacaggcaaatcagtaagaaaaaacaaacaaccccatcaaaaagtgggctaaggacatgcatagacaattctcaaaagaagatatacaaatggccaagaaacataagaaaatgctcaacatcactaatgatcagggaaatgcaaatcaaaaccacaatgtgataccaccttactcctgcaagaatggccatgataaaaaaataaaaaaacagtagatattggtgtggatgtggtgatcagggaactcttctaccctgctggtgggaatgtaaactagtacagccactgtggaaaacagtgaggagattccttaaagaactaaaagtggaactataatttgatccaacaatcccactactgggcatctacccagaggaaaataagtcattatatgaaaaagatatttgcacatacgtgtttatagcagcacaattcacaatcacaaatcatggaaccaacccaaatgcccatcaatcaacgagtgggtaaagaaactgtgatatatatatgatggaatactactcagccgtaaaaaggaatgagttaatggcatttgcagcgacctggatgagattggagaccattattctaagtgaactaactcaggaatggaaaactaaacatatattctcactgatatgtgggagctaagctaagaggatgaaaaggcataagaatgatacaatggactttggggacctgagaggaaaggtgggagggggcaagggatactgctcaggtgataggtgcaccaaaatctcacaaatcatcactaaagaacttactcatgtaaccaaatactacctgtaccactataacctacgggggaaaaaagcaacataaccatgaaccaactaataaaaaacaaccttgccttcagtctgcatcctaccctagagacactctctctgtgtcctcacacttggagctaagcttctgacttttgtctccagtacacccctgaggatcctctcatcacggccatcagaaacctctgtagaaggtcaaatccagtgggttcttgtcagtgcctctgacttgagttactgataatatttgcaccataatccacttctttctaatgagctactctgtccttatttttctcctatttactgaatcctccttatcatcctttgaaatctcctcttaattattatgttctctcatcataccctgagatccctgcatttctgatttttggcactcttcctggaaaagctcatctaacctgcacctatgcttgatgactctcagttctctggcttaaactcctctactgagaccacccatcatacaaaaatgtttacatattatttttccttagataacttttagacattctaagtgcaatagccccacactgaactcagtctcttctctcagtcaggctgtcttctctcattaccctttttaatgaatggaatcaagatgtttgcattgggttggggagatgttggtcaaaggatacatccatttcatttcatttaggatacatttcaaaagatacatttcatttagattggaggaataattttaagagttttattgtataacatggactatagttgctaacaatgtattgttgaaaattgctaaaagggtggattttaagtgttctcaccacaaaaaataagtatgtgaggtgagccataagttctttagcttgatgtagccggtccatgatgtacatacatttcaaaacaacatattatacatgataaatataaataatttttgtcaatcaaaataatttagaaaagtgacacacacttacacacacacacacaaaagagatgattgcattggccagtctaggaataagagttatctgggagttttctaagtcggatgccaccgacatcactcaccaataatccctttaatgtcaatcaaattaagtcctcttcttccatcattttactcctatgcccatttcctcactctttgttcaggcactattagtcttgcctcttgaaccaacttctttcactcatgctgcccactgttgccgtagtgatcttcctaaattgcaaatgcgccatcactctcctgcttaaaatccttcaatgattccttatgacttccaggacagagtagccactcctgagctttgcatgtaacatctgtcatgatccagcccctgcctgtctatttttccttttttcttgctgctgttccacatccaaagctggctccattcatactgaagcagctgaagttcttcagatatgtcattgccacactgggcccacacttttgaacctgcttcctcctgtgtgagaagtggcttctgccctgttttcggactgcctacattgaagccatctgttccccaggaaaccttccctgatgccttgacagcagcatcttgtgcctgccccatatctgcacttatccatctgggcctgctgttgtcttgtcacttgtgttctcttctgtgaactgtaaacatcaggaggacaagacctatgtcttacttttatttgaatatttagcatctaacaatgttcgacatatagtaggcttttgatactatttttttactatgacattgtagtatatgttaatatccagtaggacataggatatattctctctgttttcaatttttcattgtttacacacatttataattctatctataaggatttacaattatttacatgaaatgaatgaaataaatagagaatgttagatattaagagacagtgtggaaagccaggctgggactagggatgcacttaccttaggtgcaaaatttaggaggataccaaaagaactcagtaataaaagtcaatcatattttaatgaaatatcttaagaaatctaaattaatggaaaatatataatgaacaaaatgtcaaaagagaactattcaaagaaaatggagaagcagagaggcagaagaattagtagaatatactggcacataagccaaggaggtaaagatttccaggaaggaggaagtagagtggagtcagaagttcaacagaagtcatttcagaaatcttaccttggttttgaaatcctttcagagagcagttttacataatgtgagcaattatttctccttcatccccatcattccagaattgagcttcttctctggcttcagaaatgtggcccttccccttgtcaggatatgttggcgacatgatgcatgcggatgccctcaaagtcagctggggtttgggggtgaaattaattgactttagggaactccttgaatgctaagttctgttcacctggaggaccagagagggcacagagatgaccacctagcttctgcctgggacctaaacagggcagagaaataggaggatcaggtataaagggagcagggaagatgggtctgggcttacagtactgaacccagggatgacagtaactgtgtgtgtctcgaggcaggtgacaaaatatgtgaaaggaagaggacttaggagagatctgaattccagctgttttacaagctatatctcagctttctttctcaattcatgtgctctctaccccaaaggctgatggaattgctgacccttcaagttctcttctcatctgcaccccttccctcctgctgcacactgttcagcgacatcacacacttctccagcctcctctcttcctagtcttaccccttcccagtttccataactgaactgtcctgttgaggagttcttagcagccctctgtgaccacaagtgcaagttgcactcccttctgagacaaagtcccccatttattccctcctgagggcgtgtcccttcccctgaccctcatggactctcccaggtgcaccccctgtggatttgctcctgggcctgagtttcccctacttccctgatggtgtctggagggcaaggggtatctgtctatctactgagtgtcataaactgcccaactcagcacacccaccctctacctcttcctaagtgtagtgacacggtgagggaggtaatggggtggggtctggaatcagacaccaggaggaaaggggtggtggctctctttgcctctcactctgtgtgtatttctctcgggyaccaggaggatttcctaaagatttctttctcctgactgttttctggacccrtcctggtctccaagctcccctcctgattctctgcagtgcccaggtgtccaacagttgagcctggagccaggccaacttgtcagcttcctgtatgaggatcagactggacgacttcaaccygcttagccsgtcttctgaggcctcaccctagtagttggcaagtaagtctatttgctcctctggtctgcctggcccacacttttgtgagaaagtgccctagaacctgtacgctctaaactgtgaaaccctgttccttcttttggccacaacacacctacgcactgcccaaagttcagtcacttctagcccagagtttgggcttagagtgcatccttctctgcaagttgtgttagcctgtaccttgggcaagttacttaaattttttgagcctcagtttctacatcttaggatggacagtaaatagaattggcacaaacaagtgagaaagtgatggcacagtgtttgttgcactgtaagcacttgataaatggcagctattgtgattactgctctcatcgtcattggtttcaactttcatcaacagatctccaaccctgttgacgcccctgcttcagtcagtcacttgaacctctcactccatgaccaggtggcamcktgtggctatggccatgaagggccagtctgtcaccctcattgttgactgcaagatgtgagtcacccggcctctcccctgaagaactagtccagtgttggacacctgtggggtgataattgttggtgcctgtatcccagatgaagaaagtctttgaggttaccacaaaaatcagagaaaggagtgacttctggtcccttattttgtgcccactcctcttctggccccagtatgcaatgttcctatttcctaagccttcattttttttcttgtgaattttgatttgcatttcctatcttcaggactgctgatctctgcagaataactagatgtccacttatgtggcaggactgtccacagccacttattctatccttcagtcttcatctytccatctatccatcccttgaacctatctctctcctcatccaccccatccatycactcattcaccagtccacctaygcacacatccaccacccactcccgcaaccatttacccacctatgcatcacaaacttacccatctactcatgcatgaaggcttatatccactcacctgtccatcctccccctgcttaaygactctccccttctttacacacatctattcgactatgcttttgttcatctgtcctcttcaacttatccatccatctattcactcacccacccactcacacaccccatctacccatgcatacaaggatgcatgcatctgttcagccacccatctatccattatccttcctggaactcaaccactctctccttcaatacactcatgcacccatctcctcacccactcacttcacatccaaccgttcactcaaccatgtattcaattccacccatctatctattcactcatctgattccatctactctgtacctcccgctcatctacccactaagccttgcatgcataattccctctgcaggagtcccattgtacctgttttgtgcctttcttttcactctgggtcatggtagccatattgttgaaggttcacttcccagatcctcttttcttggctgcttcctgtckgtacagccrcttcctgtttgtccagtttgttttgtggccatcttggccatgtttaattttccttggccctggcatcactcttgcatccaagtgtttgtcattttattttgtgtcccttagttgttctmatatcttccagtattctctgtcagttggactgcttcctgtctactctgctacatcttctgcctgccttgcagttatggctgccttttctaccctgctgctgcatcccacacctcctgctcttggcacccgygagcttctgctgcctttcctttatgctgctgtctgggtctttggggttgatgtgggatmtgggagaattttgaaayggatcattgctgtcaggatgaaggtggagaggggcattctgaagatctttgttttggggagttggggtggtggtgaatgtttcaccttctccccacccttatcttgsctatggcctggatttgggaacaggcatctgaatggaggtgtgcaagggagggaactggttggcttggagtgtacatgagggccagaagaagggcaaagcatcctgctgggagaggaactgtggggtgyattgtagggggctgctctggrgcttggataactgagcccaagaactrtatgttttgcaaaaggcagttatgaggcctgagtttggaatatctctgggaaatgctctccaaatttacttggagtatggatacttaacctgtgcagggtttttacatttttgaactccttcaaattctaaataaaattttgtgcataagggcatataccttttcttttttggagaaagactgaaagactcaaagtcctctttctgaaagaggctcttcaggatttggagaggttgtgtttgctgaggtgggactgagaactggggtgcagggaaccctgagatctccttggcaggcatgagagttttgtgaacagaagtatttagaggaagcctgtggggcttgtgggtagggctggtctggtctccagaggacccaaaatcgaggttggagttgagatkggggcaggcctggtgtcctggctgctcatgggccccactggggttacatgtgtgtctccctyaggctgcccatgggccccggggkctgaagggaragaagagagagcctgcagtgctggaacctgtaagtyatgctggtcacagggctgaggtggtggaaagaggagaagcaagtggggtttagtgtgctggccctgtcacctgtgagttttaacctttgactccacagggtatgctcktgraggggmcccctggtttagaaggccctgtggtgagtctagcagtgacctggtggccattgttttcttagagatccctcctatgtgttcatctgtgccttccccacatatgctcaggcctcctcctcagaactccggagggtccttccaataaaagttttttaaaaaatcattttgaaaaattaattcaatagtttttggggagcaggtggtgtttggttatatggataagttctttagtggtgatttctgaggttttggtgcacccatcacctgaggaatgtacactgtatccagtgtgtagtcttttatcccttacccagctcctactcatacctggaagtcctcaaagtccattatataattcttatgcctttgtgtcttcatagcttagctcccacttataagtgagaacatacaatatttggttttccattcttgagttacttcccttaaaataatggtttctaattccccctaggttgctgcaaatgttatttcattctttcttatggctgagtagtattctaaggtatatagatcacatatatatcatatgtgatctatatatagatcatatatatatatatgtgatctatatatatatatatatatatagatctatatatatatagatcacatatatatatatcacatatatatatatcacattttcttcattcacccattaactgatgggcatttggggtggttccatatttttgcaattgtgaatcatggtgctgtaaacatgtgtgtgcaagtgtctttttcatacaatgrcttttttcctccagtagtgggattgctggatcaaatggtagatctatttctagttctttaaggcatckctgtactgttttccataggttgtactagtttaatttcccaccagtagcatagaagtgttctcttttcatcacacctaccccaacrtctatttttttttttatttttaaattatgaccattgttacaggagtaagttggtatcacatagtggttttgatttgcatttccctgataattagtgatgtagagcattttttcatatgtttgtcaaccatttgtatrttttcttttgagaattgtctgttcctctgcttagcccactttttgatgggagtatttgtttatttcttgctgatttgtttgagttttttgtagattctggatattagtccttttttgtatgtatagcttgcgaatattttctcccactctgtgggctgtttactctgatgattatttcttttcctttgaagaaactttttagtttaattaggtcccatctatttatcttgtttcttttgcatttgcttttgggttcttggtcatgaactctttgcctatgccaatgtctagaagagtttttccaatgttctagaatttttatggtttcaggtcttagatttaagtctttgatctaccttgagttgatttttgtataaggtgagagatgaggatccagtttaattcttctgcatgtggactgccaatttccccagtaccatctgttgaatacgctgtcctttccccactttatgtttttgtttgatcagttggctgtaagtatttggttttatttctgggacttctattctgttcaatttgtctatgtgcctgtttttataccattcccatgctgttttggtgactatagccttgcagtatattttgaagtcaggtaatgtgatgctccagatttattcgttttgcttaatcttrctttggctatgtgggctcttttgtagttccatatgaattttaggattgtttttttctagytctgtaaagaatgatgatggcattttgatggggattgcattgaatttgtagattgcttttggcagtatggtcattttcacaatgttgattctacccttccatgagcatgggacgtggttctacttgttagtgtcatctataatttctttcggcagtgtttttaattttcctcgtacaggtgtttaacctctattgcgggaagtcagggaccctgaatggagggaccggctgaagccacagtggaakaacataaattgtgaagatttcatggacatttatcacttccccaatcaatactcttataacttcctatgcctgtctttactttaatctcttaatcctgtcatctttgtaagctgaagatgtatgtcacctcaggaccctgtgatgattgcgttaactgcataaattgtttgtaaagcatgtgtgtttgaacaatatgaaaactgggcaccttgaaaagaacaggataacagcaattttcagggaacaagggagataaccataaggtctgactgcctgcagggccaggcagaacagagtcatatttctcttcttgcaaaagcaaataggagaaatatcgctgaattcttttgtcagcaaggaatagccctgggaaaagaatgcattcccgggggaggtctctaaaatggccactctgggagtgtctgaattacatggttgaagataagggatgaaatatgccctggtctcctgcagtgccctcaggcttgctaggattaggaaattccagcctggcaaattctagtcatactggttctctgctctcgaaccctgtttcctgttaagatgtttatcaatgacaatgtgtgcccagcgggatgtggaacctcatcagtgattctagttttgccctctgccttgtgatcttttactgccctctgaagcatgtgatccctgtgacccattccctattcatagacccccaccccttttgaaatccataataaaaacttgctggttttgcggctcaggtgggcatcatggaacctgctgacatgtgatatcacccccggagacccagctgtaaatttctctcttttgtactctttctctttatttctcagactggcccacacttagggaaaatagaaaagaacatactttgaaatattgggggctggttcccccagtaaacctccttggttaggtatattcctaagtattttatttttttgcagctactataaaaggggttgagttcttgatttaattctcagcttggtcactgttagtatatggcagtgctacagatttgtgtacattgattttgtatcctgaaactttactgaattcatttatcagatctaggagctttttggataagtatttatggttttctaggtatacagtcatatcattggtgaacagtgacagtttgacttcctatttactgatttgtctgattgctctggctaggatttccagtactatgttgaatagaagtggtgagagtgggcatccttatcttgttccagttctcagggggtatgctttgaacttttccccgttcagtataaggtcggctgtgggtttgtcatagatggtttttattaccttaagttatgatctttgtatgtcaagtttgctgagggttttaataaaaaagcgatgatggattttgtcaaatgctttttctgcatctattgagatcatatgatttttgttttcaaatctgtttatgtgatctatcacatttattgacttgtgtgtattaaatcatccttgcatccctggcatgaaacccaatttatcaccatgtatgatctttttgatatgctgttggattatgttagcttgtattttgttgaggatttttgcatctattttcatcagagatattggtctgtagttttcttttttattatgtcctttcctggttttggtattagggcgatcctggcttcatagaataatttagggaggattctctccttctctgttttggaatagtttcagtaggattggtaccaattctcttctttgaatgtctgattgaattcagctgtgagtccatgtgaatctgtgattttttatcgttggcagttttttaaaaattaccatttcaatctttctgctttttattggtctgttcacagtttctatttcttcctgatttattctaggagggttgtatatttccaggaatctgtcttctctaggttttctagtttgtgcctgtgaatgtgttcatattagccttgaatgatattttatatttctgtaatatcagtggcattttcttccattttgtttctaattgaggttatttggatcctctcttttcttggttaatctcactaatggtctatcaattttatgtatcgtttcaaagaatcagcttcatgtttcatttatcttttgtatttttttgtttcaatttcatttacttctgctctctttgttatttcttttcttctgctgggtttgggtttggtttgttcttgtttctctagttccttgaggtgtgactttacattttgtatttgtgctctttcagactttttgatataggcatttaatgctatgaactttcctcttaggactgtttttactgtgtccgagtggttttcacaagttgtgtcactattatcattcagttcagagaattttgcatcttgatttcactgttgacccaaagatcattcaggagcaaattatttaatttccatgtatttgtatagttttgaaggtttcttttggagttaatttccaattttattccactgtggtctgagaggggacttgatataattttgattaccttaaatttgttgaggcttgttttgtggcctattatgtggtctatcttggaggatgtttcatgtgctgatgagaagaatgtatattctacagttgttgagtagaatgttctgtaaatatctgttaagtttatttcttctagtgtaacttaagtccattgtttcattgttgactttctgtcttgatgactttctagtactgtcagtggagtattgaagtccccactattattgtgttgctgtctatctcatttctcatgtctagtaataattgttttataaatttggaagctcccatgttaggtgcatatatgtttaggattgtgatattttcctgttggagttatccttttatcattgtataatgtccctctttgtcttttttaactgttgttgctttaaaatctgttttgactgatataagaatagctactcytgcttgcttttgttttccatttgtatggaatatctttttccactcctttaccttaagtttttgtgagtccttacacattagatgactcttgaagactgaagatacttggttgctgaatttttatccttcctgccattctgtatcttttaagtggagagtgttaatattgagatgtgaagtactgttctatttctcatgctagttgttgcctgaattccttatttttttcctttgcattactgttttataggccctgtgagatttatgctttaaggaggttctattttggtgtattttggagttttgtttgaagacttagaactccttttagcattttgtgtagtgctggattggtagcggtgaagtctctcagcatttgtttgtctgaaaaagactttatctctccttcatttatgacgcttagttttgctggatacaaaattcttgcctggaaattattttgtttgaggaggctaaagataagaccccagtcttttctggcttataggctgctgttaatctgataggttttcctttataggttacctgatgcttttgcctcacagctcttaagattctttcctttgtcctgactttagayaacctgatgactatgtgcctgggcgataatctttctgtgataaatttcccaggtggtctttgagcttcttgtatttggttgtgtagatctctagcgaggccagggaagttttccttgattattccctcaaatatgttttccaaacttttagatttttgttcttcctcaagaatgccaatyattcttaggtcatttaacataatcccaaatttcttggaggctttgtttatttattaaagttcttttttctttgtctttktctgactgggttaattcgaaaggcttgttgtttgagctatgaagttctttcttctacytgttggatcctattgttgaaactttccagtgcattttgtatttctctaagtgtgtctttcatttccagaagttggattgtttcttctttatgatatctacgtccctggggcatttttaatccatatcctgtgtttttaaaaaatttatttaagttgtttttcacctttctctggtatctttttgagtagcttaaaatcaaccttctgaattctctatctagcaattcagagatttcttcttagtttggatctattgctggggtccagtgtggaggtggtaggggagtgaagtagactctgtgagaatccttggttgtagatagacttagtgtggtggctttctcaaatgctggttatgctagcagtgcagttgtcatgtgaacagaccgaagaccactggttagtcaagatttttcagccagtggaattagctgttttctcctttcttagagcagttattctgtcgtgaattgttgtaatgtcctgagttggttggcctccagccaggatgtggtgctttcaagagggcaccagctacaatagtagaaggtggatataagcttgccctaagttggccaagataaatattcagtttctcaggcaatgagtggtgtcataaagctcccaagagtttacgtcttttgtgattggctaccaggtgggtagagaaatgccctcaggtgtggacagggttaggcaggtctgagctcagactctcctcgggcggggggcttgcggcagccactgtgagggatggggtggagggtttttctccagccaatggaattatgttccagagggcattatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctttttgttgcgacggagttctcactctgtcacccagggctggagtgcagtggcgcgatctcggttcactgcaggctccgccttccgggtttatgccattctcctgcctcagccttcctagtagctggcactacaggcgcccgccaccacgcctggctaattgttttgtatttttagtagagacggggtttcatcgtgttagccaggatggtctcaatctcctgaccttgtaatccgcccgcctcggcctcccaaagtgccgggattacaggtgtgagcggcagcgcccggcgtacttttgtatttcatgctaaatctgtttcaggtctaggtaaagttaaatccttttcctgtaatctggattttcgagttccccagtggggacatgggtccggaggcaggtttttcccctctcacgctttgggaacgcacagtttttcacttgtctggtggagtttgcagtggcccctcccttctttaaaaggatctgtgaattctttcgattttctgggtattctcctgcagtggttcctttcttgagggatctgtgaagtgagttcctcaagatatttcttgtcaggtgaacagtctgtggtctctgcagggcctgtaccacccctgggcactgtatgccccacagagtgggcctctcctgtgcagggcctgggaagaggttgattataatctggtgtctgaggcctggcagcaccacactctcttcagtgagtcaggctcaagtctgagcacatctgcagagcttatgtttgctgtgttgctcatggaaggcagggaatccaaaattgttttcttagagatggactctcactatgtttcctaggctgctttcaaactcctggcctcaagtgatcctcctgtctcggcctctcaaatcactgagattacaggtatgggccactgtgcccagcctattatcgattttctcccatttcattcagtcctcaacccaatgtactctctctttttctttccctcatctctgatgctcctctcagggtggcaactaatgacttttatacaactcaagccagtggtcactgttctgtttctgtcttatgtgtgtcattagtgtgtttgagatgccccctctcctctttcctggaagttttctcctgtctcttgtcttttatgaacccacttcctctctgttttcctaccamtttctagtcctctgcttttcagcctctttcttcatgtctgtgtttgtctggatgcaggagcacacactcagatccctgctatcctgactttgtgtacttttcttgagtgacctgacccaaaattagaacttcacccaccatgagcctccttccagtttatgtcactaacctaatgtagcatgacactcatccatttatttcactgccttcaaatcaactgtatgttttcccctagaagtttaaattcagtatgtctcaaacagaaaattttaccttctctcaatcacttaattatcacctttgcagkcacggatgccacaattctccacgttgcgtggttattctcgacttcttcatatccctacttctggcaygtgatttagtgattcctgtggcctctcatgtcattactgccatcaaatccatctgctgtcctcctcaccccatgttcctgccctggcctacgccttcattacttccyaccagagggcttaaaagtgctactggtcttgccttgagtccmgcctcctccagcccatccttcctacaggtgccccatccaaacacaaatctgaccgtgttactctcctgcttaagatacttcacaacttcctrtgtcctgtgggataaaatgcaaacacttgccatcagcacacaaggcaggttacagtgctgcctggcccacatctcccctggcttcagtcacactgaagaactgcagttctccttgcaacttcatgcctctctgctcctgagcctgcttctcctgctggaaatgccatttcccctttctctgttttgctatctgcaggtgaacactgtccctaggaacctttcctaaatcgtattttaattttgctcctgagtagctcttgtgtataccttgtgatactcagtggtgatcaaaccacacatgtagcaatcatcttttctttgtctgttttattcttgaatttcaagtagattaaggacaaagttcccatctttagagtttcatccttattacctagagagtgaaagttcacaaaaagcatttattaactgaatgaaaattaacatttgaagtgtggaatttgcttcaaaatgtgccaacctttagttttcagattttgtaaatataataaatacaaagtaacctaagctgaaccaattacakctgtgtagcccagtctatacaccrtgtatttttctttttcctttgggattcatttctgtaggtgagtaatcctctagaccctaaactcagtgggggaccctcaccatccgtgtgcggcactgaacctgctgtcacactatgcatctaagtagaggactggttctccccatgctgggctgggaggggaaatcctcacttagggaccaccaaccatgcagtgtcatttggcttcacttcctcttccaggccgaaccctaaactctctgtaattcactgtaataataattcactttttgttatcaaccagttgctgcttcttatgtatcaggtaaagctaagatactatcccrtaggtctttcaaatgccaacaacttgtatttccaggtgaaactacacttgaaaactacactccwcaagacaattttgtgaatgttatgtgaatgataatacttttaaatttactctgcctaaaatgtaagtgttgtggataaaattatagaaggtatcatttttcttctaaaagtaagaatgtaacttgaagtctataaatgtcactaagactctggaggtattttcatgtccttcacgattttgttccactctgaaatatttattccatccttccacttccctgccttgctttatggctatatcagtaatttttaatgtattgtcctgtagggtttctgagatcctacaggaatgaggtaggaggactactcaatattgtttctaccaggagttgtgtgacttggacaagttactttacctctggggtcagttccctactatggaaaataagttcttctacatgggggtgtgaagattcaatgagtaagtttagcacatagtaagtgcccaataaatattatcttactgtattcagcattaccattatcatagacggatgttaagtcttcagggacaagggaaacaacctatatcgtccatgggtcatttctgtctttgtttcttctcactccttttcttttctttcatttgcatttctcattttctgtgttattccttcatgttcccaataaccttcctgttacctgtttgcttcctgcattctgtgtagcatcctacrtattcacccattctccatcttctccttcatgcagcagaccatgtgtcaacatatgcggagtttgtgcagacgcacagaccctctggggagtatatgtttgaatttgatgaggaggagcagttctacgtgaacctggatgagaaggagatggtctggcctctaccagagtttattcacacytttgactttggtgctcagaggggtattgctggcatcgtcatggcaaggaagcacttgaacacccggatcaatggtccaaacagacttgggccacaaatggcactgcctatagctgcctgttcctctcagaggggtattgctggcatcgtcatggcaaggaagcacttgaacacccggatcaatggtccaaacagacttgggccacaaatggcactgcctatagctgcctgttcctctagagtccagctggagggatgggagggcctctctgccacacatagaactagaggccatgatgcccactcatgaatgagccccttccctgagagcgagaaatcttgggtccacacagctgggttcttaggacagcagaggaggaggcattttcttcttactcaagagaaaggctgggctgagggggccaggtcaggagcacgagaagctgtgaccctgtccaggagccctaggggagcaggaggatgggcctgggagaggtggcccctaatctggtgaatataggacttggggtggtggaacctttaagaatcagccaatggcagtaggctccttgggttctatccccttttggagcccccaccgaggtaagcgtctttcccaaggagcctgtggatctgggccagcccaacaccctcgtctgccatgttgacaagttcttcccaccagtgctgaacatcacgtggctgcgcaatggggagccagtcattgagggtattgcagagaccatcttcctgcccagcaagaaactcagattacacaggttccactatctgaccctcgttcccatggccgaggacacctgtgacctccagggggagcactggggcctgcaccagcctctcctcaggcactggggtatggagcgccctccctctgccctcacggccttggcaccacctttatttcctgggcccatcgcccctcagcacctgccttcctcaatcccatgttttayggtcactttatccaaatttcaccatctcatggtttcgaatacccaacacctcccacatccaaggccagcccctgctctctgtaccttataactctgtcttcccttggtgccccagaggtccatgaamtaatccaggtgcctgagaccatggagatgctggtctgtgccctsggcctgctggtgggcctggcgggggtccttaatggcaccattgtctcaaagaccaagcgatctgacagcatccccgggtccaggggctcctatgagtcatcctataggtgtattagggacagagtggaaaagacgaggtaacaagttaggggtgaagagtgggaaagagaaacacttcaccaggggctctttgagcattactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcactgcatccttccttagaaatcccagagtttcataaacacctgcatatgtcagagtgagacacatctgataccttctttctgtgactccagggacattcctcatctcctgacaccctcagttccctaggagcacatatcctgttcctgtaatgtgggtgcagatacctcagcttctgatcctgacaagtgttagtccagagattgttcactccactcggggtactgccctaacctgtaacatgagtacaggagacaagcaggaaagagaatgactctgactggatatggtttgtaatttgtaatgttaactgctcagtgactctgagggtaggatttatgtgctctgggtctgaggatttcataatgatctcgatttgaagactttctgctattctcatgacctccttccatcgttgaatccctggattgaaatcatattaattttatgctgcataggtttctcacaagtttcctgtgaagccaaaagggaaaataagacagataaagggtccttatttactatatactgtcttccttagcttattatgtgacagctgaaattactacgcaaaaacaagtcagcagcattttcctttatagtttttgaggaaatgaggctgatcagggataaagatgttttaaaaagaaaaaatgattgtgtcctattccctaggttaagaagattatgagaaacatgattggttgtccttgtgtgtggcttctctttcctgactccctgactcagtccagcctctctgcagactccagctgtatttacttatatctgtgccagtgacgcccaagtctgtgccttcagccccacctctcctgaaattggaggaagccggtcccccgatggaagatattatttgcaaggggagatgggcaagaggagcacagtagctttcgggaattgaccagggacaggtgcccagggacacacaaggcccagaagatgcttgtaagaagccagggagactgaaggcatcaactggatgtataagagagctgctgtgcactgattgtgtgtatcaggagtgaagaatccatcctctacacgaaaaagaaagcttacaacaaacatgtcctctaccttgaccaaaaggtgtcaatatgagacgcaaaacacataacaatgttggattgttaagaaaaaaaaaaagaccagtgtttgaaaaagagtgctacatgtattgctttgctctttccccagtggggagtcatttctgtctgtatgaaaattaagacaggaggcctaggctggtggatgaatgcagacttagacgacaaatgacgtctattggatgcattcaaaagtccaagccgtatttggttaaggagtatttgtgatggcacacaaagaaaatggttaaagtgtattagattatatttatgattttaaattctgatgttcatttaacttcttaatggtaatgataaaacatgctctcagtaaggtatatgttgaattagtgctgtgggaatatgggtcctatcaggcagatttgcagtctgctcaccattgaatagttaagaatagtggtctgagacataaatggatgagggcactaaacttgatttgggggcagctcactgaaatacagtcaattcagaagagtgtcatgtgtaacaggccccattatacaatagttaacatatccccattttcatggttctcttctttcctatgtttaaaccaaaatgaacttctttattaactcctactgtctactaaaaccctcagagaaaagtgatgagagatgatttggtgcatatttttaaaggaaaacaaacagtcatgttgggttttgattatttgtggtgctaagaagaagggaacatggttggaggcccagtgagagaaacagtgctttgaatcaaagagcagaatgatagaaactgacttcagagcaacttcttggcagcagtatccaatttggaagttgaaggtctgtcctggagccagatgctaacgaaacacagcaaatgcttttcctaaggcacaatagtcttttcagtgagctcaggaaccctgtgggggtaaaagacaagttatcccaggttgccagcctccttcctgtaagtccaggagagaaaaattatggtgagaggatgcgtctcaggctgataaataacagagttgatctctgcttccttcagcaatggagccaagcaatgctctttccccacttgcctgaaggctgacattgaaagaggggttcatgcctgagattcccttcctggaggagcctcagtgttacaatgcacagaaaggactcatatcctcctgcaacccaccccacaaggaaatcaaagcaggaatattacctgtttatgcagatcctcgttgaactgaaatgaaagacgaaaggttatataatcagccattgaaaccacctcagataattagagaaacatttccatcccaccaaattccattgcccatcactcaatggacgctccgcaggagcctgagtacttgggacctcatgcatctggctgcattaagatcccagcctgggatccctctctcgctataggtcatgtttgttccccgattatctgatatcagtggcctctagagctttctgacatttcttttctgtcaaacccctcatcgtggaataagtgtgaatatgccaggggaaggtaagtcccgctcaccctgcaggctttctcacctttcttgctcctcctgtgcatgaagatgcccactccacagatgatgagccccagcacgaagcccccagctcccgtcaatgtcttactccgggcagaatcagactgtgcctctgggaaggacagacccaggtttagtgtcacctccaccagctgcatccctactcatgtcctgtctgagattctggagcctgatgcagcatatcgggatgaggacagtgcagcggaaaaagcttgctaagaggaaattcagaaagagccaccctcatatctggaacaggggtgtgacctcaacaaggtggcaaatgctgattctggaagttgcctctcaaaatgcctgagaagaggctaaaatgctgaaggaagagaactgttcctatgtgtgaggtcagttcctaagtgtgagggtttcgagaccagtcagtgtccctagattctctgacaagggggagaactatgaatcttcaggaacccctaagccaaggnnnnnnnnnnnnnnnnnnnnattaacaaatgtaatgagaaatgacattcattgagttgcttactatgttctaggcactattctaagtgcttctcatgtgttcacttatttacatctggaggttggttcttatttatttcatgttacagagcaggaatcagacaccgggagaggtgaagaccacacagcttcaaagtgcaaagcttggatttaaacccaggctttgggcctgcagtggctgcagtcttgtccagtatttagattatttcatctgcagtcactatctgtcttcctacattttacacagccttaattttcttctgcccgcagagtgatgttcagaacttccaatgctatgttaaacatttccagcaacgaaggacatcctatcttttgcacaatctcaaaggcaatccacctcatttctttgaaatatatatgctatagatttttggttcactacctttaacatgtcatgaaattgattaaattctgtctatgtcttgagctgaattcagtttaaattaatatgaattttgcggagtccactaatgtgttaaccacattatatattttctgacactgaagaatcattgcattcctagaataaatctaaaattggtcaaaacgtattgtttttataatgtactgttggattcagtgacatggctaaaattagtccacaatcctgttctcctgtactattcttagctggctctggaaatataaatgaaccaacctcataaaatgatctcaaaaattctgttccattctatgttctagaatcacacgtgtaagaggcatgatctgctcctggaaatgtgggaggacgccctcatctgcaataagatcaggacagggccctttggaaggcgattctttgcttcccatgacaatttctttgatattctctactctattttagttttctatttcttcctgtagttttgacctttatatctttctagaaacgtatccgttttatctaaattttcaaatttatatgtatagagttggtcgtaagattttgcattttaaaatgtgtataaatgtcatttacccttttcgttctgaatctcctgtattttccttaggagtcttgccagaggtctcattaaagttttcattgcctcaaaatttgattttrtcttctctatttttatatttcattgaattcagcttttgtccttattatttacatgtattttctttttgctgtttttctgcttttccatcctcttaattcacataattagctcatttgtttacagtcattttactctaacaaaattgtttaacagtctgacattctatgcagcattttgaatgaacttatttcatctttctataaagactaaacatctattatgttttcagttatttcctcttcctccactatttccctgactttctagacgtctaattattaagatgtcagatgtctgtttctatccttcatttctcttcacttgtcctttacattttctattgtttactcgatcatattgtccttgggacagtttctcagtttggctttttgtttattaattacacttcagttgcaaaagtcctatttcttgtctcatttattatgtttcttattccaatctttatcaaagctcaatatttgtgcttgattcagtg

SEQ ID NO: 10608 - DNA, 13878 bp, Homo sapiens
  misc_feature (1)...(13878): n = A,T,C or G, or insertion/deletion polymorphism (see Tables 1-2)
tgagccactgcccccagcctgtttttaagtgacagaaaaaattacctccttttccacaaagacctcagaagtctcagaagttaagtggcagaggtgagagtccaacccaggctggaaaagggggatagtaatacataagtcaaaaagttatgatgagatattaaaaggacaataaatagcaaagacatttgcaaaccataaaatgcataaggaagtaattgtttttctcccaaggaggcaacaattaatcttacagaggtctggagctctaagatgccaacataccagaaactcctcagacctgggccctctccaaatatctaagtctcaaattaaaggagagcagtggtcaggcatggtggcgcccataatcctagcactttggaaggcggaggccagtggattgcttgagctcaggagtttgagaccagcctggacagcatagtgagaccagccttgccaacatagcaaaatcctgtctctactaaaaacacaaaaaattagctaggcatggtggcacatgcctgtgatcccagctactcaggaggttgaggtgggagaatcgcttgagcccaggaggcacagattgcagtgaatcgagatcgcgccactgcactccagcctggatgacagagcgagaccccgtctcaaaaaaaacaagataaataaatgaaataaaggagagtagcattcttaccctttgagagcccattcttctaactgtgctgggtggcattcctggagaggattctctaagcagtgtccaggtaacccactcttccctgaagtccccagccacattatcaagcgtcatcagttcctaaagcaagagacctcaatgtgcatcagtagctccctagatattctcaccattgtctgaaagccaaaaaatggccaccagtgtacacaaacaaccccccacacctgaccagaatggtcctgaggtaaattctgtcaaccacagaggggtgcttttctaagtctgtttttacatacgtcttctcctggccaactttcccattactaagagaggcctaggcctcccaaacacatcgacagaacccagtcttttagacacattgactttttgaggaacaaattgtccacgatgaacaaggtaaacaaaggagagagttggcaggtgtaatttgatttctggaaagcttttgattctccccaacttcattttcctcagcaagcaaggaaattgtggccttaactatactcatattagttatgggagcagctaacttcttggcttgcagatttggtgtcaacctcaagggacagattatacagaaccccaaagggaactgtgttggataccattctatttcaagatcttaatggagtcagaaataagactgaaaaagacattttttttttaaaaaaaagaagacatggataggttgtaaaaataagtgaaagtgggaataagcacaaaacacaactcttaggggctgaaaccaatcattaatatattaataaatcgacagcaatatcatgaaaaacattactttttggaggatagtcaagagtgaattactggatggatcagtcatttattcaacaattaatatgttgccaggcataggagtcacatagaaattaagataatgttttttcccttaaaaagtttccaataaaccagcctcagcaacatattgagacctctttctctacaaagaacttttaaaaatcagccaggcatggtggcatgcacttgtggtcccagctactcaggaggctgaagtgggaggatcacttcagcccaggagttccaggctgcagtgagctatgatggcgccactgcaccccagcctagcaacagagtgagcccctgtctctcccttaaaaaaaaaaaaaatgcagccagcatgaccacccactacaaagaatattgcatttcaagggaggaaggaccagactgtggtgaagaagttttactctttcacatcttttgtcccactacaaatcacctatttactactggaacacacacacacacacacacacacacacacacacacacacacttttgggggaaatatttttgtatttacagacattattattggtcatttataaagtattgagtttttaaggatctaaaaaccatctctctggtttaaaactttaacaaacaacaataatgtaattagaaagtaaaaattgtaataagagttttcagtattggccaggtgctgtggctcatgactgtaatcccagcactttgggaagacgagacgggcggatcacctggggtcaggagttcgagatcagcctggccaacatggtgaaaccctgtctctactaagaatacaaaattagccgggtgtggtggcacacgcctgtaatcccaactacttgggaggctgaggcaggagaatcgcctgaacccgggaggtggagactgcagtgaaaggagatagcgccattgcattccagcctgggcaacaagagcgaaattccgtctaaaaaaaaaaaagagttttgagtataatttttatttctacattcattacaaaacacagctgcagggcccacttgctggagacagcgccactgaggaggggagacgtcttagccacggttatagaaaccctgtttcccagcccgtccctttccccatgcacaggtgacctcaaaggccccacagcgctgaggggctgtgactaagtgccactgtgagaagctccagtgcgttcaccgggtttattaataggaacatgactgcacgcgtggggccgaaccccgttcttcttctcggtgctcgcgccctaaccggggtgcggcggtcagagggtcacagatcagctgaaaccctgggaccaccatcgagaagcaagaaaactgattaagagaatgacttatcccgccgacggtatagagaccacagctacctctcccacagcccagcaagacccgggggctcccaaaggccagcgcgggaaccccgctgagaaaacgtctgggtggcgggcaagccccctccacgcccctcagcagcgcgccgctgccgccgcggtctccctccttgaatcactcaccgccccagggcccagccggggatggagcaggaagtgagtcctccaccgccgagccgcacccggcccgcaaccccgaggctgtgcctcccagaacccgaccgggattcgtgacagggctgtggggacacaggtgggactccggcttcgacagccagcggccggaaagtaccgcccccatcctcttgctattggcttttcagtttccatggctagaatttttctctgtccataggctgatagagctgtcaattatcgcctagccttctgggaaacgtagtcccgagcaagacctcaaaggactcggagccgtggatgtccagttccaagcgttggaaagtgctaaacccaattccccagctaccggtcccccggaaccgcctgtttggagccgagggatctaaatgctgtatcctcactgtggcatctgcagatgtgaatctcctggcctcacccacctaccgcggagcagcctggtgcccaccatgaggtctcccgcgctctggcacttcgcccctccccagcgcagagcagctcagccctcgggcctttgcggcctctcttctgcccagtcttccacctcatccccggcggccggagcctgcagggtgtttgcggaggccaggtcccagaccaactcaaactggacattggaaaggcccagcagaagcccttagtagaaaacagacattccgcatccttcccttggcatcaaactcccaggcacatcccctttccgtctggttgatagccagaggaggcgggcgagggcatcaagtattctgggaaatgtgatatcgggcttcaaactggggaggctcctgggtctcatgtgagagccagtgatcactttgggtcggcccctagctaaaaaacaacaaagtctttccttaaagtgaagaaaatgtgcctgtctactccgtttgttgattcagtgcaatttagaaaaataaaagaacattttgtgatgtattataaaacgcttagaattaccagccatagagtttttttttttttttttttttagacggagtctcgctctgtcgcccaggctagagtgcagtggcacgatctcggctcactgcgagttctgcctcccaggttcacaccattctcctgccttagcctcccgagtagctgggactacaggcgcccgccaccacacccggctaattttttgtatttttagtagagacggggtttcaccatgttagccaggatgatctccatctcctgacctcgtgatccgcccgcctcggcttcctaaagtgctgggattacaggcgtgagccaccgtgcccggcccgagttaatgttgaagatccctttgatgctaattccaccattccttcaacaaaaataaggtgcattttccagtggatatttattgggaacattctgttctcaagatcgttctgggggcagggcgtggtggctcacgcctgtaatcccagcactttgggaggccgaggcgggaggatcacgaggtcaggagatcgagaccatcctggctaacatggtgaaaccccgtctctactaaatatagaaaaaattagccgggcgtggtggcgggcgcctgtagtcccagctactcgggaggctgaggcaggagaatgatgtgaacccgggaggtggagcttgcagtgagccgagatcgcgccactggactccatcctgagcgacagagcaagactccgtctcaaaaaagaaaaaaagaaagaaaaaaaaaaaagatcgttctgggaactgtgattactcgggaatcatacataaccattaccttcatgaagttcacaggccaaaaggggaaataaaccataaaaggtatcaaaatcctaagtaatttttttttccatatagccagtggcatcttagttattttgctacacaattatagtcatctgcaaggtaactacattgcattttcggaaactctgtcgactatgaacaaatgtctggttagcagaggtagttagacgtagttagatttagttagacgaaattgaggaaaatggaaatctcagaggaggtcagtaacaaagtaacacccaggaaacctagggattgccagtcctcctgtaactggaacagagttcaggacctggagaaccgaaggcatcttcagacccctcggtaagtctttctagcattttgccattaaggagatcatgaagattattcttcaatctgggactggagtggggagatgaatgaagagtcacagaatctggctggtggctatcccctgccgctctctgcagcttctgttccttctgccttaccttgttctctcggcggtttgttcacaatgatcaggtgtgtggggagtaggggaaaggaagcttggtctcacgagaagagcagtcagtacaggaaaccaatcatgtacccgcaatggccacgtgaagagaggatcattacctgttgaggggttgggtgctaaagggcgtggccgagaggaggcgtagaagagccaggaaaaactgtgaaaggacttcaaggagcatgaaaagacagaaagacttcagcacttgctataactgaatttatttatttatttatttatttatttattttgagacagagtcttgccctgtcgcccaggctggagtgcaatggcaccatcacagctcactgcaacctctgcctcctggcttcaagcgattctcctgcctcagcctcccaagtagctaggattacaggcgtgcaccaccacgcccggctaattttttgtatctttagtagagacgggggtgtcaccatgttggccaggctggtctcgaactcctgacctcaggtgatccacccgccttggcctcccatagtgctggaactacaggcgtgagccatcgcaccctgccagaactgatttttttaaagagagagtctatcattatctattgctgtgtaacaaattaccccaaaatttattggtttaaaaaaccaaatatttggtttttgtgctcccagctgtttggaaaagccgccggtatttctccacctggctctcctctacctccaggcaggcgcacccgaggtccccctcccaccccaccttctgccctcccgcacacttggaccagtgctgttgacccggaagcggacatttctgcagctattctaagcacacgtcggcggagggagcgggacgtggccagcggtcagcggcgaaggaggcaggccctgcgcggggatcacggaagccctgtgattcaccatgaagttccagtacaargaggtccatccctttgagtatcggaaaaaggaaggagaaaagatccggaagaaatatccggacagggtccccttgattgtagagaaggctccaaaagcaagggtgcctgwtctggacangaggaagtacctagtgccctccgaccttaccgatggccagttctacsttttaatccggaagagaatccacctgagacctgaggacgccttattcttctttgtcaacaacactatccctcccactagtgctaccatgggccaactatatgaggacagtcatgaggaagatgattttctgtatgtggcctacagtaatgagagtgtctatgggaaatgagtggttggaagcccagcagatggaagcacctggacttaggggtaggggaggggtgtgtgtgtgacttggggaaagagagggcggctcccaccgrgaggagacagaaggtgaagacatatagaaactttacaccgcacacaccgtcaacgcattttcacatgctcaactgatattttttgttgcttccttggcccagggagaaagcatgtcaggacagagctgttggattggctttgatagaggaatggggatgatgtaattttatggcattcctgagatttaatttttgtgcagtttcatagaaaggtcggtcaggaggtggacaagttggggtcagagatgatggcagtccagcagcaactccctgtgctcccttctctttgggcagagattctgtttttgacagttgcacaagacaggtagggaaaggggacttgtggtagtgggccatacctggggacgaaaagagacccactgtaattgatgcatcgtggcccccgatcttccgtrtcccacacttcttttctcccatcccagttgcaatctcactcacaaacatcacagtaccaccccaggggcggcagtagacaccarcccagaaatttagacagggatctcttatctttggaaaataggggttaggcatgagggtggttatgattaagaagataattttgttgttaaatagcattaaactggaattgacagagtgagttgagcanctctgtctaacctgctctttctctctggtgctcctcatctcacccctaccttggaatttaataagcttcaggcatttccaattgcagactaaaaccacttctaccatctcctctagtattttccatgtatcaggacagagatgtcttatgtagggaaggggcaggtatgaagtgaggtagattatctatacctctcactcattcaggattctcgctcccatgctgctgtcccttcaktctcacactcacaggaatgctatgtgatggccagctgcttcccttcttggttatccactgcagctgctagttagaaaggtttgcagggatgacttttagtaaatcatggggattttattgatttattatcacttataggattttgtggggtgggagtggggagcaggaattgcactcagacatgacatttcaattcatctctgcaaatgaaaagggttcttcctcttgggggaaatctgtgtgtcagttctgtcagctgcaagttcttgtgtaatgaagtsaatgctgtcaggccaagtgaagggaaaagagagatcagactgttactgtgtctatgtagaaaggaaagacataagagactccattttgaaaaagacctgtactttaaacaattgctttgctgagatgttgttaatttgtagctttgccccagccactttgacccaaccactgtgacccaacttggagctcacaaaaacatgtgttgtataaaatcaaggtttaagtgatccagggctgtgcaggacgtgccttgttaacaaaatgtttacaagcagtatacttggtgaaagtcatcgccattctctagtctcaataagccatgggcacaatgtactgtggaaagctgcagggacctctgcccttgaaagcggggtattgtccaagttttctccccatgtgatagtctgaaatatggcctcgtgggatgagaaagacctgactgtcccccagcccgacacccgtaaagggtctgtgctgaggtggattagtaaaagaggaaagcctcttgcagttgagatagaggaaggccactgtctcctgtctgcccctgggaactgaatgtctcggtataaaacccgattgtacatttgttcaattctgagataggagaaaaaccgccctatggtgggaggcgagatatgtttgcagtaatgctgccttgttattctttactccgctgagatgtttgggtggagagaaacataaatctggcttacgtgcacgtccagtcatagtacattcccttgaacttaattatgacatagattcctttgctcacatgttttttgctgaccttctccttattatcaccctgctctcctactacattcctttttgctgaaataatgaaaataataatcaataaaaactgagggaactcagaggccggtgccagtgcaggtccttggtgtgttgagtgccggtcccctgggcccactgttgtttctctatactttgtctctgtgtcttatttgttttctcagtctcttgtcccacccgactagaaatacccacaggtgtggaggggcaggccaccccttcaccaaggaaatgaaataattgcttaccttaaaaaacaaaacaaaacatttgccaggtgcagtggcttatgcctgtaatcccagcactttgggaagctgaggcaggaggattgcttgagcccaggagttcaagaccagcctgggcaacatggcaaggcctcgtctctactaaaaataaaaaaatcagctgggtttggtgatgcgtacgtgtagtctcagctacctgggaagctgaggtaagaggatcacttgagcctggggagattgaggctgcagtgagccaggatggcaccactgcactctggcctggaagacagagtgaaaccctgtctcaaaaaaaattattttatttctgttgattaggaatctggaacagcctaggtgagtatctctaattgaaggtctctcacaaggttgcagtctagacactggctgggactacagttatctgtaggattgactggggctggacgatcagcttgctcccaagctccctcatgtgactgtttcctcacgtgtagcttctcctcacaacgtgtcagctggcttccccagggtgagtgattgagagaaagaagcagaagctgcaatctaaccttggaagtgatagaccatcatttctgccatactcctttggtcacacagaccaaccctggtacagtgtgggaggggactacacaaaggtatgaatacttggaggcaaggatcacagtgagtgtattagtctgggttctccagagagaaagaatcaataggatatatagatatagagaaccagggaagccagtagtgtgagtcagtttaagttcaaaggcccaagaacttgaggggctgctggtgcaagtcctgaagtctgaaggctgaagaacctggagttctgatgtctaacatcaggagaagggtgtcccagctcagaagagagagagagaaaattcgcctttcctctgcccttttgcactatctgggccctcagctgagtggatgctaccatccaccctgggtgagggcagatcttccttatcagtctactgatttaaatgccagtctcttccaaacacacttacaggcataactataaagctttctcagctatctgggtattccttaatctagtcaagttgacacctgaaactttttttttagagacagggtctcactctcttacccaggcttccatgcagtggtgtgatcatagttcattgcagcctcaaactcccaggttcaagtgatccttccacctcagcctcccaagcagctaggactataggcatgtgctactgcacttggctaattttaaaattttttatagagagggggtcttgctatgttgctgaggctggtcttgaactcctgggctcaagtgagccccctgcctcagtctcccaaagtgctgggattacaggcttgaaccaccacacccagctgacacctaaaattaaccatcatagtgggccaccttagaggctgactaccacagggactacagaggactttaggacattgtccttgtgatgtactccatcatgctcctatgacagctctttaaggaaacttacagtaaagatctctatgtatggggaactggggagacgatcccattactcaaactaggagccttagagacttctgcaacccttcatgctacataggatcaaagtcttgggtactacctcttaccttcttgctactcaattcagctatgactgccagttctactctgttgcaaccatagaatgttggctccagaatgctctatgggtcagtttccttcaacacttcaaaaaagaagtaggctacaagttcctttatttcagcttcccctcaacctctctggggttcctattattacccttccctacctttcccattgatgttaatttccctggcctacctttaatcatggaaggctgtcaagaagtgtatttattaggaactgcacttgtccatatgcaagagaaccctgactactgtggtttatccaaatcagggattatttttctcatgtatcaagaagtctaaaaaggctggttgcagtggctcacacctgtaatcccagcaatctgggaggccgaagtgggtgggtcacttgaggccaggagattgagaccagcctggccaacatggcaaaaccctgtctctactaaaaatacaaaaaagttagctggccatagtggtgcatgcctgtaatcccagctactcaggaggctgagtcaagagaatcgcttgagcctgggagttagagattgcagtgagccgagattgcaccactgcactccagtctggatgacagagagagactctgtctcaaaaaaaaaaaaaaaaaaaaaaaaaaaaaaagtctagagattggtaatacttggctagtaaagtaactccaggatgctgtcaaggacctgggtgttctctgtcttcctgctctgtcaaccctgatgggtggctcttgtcctcatggtcacttccagtcatcatggctgtattccggaatagaatattctgccagagcaatagaatgctctgccattaaatgttattatcactgaaattatgtcatggaacatagacaaatgaaagatgtaacaaagtgtgtggcaaaacacatgtgaaatatgattccatttgcatctggtgaatatctgtcacttgtctaccagcacactatccttctaggggaaatagcaactgatttttctttacagaacagcaccccatgcatagttcagatgggagctgccatctgcttacctgatccctcctctccatcacagggtctggtttggaggtgagcactcaacccaaactgagcctaccgcagaactgtgctatcttgcccaagatgatttgtcaagaagagcacagatgactcatgctgagcctatcagggacctctcctgggactttgtaagctggaaccaaaggaaaaggacctgttgctttccagaagtaaagatgggaagacgtgagtctgtaggccatggcagccatatttcctgccagctggaccgcattccgagagaatgagacgaaggcagagagagggaagcagagggcagaagctggaaaacttttgagagcattttgaatcctgggtcactgaggccagaaataactctgaattttccttatgtttgttttatgagtcaataaatattcccatcttgcctaagatagtttgaatggtaaagtccaggcacttgcaattcaaacatttcccactaatgcaccatcatttctgtttcatgcatatgtacacacatatacacatatatgtacataaatacagtacagaaatacatttttcttatctgtattttaaatcttccttaaagaacacattaatttttaacaccaatttttagaattacccatttaaaattattcattgtaaaggatccagataattcacccaaaagtgaataaaattagaaacaaaatgagcagttttcatctttgctaataataacaaagtagcaaaattatctcaaacccttttaagctgaaccacttccaggatagttaaccaattcaactccttggtggaaattcacaacaaagtacttaatgtctaggtctaagtgatttaaaaggctgaggcagggattatcaccaattggtttgataatggacagttatcttaagagctccctctttacagataacaaggggtcagcatgcccacatttgcaggagggaggcctgagtagatttctggagggactccccatctatgcctgccaagatctgggaaccaacttcatttcctgtttctgcaaccccacatcctttataaaaagactgttctgtgtgctgtgaaccgtatgaggaagcctttgtgaccttcatacactaatttttgcaagacagaaattctctatttaaagatgcatgttgaaggctcacgcctgtaatcccagcactttgggaggctgagacagttggatcatttgaggtcagaagttcaagaccagcctgaccaacatggtgaaaccccatctctactaaaatacaaaaatcaggacaggtgcggtggctcacgcttgtaatcccagcactttgggagaacaaggcagggcgatcacgaggtgaggaatttgagaccagcatggccaacacaatgaaaccccgtctctactaaaaatacaaaaattagccaggcgtggtggcaggtgcctgtaatcccagctactcaggaggctgaggcaagagaatcgcttgaacctgggaggcagaggttgcagtgaaccaagatcaggtcactgcactccagcctgggcgacagagctagacttcatctcaaaacaaaacaaaattagcccggcgtggtggtgggctctcataatcccaggtactcgggaggttgaggcaggagaattgcttgaacccaggaggtggaggttgcagtgagccaggatagcgccactgcmctccagcttgggmgacagagtgagactccctctcaaaaaataaaaaatagccggamgcggtggctcacgcctgtaatcccagcactttgggaggccgaggcgggtgggtcacgaggtcaggagatcgagaccatcctggctaacatggtgaaaccccatctctactaaaaatacaagaaaaaattagccgggcatggtgacaggcgcctgtagttccagctactcgggaggctgaggcgggagaatggcgcgaacctgggaggcggagcttgcggtgagctgggatcacgccactgcactccagcctggatgacagagcaagactctgtctcaaaaaataaataaataaataaataataaaataaaacacattgctaaaccctaccttcctcctaagtaggaggaatttaaaaaataaaaataaaaaaaataaagatgcatgttgaaatcacatattccatcaccatggggaatttctcatttcctctaacaaaacacttttctttatttttatgattatataatatacattcttttttttaaagaaaattagaaata

SEQ ID NO: 10609 - DNA, 23047 bp, Homo sapiens
  misc_feature (1)...(23047): n = A,T,C or G, or insertion/deletion polymorphism (see Tables 1-2)
gagccaccgcgcccagcctatcctgataatttactcgtttcaggtttactgtcttcttccctatgaaaggaaggaccttgtaaatctgttcattgctgtaaatgaatgtgtgctaactataccaaagacaaagcacccagctcaatgagagatacataaatgaaccaaaaagagatcttgccctcagggatcttgaggtctactggaaaagataaaacacatagatagaaataacactggagaaggaagagatgacatccacctataggaaatccaggccagccttggggaaaaggtggcctttagaaagatgggcattttggcattttccatttctttcaatgttctctttgtcctgttttgttagacgaacttgacacctaactgcttaactaactcccctttccaaaacatgttggcactgaaactgattttctttttttttttagatggagtcttgctctgttgcccaggctggagtgcaatggcaggatttcagttcactgtaacctccacctcctgggttcaagcgattctcctgcctcagcctcccgagtagctgggattacaggtgcccgccactacgtctggctaatttttgtatttttagtacagacagggtttcaccatgttagtcaggctggtcttgaactcctgacctaaggtgatcagcccacctcagcctcccaaagtactgggattacaggtgtgagccactgtgcctggccaaaactgatttttaatgttcctgttgttctctgaatttgggctggattcatttggtcatttgtaggtaagtgcacctatgggtaaaaatgcatgtttatgtgtgaaacacagtaatactgattttaaacaatgaattagtttatttaactgaaataaaaatttccatgttattgcttttgtaattgagcatactttagcattggcatacaaattggcccataacctaggcaaataaaaacactaacaaaatataaagtacagtagaacattaatactgaatttggctaagctcttaatattggactacattacatatattatttccattatatgtgtaaatataaatattttctaacccagtgaaagattttgtgaatcagaattttaacaacttaagatgattttattataattatctgcgggaaaaaaacaggacacattttcttatattctgtataaaaggcgcatatttgttccatctgtccactccacctcttctccaccctctgccacctcaatagttgagaatgacttcatctacataatgatggtttgatttattcttactagaaattcaggtttccatgaaactagtgagaatataaatataaacgaaatctaacatttgcccctccattgctttggcacagagccatgaacaactccagggcactactcacatagactctgaattgcaccaccatatgaggcatccctgattgtacaaagaagtaactaagtatgggtcacttccaaaaatgggaaatttatacttccactctgaagttttctacttaaaggagtgggttttttgagatggagcctcactgcaatgcccaggctggagtgcaatggtgcaatcttggctcactgcaacctctgcttccctggttcaagcgattctcccacctcagcctcctgagtagctgggattacaggtgcctgccaccatgccgggctaatttttgtatttttaatagagacagggtttcaccatgttggccaggctggtcttgaactcctgacctcaagtgatccgcctgccttggcctccaaaagtgctgggattacaggcctaagcctccgtgcacggtcaggagtgggtttacttaactgtcattagaaacattaggcacaatattatgaaacaaaacaaactttccaccttgcttaaaaaaaaattattagaagcaaatcaatgcagtgtacacgtggcagacactgtgagttgcttacccaaaagctaatctcccctccctgtatttactaagagacccctccccgccaagttttgtccctatgttgtgcagccaagaggcagggcccccttcagagtaccagaggtgatactggataagtaataagatatttcattacccttggcaaagattcatttagtaaaggaaatttgggaaactgtggccaagaagctagaggagaagtcttgctggaggcctttcggggaaaggcttccttgatctacaaaaaggaaatgaggaaaggaaatatccttttccctcctttcagtctttagccattattgtgtgtggatgtgatacttggagcctctgcagccatcttgggactgaacttgtaaagtttccatagtgaaacatattgatatgttttggatatttgtcccctccaaatctcatgttgaaatgtgatccccagtgtcagaggtggggcctggtgggaggtgttttgatcatggggacaggacggatccctcatgaatggcttagtgccgtcttcttggcgatgagtgagttcacacctgacctggttgtttaaaagtgtgtggcacctccaccctctcttgttcccactttcaccatgtgatgtgcctgccactgctgcacctttcaccatgactgaatcctacctgaggcctcaccaggaagccaagcagataccagcgccatgcttgtacagcctgcagaactgtgagtcaactaaacctcttttctttataaattacccagcctcaggtatttctttataatgacacaaaaatggcctaacacacatagctatctctagctctatagattagatagattagatagggatagcccaaagaaaccttggagatcaccaaattcaattgcctcatttatttttattatttttgttccatgttgtttggtttattaatattccccaatggaaatcacaactattaaaccaaccattatttttggaaagtcgtgataaacatgaatacaatacgattatttaattaggtgtcattttagagatagaagcttaaaatatgacccctttatgtaataattgccaaaataatatcctaccagaattaattcaatagcatgggtagcttatttctagaatattttaaaaactgaaccaaagcttactaagatgggtgaatttaatacaatgtttttagctttgtcaaagatagtacaatttagcacaaactaaaataaaaatttactgtttgctctatgctgcatcctatgttatcaaatagcttgactcaaattacttgactcaaatagcttcatacagttctcacaacaactcaggtaaacactgtcatcaaacccattttgtggatgaggaaattgaggataggcaaggttaaatagcttgctcaagatcacagagctagcagtagaaaagctgggatttgcagtaagtagaaaagctgggatttgcagtctgatttgctcaagctctgaaccactgcagttttctgcccaagaatgaatacaacttattcatggttgaggcatgtggcaaacactgttggatgcctacttagcaactatttccccttttctgctctcagtcagaacactcattttgtttaggggtgacttgtgatcaatttaatgaactgtggccaatcctatctctttttgccagtgactggtctgatgtggcatatgaccattttctggacaataaggaagattctaaagtctgggaaatatttttctccttcataaaaatgggggacagcacttccttttcttccgttcctgctctgtgcagtgacctctgtggatgtgatgtctggagctatggcagccacattgcaattaagaggtgacaaacctggagacaaaagctcacatgcatgtgatggcagagagcaaacacaaaaaagagcttgggtccttgatgacatgattgtactgctcaactaaccctgaaactatctgcacttgaaatttatattgaagatatagtaaatgacctcatgctttaagctactgccaaatattctgttccttgaggccaaaggcattctaacagatgcaatctagacacagaaagatgttttcccagagttcctgcaaaaacagatgatgtgtaggttatggagattttatccaggaatccattagtataggtagtagtttagaaaaaaaatactccaagctttgtctcagatatggttaaatctgagccatccacatggtgtctgtgctgaatattttcccctcagatgcactgtttccttttctgaaactgactgatatgaactatatcaaaagcctcccttgccctctggcgtctggttggacttggccattgacaagcaccagcaggagactggaggagggtggtgagttagatataaatcccccaggtcctttgctgggtgtttacttaggctgactgcatccgttgactgaaggtcacagactcctgtcaggtggccctgtgtgtctggatttttcggtaactgttctttcccgattggacagatctaggagctgtagcctcagggttccagcttctcttgtggtttcccacaccctgcccacatctttgcaaaatgccatttgtttcctgccaggaccctgactgatacaatggtgtcaacgaaatcactgcagctattgaagcttggtccagtctatctgaggtgtggagttttataagggctttcacctactattaaagggagacaggagactacacaaataaatgtcatgctgcaaaagtgaaacaaagatcatagctcagagaaaacactttccacttgagggcaagaaatcagagaaagctacctggaagagccggcatttgggatgaggacggataggagttttaaaagagatgagatgaagggcattccaaagacagggaagagtgtaagtcaagccggggaagagagaaagctcaagtgaaatttctgaaaaattagagctggaagggatctacgatatcttttatttaatgttcgttctcccttcacctcctttaactgagatttggccaaggtcaaacagcaagtaagtagcatgtcaggactccaaccagatctgctggctaccaggttagttcttaataatccaccttctacctccaccccactccctcacctcaggcagtctgcttacttctcagtctctcccactagactgtaacctcctcaatagcggggcttctgttttcttcacccttgaatcccagtacctagcacaatatctaacacaaaatcgtcatcgtcatcagcagcagcagcagcagctaccaaactttaagaggcaaccacccactgtcaggcactatgcagttattttgtacatcttctgtaatcttcacttttcactgaggacgctgcggctcagagaggttgtctaatttgtcttaggtcatacagcagtgccggactctattttataatatctttcatcaaccggactccgaagccctgcctcaatgggcgttcagtaacatctgttgaatgaacgaatgaacaagcaatatccactcaatgcaaactatcggctgtaacaggccaccctaaaggccccggaacctcggccggctcaggactccgcacgttgtcttccaatctaagcacaccggcccctctctgcgccccgcacaggctcagaggctccgcccgcgtctccgcctaactcgccggccacgcccccacttcggggagctcggtccctctcggattcgagttttcctcggctccagccgccgcgcagagggcctctcccggccctgcgacctacagccccttccactcccctgcccctcctctgcgccctccctcactctccaaacttcttttttccaccctctctaaacttcagtcattctagtgcccgcctcctccactcgcaccgaccaaccagtggtccccattctcgttggcggtccgcctcctgcccgccgggggccaatccctggcgcgagagtccagggccggggctcgttcccaagcgcccagcctgtgacggcagcgcgccgggcgccgcgcggcgggagggggcggggctctggatgagggatgggcgagggccgggggaagggaaaagggaggaggaggaggttgcggctggtttgaaagcggcagtttcctggcagcttgggcaggcgttggtctccgcgctacagctccgcagcggccacgatcgatcccgcgacgggtctacgcgcgcttctgcgcgccccccacggatttttcccgttcccggctcttcccccttcacctcaccgcccccccgcctcagcctttcccgccgctcgggcgctgagcccagggaccagccggcggcagtgaccccgcccgaagccccttctggaacctcctggggacaattcccttttcctttcttcagcctaacccacggtggccctcgcggagtccggtcagcggcgggttagtnnnnnnnnnnnnnnnnnnnncctggtggaagactatgcctttctagacggatatcggactcctccccatccgggaagggcgtccaggggcgtctcgcgtctgggaaacggccgggcccccacgggctgtggtcgcggggtgggggccggtacggcgaggccccccttaccgggctgcgcgggccgcccagggcccccgggctgagacggggccggcacggcgccccggctgcccgcgcggggtctccccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggtacgccggccctgcgtatctgtctcggggtgttggggagaggggcttcagggtgggcgtcctgggagcggcggcacctccccaccgcgtattgtcccgggtaatcttagacctctagggtgtgccagactccttgacgagggggaggggtggcgttggtgagtcccattttgccgaagggaaaactgagctctggcttggcgcggttgctctgctagctgtgctagctgtcacagaattgcgactagaagctgggtttcctacatttgtagctccatctccccccgcagacaagagtttttgactagagaaggccagccttttcctgtgttrtgcaaaaaggcccttaggattgtaacattttctttggaacgatcttacgcatcttctaacagggaaaaagggactttactatagaggcacttggtgccaaggttaccacctggtgtacctggaagggcttagctgcttcagtgtttcttgcactctagcagacatctcagagctgacagcctaactctgtcagtccaggtggttcaggtgtctgagtaccgatgacggtacaatatgtgatatgtggcagactggtgtgttcttgcagggagctgttgaatagagtctgggttttgcaggaagacctaggtgcctagcggagtgaaagcttctgtaacgcttttgattttacagaattttgttgaagtggtaggttaaaggagcctctgttgccctggtatcttttatgctagtaaaaattgctgcaaagcacgttatgtttatggcatactcgtcagtttcaaagcattgatcagagacagcatacagtgagatctgatagtatgtagtagttcttatgaatttgttatagacagcattgttggttttgtttcagcatagatagaatgtggttctgtcgtcttagatgtttgtgggagagagaattgtgattgtaacattattagaaaccaaactgtttttccttaatgtgctctgctgagtatacggtgcatcaaaatataatgggctggttaattgttacctgggctaggtagcagtccatcccttgatggcaaaatgctagaaaattctggataaaaatttaatatgttatctccttctcatttctttctcagcagctcgctttggaaatattaatatatctttaatagtccttgagcttaatggggcttgatggtttgtggtgcagtttacatatgtctgtgtattgtggatatgtatacacacagactcacatgctcctaaggtcataattaagattttctttctatagcgtattccatcgtattcattttaagtgtatgggtttatgtggtgaggttttctttttattgttgttaattttttaaaactttggcagactttaaacagctttttctgtatagttttgagaatttgtaaatttttttcttaactctaacttttacagccatgtgtgaaaggcagaggaaagacttttggggctgtaattcagctagtcaggcactgtctgtaatatgcaaaaggctatatagacagcatttactagtctagctgccaaatcttagttcaaatcccatgagttagtgaatagtgagaacatctgcatcatttctttgtgttttgttttgattcgttagggcatagatgagaatataacttatttttagaaattttaaagttgatatattgacatggaagctggtgtattctaaattattgtgatcttttttagaagactgaagagatggctatttcataacattagtctaatctacctgttatacatttttctcaacctctatattatatttaacaataattcaagatttagagcattagtaatattaactgtgttgaataaacatcctatgcccccgtatgtagttgacattattagagtaatacagttttgccctcttgacagccacagacactgttctattttaaagatttagccaaaataaagggaataacgtattaatggccacagaacattttgtagtcattagtaataaagttctgaatactacacttgttttttgaagagacactttgtgtcagtaatttctcaagataccattatgtctgtgttatttgagattaatattgtttctaagcaggttgtaatttaaaatttttaatctcttttaaaaatagtattcttagcttcttaatagcctcatgttaggtattatattaaatggctttcttaaatggctttgcttaaaagcaacatttgttataaaatagcaagatttttgcaggttaaacagactttaaatactagaaattaagaatttgaagaggttatctgtagaacttttgagtttgattaaaaacaaatattattttcagaagagacaaagattctttattgtgattcattttggaaaggatgaaaatagagtaagggaatttaaaaagaaacttgccataaacattgttttattttttgcttttatctaaactttgtgacagaaattgatttttcaatttaataaggtattgtaaagtgtacttagcactctcttgtcttgactagttgctttttattaaaccatattcataacatgacatttagagactagcacagtgaaagagtaaaatttaaccatttttgtaagatgtaatactaatcggaaatgttctcatattgtcttctgacaaagtccatggcagaaggatgagctgggttgtagaacatggcttttgtagcactgattcttcctagccttcttttcacttaggtgctaagggtcgccctcccaaagccagtactatcagccaggtgacttaacatctttctggcagctactttctttagctttgattttttttccctttttttgttgttataatctttaatagagaattgaaagttactctttaaaatatggtttctaatctgaagcttttcctgaatcaattaggtagtttcttattgttttagtgtagtacttagtagtcagtactttgcccgcttatagaagaatctttggtttcacctattgcttggctcrattagttacttgtttcttaattatgaccctgttgtttatttttctgcaaagagaaaagttgtcatttgagtttgaactttgtcttttcccagtagtaaagttgaactttggacctctggtgaaattgttttgtgatatactactatgactaggtttagtttctttgattttactacagagtatatattcttaaaccatttctattctgattaatatacaagtagtgaattttgttctgaaattccccagactctaattgtgcagagttttatgcttcttcatacacctttaagctcatatttcagcagtttgctttcagtaagtttcagtaaattatgtgtattttattccagagattaagtatcggtacaataaatacatgaaatcattgtctactgccatatgcacacattacattcaactaccctaagcaagtagtgtatccagggatggaaatcataggaaacaatgttatagtttgtttaaataaaaaccaagttgaaacagttcctgggtaatgttaaaggtaggtaaaagtcttcactgctgactctttgggacatccaatttgtaagggagttttgttaaaatgggctaattcctagaaatacacttcctgttggtgaagaaacactactggatgctttaaaataggaaatatttatgttattcaaataaaaataatgctgtgcctttcttatctcttgaatctttttgttagttttttttttttttttttttttttttagtgggatatttaggatttttgatgagttttgtttaggtggttgtattatatgaggatgggaaaggtaagagaatttagagttaattgttagcctcccaggcttacaatacatttcttcgtaccttttttaaaacaagaaaatctagagacctagagattattttagaaacaatagaaaaagaagcaagccaagcccctttgctagggaaagtagcattacattttgataaaccttgaagttgaaaatttcctatttcaaattttggtagtttttttttcttttttccctaaagctcttaataactcaggggttcaggttttggattctgttcattgacaccttcaattcatatgagtaatgggcttacaccttagcaattgcaagctgatttgcttgcatgatatttgatgacttttattatatcattaacatctttgtacttaaaaaatattttctctccatcattctctaagagtactatatccaaatatctcagtatgtatatatgtatatacgtgtgtgtatatatatattatatgcatatatgtatatgtatatacacacacacatacttttgttaacttttcttgtatatcattttctagtatatcattttgggtactttattgatcctgccctcacccccagacttttataatttagtttgtaaaactttattttcctaggttgaggcattttaataattctttaatttcttgctatcttactggtacaaacaaatacttaacatttggccatttgatttttagatgattttaaattttattcagtttattgctaaaactgattttcatgtaacataactctgtgttcctgggacgtatacattatttttcctctgagatcctggcacatactttataaaaccttttgttttgagagacaaatttttgtgattttttttctgctaatttatgtaaactggcgacaaaacaaatcttctaaattcattcaagtgtctgacttatgaagtcagtgcctaatcttctcaagtgatagtttcatacagagtctttactatgtaacccctaagtgctttgtaatttttggggggacttagtgttttgggagtatgttgaaagagaatcttgtttttatggattacttcagtattatttaccaatttcaaaatctgtgaatgtcagggttgtgtktgtgtgtgtgtgtgtgtgtgtgtgtgtgtgatttgacaaaagataagtgttttggtattgaagactagaaccgtttygcctttaataaattattttttgtcttctgaaattttgagcaataattttcttgaaatactacattttggtagatagagtgaatgccctgaatttaaaactattgtctaaagtaagagtttcagaaacttagaagctggtgttatgagacatgtttgtagggaaagaggcaaatccattcattgctcttctagctaattttgctaacaaaatatcttgctaatattttgtttttgaagaacaactattattcagaatgttttccaagaaaagatgcatattttatttaatacagaaaaaataagaagtcctattactggcacgcattcattccctcagcaaatacttagtggtgcacccaccaagtgccagcatggagctagcactggcgatataaacatgagtcagaaattgtgtgtcttcaagaagctggcagtttagtgggagcttaatgactcattggtaaggaatacctgtagtaagggttttgcctttttcacttttctgccagtgtttaaaactctttaggtaggtcttagtatgaattttggtgaaaatgagactaactggctgcatagtgtgctattcgaaaaagtagtggagctgcattttagaaaggatttgggttctcaagtcatcacaaaaagagggaaatcaaatataagcaaaactgtcttttcaaaaagcccttaaattgtgcataaaatactatattgtactgtttgtaggatgagtccaaatgccacttttccacccatgttggaaccaattgcagttttttggtcgaataccagaagaagtaatttgcttgcattaaaaagatatgttttacaaaaaaacttttaattctaagaaattatcctcatctaggtatgtacagtgaatttatggaaattaaatgtgtacatgaagtgaaagaatgatttcttttctttttttctttttaatatcttggtaggatccacgccatctgcccttgttttctgacttgagtggttgaggaatgaattgtgaataattttgaacttgtttgggttttgaaagatgacagattttggttgagtggaattaggatctttccagtagtaggtaagaagcagaggaggagaaaaacacagggcaaaaacgttccatacagaaaggtttacagtgtggtccatctcaataattttgtgtgtgtttgtgtacaagggcacaaaatccacattatagaataattggaaattattttgtacaagggcacaaaatccacattatagaataattggaaaatagagggaagatcatattaattgtttaaatgtataggtagttccattatgaatagtctcctgtaagttttttttaaatgtgttatctcctcgaaataatgctctaaggtgcttaatgctatttctgccttcagcctcattccactcataatgttatactatgaatatttttatttaacccttaatgtaccattagttctgttctttatggttaatagccctatttttgttgttttggaagtctagccagttttatgggaaaacacaatttgctagcctaggaaaaagggaattgaaaaatatattttcatcttaatcccgccttcccttttgttacagccacagccgactggcttccagtgagaagggtggcatcattatatctccattcttccctgaaccctagcaatttatcctgatgcagccactcagctgcattgcagtggtttccaggagcaacccacttacctgcagcccccacccatttcagtcatcccaacatggccaggggaacatagattacattttgaggaccataatttgacttatgacatatctaaatacctgagaaaggacacgctgtccttataggtgattaggtacttgttttattaacacatactgagagatattgttttagagactctgtatgggttatgaagggttaaacttttttgccataatttgtttggagtttagggtttggttttaaaaaatatcatgcagtggtaattggaaaaaattttgtttcaaatttattaataattaagatcttttctatttggaggcttccctttttattgtcttgggtatacaatgtgaacggtaaccgatctacttaattaaaactttctggcattttagcctctttgcttttgctggtttttttgcacataatttgaaacacrtaattattattttctggcttcaggggagtttgtgagaggcaagcctgtatctcgttgttctgattgggaattacacatgactatgaaaaatgggattttactatacataatggcatttaacagaagtagttttatgaaaggaaaatatcctacaaggtaggaaaaaaacaagtatttattaatgcttcattttctgaacttaaatagaattaagctaaattggctttgctttttcctccaataaaataacttttaaaaattcactttaatggagtagttccagagatatattactctttggatatggttatctagtttgcagcaagtatcttgtgatatatagcttagatctcagcaggaaagaaaaaaatcttaatttacatwtcagtttctgtatttgtaagaattctgtagcaagtgacagaaacgctgttgagattaatgtaggctaagaagaaatttattgacttacatacattaaaatccaggcatagatcagtaacagctaacttctgttctcaagtgttggtcattagaattattatttggttctcttttcttctgggttggattttttctcagctagactgtcagtgtagcggtgaaggtagctctgaaccccgaagtcatacagggtccttaaagcttctcatctttttggagtctaataacaaatctcatgcagggactttggccctgtgcccatctcttggaccaattattgtagagagaggagaggacaatgaagtgccatgattggtcaggcgtggggacatgtctacccttgcagctgggtataaatagcataatatgattaataactgtagcagaaccccaagacgtaagggagggggagttcctgaaagggtgggatgccgaggaatcaatactacaggaaatgatctcttttaaaacatttaatctctcttacttggaggccagcagtagtacacagttgtcataaaactatcatttttagaaaaacagatattggctgtaaaccaaaactgatttgatttctaggcactgcttttactcaaatatttaaataaaaaattgcttttatttaaaagttatttctttaaaaaattgaaatactgataccttaatgtgcacaatttaaaagtatttcttgtaatttttatttaattttctttaaaaaaattaaataagattctctaaaatcaatgctgttgatttttagggagatggaatactttggaagattaacagtctttggcattgagaaaaatattattagcctagttaaacaattacgtttttaaaacaattttattctaccattttgaaaatgaaattctaaacgaattactttccaaggtgttttgcttttaaaacaatggtctttttaaacacaaattgagacaatgtcattattgtagtatttctgagggctccctaataatactttttaaccatgatttcgtggaaattatgtgaaaggaactacttcactgactcttatataaaatgggtatataagagttttgaaacattacttaagtatggtgtcatgtggtaactgtttaattaccaaaaatgttatttggcagatattgcaggataaaatctgatcccctttttaaagttttttatagcctccactgggagaacagaggtactcagagcaggggtagacagttgaaagagaggggtgggtgctccaaataacatttcatactatttttatattctattactgtatcaatgtcttcagctttggtgccataaaaataataattttagtaataactttgagtttatatatgccatgcacagtaggagttttgtagttttgccaagtgtcatctggtagttggatctttagtgaatattaaatgttggtagattattggtgaatgcacttactgtacataaaaatgaacattcatggaattgggtgtgatttgccagtaagaatcatcatagcaagtactttgtattgttagattagtttgggcacccttcggatgactttagaccatatttggaaaattactgcttctacttcaaaagcctgtaataattagagttctccaatattaattccatatattgattaattaagccatgaaatctagtaaaatgatatagtctttattacctctgttcacagaattgtatctcaatccaacttggtagctttcagcagaacactttgtcaaaatattattaattttagctaagaattctattcactaatttcagtgtttaagttagaatgcacatgctagtgaaaattttaatttcctttgaatagaattagatttgctaactagagcaatctcacaatgtaatgctgatgactgaaatgacacttcagcctcccttgggtgacaaccctaagtttagacaaccttactctaataggaatattgaggacttatcacaacatattagctgtcatttagagtaataacttccatgtcagggcattttatacctgtcttatttggtttataaggatgtatatattagcattcatgttttcttataaagaactttatatatttttattctctatgagtcagatattatcatcttcctttacacatgagaaaattgagttagagagattaacacgtgaaagttcacacagactcacaggaagaattatgaactgacacagcgttgagtctttctttactttctggatagaatattagttcattatatccaaaaaacctgtcttcctttttctagtaaaaggaaaaagcacaattctgaattgtttgcgtgggtgttaaatgcagtaaaacactgggcargtacttacaataaaggcttcactgcttggttctgtttcaaaacagagtttgtggccgtgcagtttaatctgtacagctaagctgcatgataaagtagttatttccaagaattgctaatcaagcagaaagttagtattcttgctacatttgtaagagaatattttcagcagaatatttttattgcggaaaatattctctataatatgtaaaagcccagataaatatattagatacatattttaggataaatatacttgggaaaattgcatattagaaataatattttgttcttgtgtttcctttctacttcctctgtaattcactcaccaggaaggtgttagcacatttactgagagcctagaaaatgttctggtgaatgtagaaaggaacgtactttagaattagggatcttttataagtatgcagacccttctcacaaaagtacactttgcttgaataaaatttagctaagctaggtaaaagaataactcattgcatttaagtagacctttctccttctagacttcgagtattgcacacctaagatggatcctttgaagaggcaggtaaagcaggttgtggattgttggaacctcttattctttaagtgtttacgctgttatgttttctctctgggctaaagtcagtcacttgagtggaaggaaacacagcaatccaatcttagtatatggataaacaattcgaggcttagcaatggcagaagtcatagcataagcatggtagagcagagactagaactcagattgtttagttcctttcattgttctagtttctggcataagaatttgtgtagaaaattggcgaaaaaaggacctgttaaacatattctgtttctttatgaaatctgcattctcttggaactaagtgtaatgtgctagactcagtttgttaggccatcagtgtgcatgaatgtggttagaggcagtggtatccccgaacctgcagcacaggaaagaattttaatcattatatgccatggattttcagggcattttaagcctttataatggtgtaacttatgattaagatttacacagtcaaaattgttagctggtataatagctgaatagttaagtatttattttggttagttactttagctttagctttgaaaaatcatttttcctatcggagattcttcacaatgctttcagtaaaatgtttctgaatagttcctgctatatggtagactgctaacactgtttcttgctctctctgtggggctgatgctacaagtctgatttagagtcagctgtgcttttatttttttccttgagtgactaggggatgcattgggggaagataaattttagggcaagaggacactcagggttgtgggagatgaactgtcaaggatacctttggctcactgtcctcaagcttgttcggctgcagtgatggcataactgagaagagggattgtgctcttgctgggtgcgggacaagaagatgtctcaggccacgtaaagctggccacagcagaggacaaggtattccctgtgaggcaaaactgaagaaaggggattgaggtggcagttctggggaaactatgtttgttaggtagactaatgggaatgatggagtcttgcttgggctctttgtaggtcagtggaagaacagcatgaatgtggacatgaaaaaatctttctgcaatccatttaccacatactcctttgcaatatcagtcagggttcagtgcaggaaacagaaggggatataatgcagggaattaattgcttagggaatcttttgaaagggctggagggctgggctctagactgagcctctgagaatgatttccaggacaccttgaaacagtccacagtgggagctgccacctctgcttgagtcaggaaagtggcaatcaggaggttgctactgaaacagtggcaagaaaatgctactgtagctgtgatccaggtgatcagggcagccactgctgttaacattgtaactgctggaagtctggaatgtaggatctggccattgctgtgacagcttctccttgatgctcgtgaactggtgactagatgctgttatgatgaatctggtccctgctgcctttgccattgtctctaaaataattagaaaatgattaattatgtttttaatataatttaattgtaattttatgcaactaaattcttaatagtggctgtgtttgacaactgatttgtgaaattcataaaaatttaataattggccttgcaagagagtacagccaactccattgcatcactgtaaaacctcctagctgacggttctactccttaattgaaaattctctcttttttgttttagttcaaagctggagactggatactgacatgttcatgaccttgtgtacaagctgaaagctgctgaaagctacaggccaatggggctctgctttacttctgccttccatatcttgtgtcctgcatcttaatggtggaatcagatttgcatccagaatactagctataaaggagtctggaaaagacagtttttagttttccaacttctgcgtttcaggaaggcatactacaaggaggaagtcgctgagtgatagctgatcctttcccaggcactcatcttcttaaacatagtatattaattacaatttagcccattcttgatggctcattgtcatttctgtgagcttctcttttcataatggcctgtagttggaataatcatagggccaagggattttaacatctgtagtaactttttgtcctaggttagcttgtatctctcccacctcccataactgctgctgagacatctatgtttgatatcatttgacgtcaacctcccctgcaagccacaggcagggagagcacctcacccaaagcaaccagtttattggctggtcagcaacctgtgatttctgtagcttaaaaagatgagtggggcttattgtcttttgaactaagacaaaaaggaaagaatttccaattaagggtgggagcttcagctgagaggttttgaagtgagttggctgtattcttttgcaagaccaattgttaaattttcaagaattttgtgagttgtcaaacagccatttttaagaattaagttgcataataatttaataaaaacaaagataaatactcaaaacaaattatttcctaattatttgcccacattttacaattatctatgcttttgaatttctttatatctactatatctgtatggtagaaacactatatagtggtttgctactgtgcatatcttcccagctcccttttcactgttatcacagttgactatggtggtagttgttggcatttcctgaacatatcacactgattgtgggggcggggagggagaatcaaagttggagaggtcatgagaaaccatgtacaaactaaaattatgggagaagaaactatgagtgaaacgatgagaaaaacctaatgcatgatgtagaactgagtggtgttaatagcagagcactggagggaagggccacaaaactcttcaccccaaggtctagaatcattctagaatcatcctacaagcctagttttcatgagattcagccctattttatttcttgctcttggaattatatgaaattacgaatttctgtgtgttgccagctgtaatagaataccctggaattttatttacttttaattttgtttatttatttatgcttatgtgccatcttctcatgaaaaagaggcagtatgttaaaagtttgagttcagattttctgatgtagataaataagctaaagaaggcagggtgaagtgtgatatatgagaatttccagagcagggtattcgtaacttgtaagtatttagtccaagttccctctcccaacacattttacactagaataagattgaaaggccagatgtggtggctcacgcctgaaatcactttgggaggccaaggcaagtggattgcttgagcccaggagttcaagaccagcctgggctacatggcggaaccccatctctacaaaaaaatacaataaaaggtaactgggcatggtggtgtgtgcctgtattcccagctacttgggaggctaaagtgggaggatcacttgaacccaggcaggtcgaggctgcagtgagccatgcttgtacctgcatactgcctgggcaacagagtgaaactgtctcaaaaaaaaaaaaaaaaaaaaaaaaaaaagactgaaggctgtcttgaggaatgccacttataaatacatttttaaaaattcagtaatatttttcatgtataaacattgtggagactattgtagttgcttgtacaatactggggcattggtgatatctgtctctttactattgtagctcctgcctacgcctttagtaactgctaaggtgcagactgtagatctggactgtctgtgtctgtggctcacaacctcaacttctctgctgcctttgatttgctccctctgcagttttgttttctctgtactccgattgcttctcccatgcttctctgctttccaaagaaaaaactgaccttgtatagatcctgtcagctgattgcagtgctcttaacttctccattgtgagttgttcagtctgaggagttaggtataaacccagagtggtattctcttttctgttgtgtttggttttgcttacatattcaggagctgctctttacccccagaacatccgtatatatgtttttttctgtttctagatttaaaaatattccagaagcctggcctcaagatagataatattttacttttaatttggtgcccttgttttagagatttgaactggattgcatttagtaaaccaaaccccatctttaaaaaaatcatcttaaaaaaaaatagtgggccggacatgatggctcacatctgtaaatcccagcactttgggagactgaggtgggaggactgcttgagcccaggagtttgagaccagcctgggcaacacagtgagaccttttgtctacagaaaaaaaaaaaaaaaaaaaattagccgggtgtggtggcacgtgcctgtagttccagctactcaggaggctaagataagaggatcacatgagcccaggagttggaggctgcagtaaattatgatcgtgctactgtactccagcctggatgacagagcaagaccctatctctaagaaaaaaaaaaaaggaaaaaaaaactggttcaaattggatttttctattctttcataagatgataaatgaaaaaaaaaagaaaatagatttttgaaaagcaaataatctcttggaatttcttattaaagtataaaaaattatctaattgaggcatgttaatccaatattaaagtattaaaggctgagtgtggtggcacaggcttatagtcccagctactcatgagatttgagaccaggtgaactgcctgagttcaagaccagcctgagcaacatagtgagaccctgtctctaaaaacaggtaaataaaaaaaaaaatttcctctgattacaggagataggtagaaaaaatgtgttacagtgcagatgagaatttccttagcacttttaatgtgaagtttatttagattgggtggccagggaaagcatccctgaggaggggacatgtccattgtgagttgaatgactgggaggcaggcatctgccctctgaaaattttttactcagagagaattgtaaaacacaaatatgagaacctggttcgatataggaatagaaaggctgatatggctggcaccaactaaatgaggggtgaaagtgagagggatcagattgaagaagtagacggggaccagtgggggtctgttagccacagtaaggggtttggattttatttattcttaatgccactggaaagtataaagttggagaatgattggtatgtatgtcaaaaagtcattgtttgtgatgtggaaggagggcaagagtggaagaagggaaaccctttagtttggatgaaaataaatgatggcttggacttataagaatagtggcagtgaaatgaagtggatagatttgagatatgtttttaaagaggaactaaataagacttaactgattgattgcaggtaaggaagggagaggacttcaagagaacctctaggtttttgctttgagtaactg

SEQ ID NO: 10610 - DNA, 12968 bp, Homo sapiens
aataggtcatgtcctggaggagctcacactcgaggcagccaaagattaattaccttaggcattgattagtaataataataataattagttagaaagtgttatcggatctcaaaaaagagagaaaatgtgagttttctttgtaaagaatatgacccttgagcaaactcttgaattaggaatggagagtttgaattggaaattaaggcaggataatacctttcagatgaaacaatgtaatagagtaataggatgtataatagaatgctggccccaaactgggatggtagatttaagttgtgagtttgtttctacaactacagagtccattgaataaatacaactttatatattaaaggtgtgctttttctttaaacttgtagagaatagtaattgaggccgttttaagcaaggaagtgatgtgattatcagttttaggaaaaataaataataacactgtgaaaactgagtctgttcaattggaagctctcttagaagatgaatttaatggttggttcacacaaaggtaaaaagatattaactaatatattgataacaaatggaaaatatgtgctgaagagtgaatgtattctaaaaccatgtcaaagggagaatcaacaaagcttaggttgactattgggagcaaaacatagggaagaatcaataataattcaggggctctcactgcagttactaaggatttggtattgagattctggatatttgacatacaaagacaggaactggtttcagaaaatcacaagctgaattgtaaaaccattggaaatttagacttcacaaataagctatgtgtagatagccaatattccatttgatttagtatggaactcaagaaggaagactaaattctacatatggattgaagatttatcatatagatagatgttagagccaagcaaatggaaaagtatcccagggacagtgtggagagagatgaaaaaagagcgaaagatagaacatgtgaaacctaaacaatgaggtttgtctccagtgagaaagaaaactcagaatcagggatcaaaggaataatagaaaaagaacaagagagaagtccatggataacataatttcttaaaagaggagatcatcaagcccaaattacatcaagtgagattatggggttagcttgtctactttgtgtgatgggaaggatcctggagattccactgaaagcagcttgactagagtgggagaagaaggcaaatgacagcattgggaagtgtcgatgagaggagaaaaaatatggatgttttatgtcctatctcaaagattgtaagttaatggaagaggagaactagaaggatataagaggtagggaggttcactttctatttttatttttctgataggatagacttgggcatatttttaggctatcaagaaagagataatggataccagaaggtgaaaatcagatcagatacaactggatgacacagtctcaaaaaatgggaaaggaatagagttgatagcaccattggaaaatttattttttgagtgaagcaataatagcacaagcatataagtaatatgaaagagaaaaggcacaggaatctgtgcttaattacttcttttttctctttttaagtaagaataaatatttctgaaaataaggataaagaatttagagattggcaaaaacaatgcaatcactactaccagatgtgagaagtggaagttagaagttaggtagagacaacaggttcgctcctaggcactgtttgtttgtttgtttgtttgtttgtttgtttgttgagaaggagtatccctctgtcgcctaggctggagtgcagtggcaccatctcggcgcactgcaacctctgcctcccgggttcaagcaattctcccacctcagcatcccaagtagctgggattacaggcatgtgccatcatgcctggctaatttttgtatttttagtagagacggggtttcaccatgttggccaggctgctctcgaactcctggcctcaggtgatctgcccgcctcggcctcccaaagcgctgggattacaggcatgagccaccgcgcctggccgactcctaggcatttgggcagggaaagatagactatctgatgtcaactctccagagtcttcctctttggctgctccccagaggcagccaaactctggctacctgaactgaggctaatgagttacatggagcaggacactcttggggccactaaaaataaacacatcctgaagcatctcagtccctaaagcatgcaccttgactttggtggtttataaaaatatcccagacataacattggcccctttagtcatcggcagattccttagaattcattgattccaatttctgtttacttatagattcaactgaccaccctaatttatactccctcatatgcactgaaatacacttaaaaaaagagtggacaatcttcctgggaaaatcctggggattgcctaacttataatagcagtaaatttaaaaagaaatggtactacctttaacagaatctgggtgagtagcaattttcactttccttgcctttgacgattaaccattttcaaggattattctctctgagggtggcatattttaaagcatgctttaaatatgtggatctgtatttatctactttatcctctaactctgttctgtagtttcatagccaaacccaccagttgttaatcactgaatgtaccatatttggagaaccaaatttcatgtggtttcatatttttgatattaaccttctcatcaacatgcccatcttctagtttcatagaactatagtggttcttctaaaaccatcttacttcttctagaagatagttgaatgtctgtaatctttgtcattcttctgtgaaagatgagtccaacacccattcaattgcttcctaagccagctgagatggtgtgtttcagtcttgatcccttaaaaatgctgatggtactccctatagaattgatgtctatgcatgagtttgctatttacttagagtaagttttagactagaagagaaatctgaactctagattaactgaacacccctacactaaagaagtgaatggataagtgtgcaatctgtaatggtgttttagatctgttttgtaaagagtaataaggatatgtattttttaaaatgccatcatcggagagttaccgccaagtgaggggaatcaggtttccctattactgtagacttccactattcacacacgaacagaaatgagaggaatagcaatattatcaataataatcttaatgattatcattatcacaccgtacctcatttatgaacttggaatagaataggattcatatctggatcttaggcttaccactgggtggcagggatttataataaacaatcattacaacttggcagaagatatgattacattatgctattgttacgagttgaactgcatcccccagaagatatgttcatgccataactctccagtttctgtgaatgtgatcttatttgtaaatagggcctttgcatatgttatcaagttaagataaggttacactcaatttggatgggccctaacacaacatgcctgaacacaacatccctgaaatcccagcaactggaaggtggagacaggaggatctcttgagcccaggagctctaggctgcagtgagctgaaattgtgctactgcactccagcctgcctgacattccaaggccctgtctcaaaaaaaaagaaaggaagcaggagggagggaaggatgcaaggaaggaagggagggagggagggagggagggagggaaggaaggaaggagggagggaaggagggagggaaggaaggaaggaagggggaaggaaggaaggaaggaaggaagaaaagggagggagggagggagggagagagacagaaagaaggaaagaaaaagaaagaaagaaagaaagaaagaaaaaagaaagaaagaaagaaagaaagaaagaaaaaaaaaagaaagaaagaaagaagagagaaagaaggaaggaagaaaaaaggggggagggagggaggaaggaaggaaggagaaaagaaaaagagaaagagggagggagggaaggaaggaaaggaaagaaagaaagaaagaaagaaagaaagaaagaaagaaagaaagaaagaaagaaagaaagagaaaaagaaaagatagacacataaaaggagaatgacatatgactggaggcagagattgaagtgctgcaggtgcaagccaaggagtgccaaaaattgccagaaagccatcagaagctagaaggatgcaagaaaggatcatccccttcaggtgccagagggagcatggccctgcttacaccttgatttcaaacttctagccgtcagaattgtgagacaataaatgtctactatcttaagccatctgagtactggaactctgctatggcagccctaggaaactaatacaaccatattaacatttatattaaaatagcttatgttaatttaattctacctttgtggttacaatgaactatacatgtagcttatcagaatatatgcttttcttggttcagatcactctctgtgcatcactgagaagaacaaaatcatttaaaagcatgttctagactaagctatgaggcatttaagtgatctctgagagagaatagaccactgtacaacattgtaagaggcttcaactgggtgccatggtggactggagaagctctttctttatgatcctgaaatcacaaggatagagggaagaagcaaacataagcgcgaacaacagttgatgaagccagttctgggagttaatgccaggcttgtaattctgggcatcttgaaacacagcctgataatctggaagacatagaaattaagaaccatgctgtcactgaagaatgtgctagaactgaggaatgctgatccaaaatatgacattaaagctattggaacataaacctaccaggttttagcaaaaagctaaaagctagtaacattatcttttttatatggaaggagaaatagctaggaagtagaggtcagggtgcagacttcagaaccgcaaagcttattcatggcagatttatacttagaatacaagtattctgattcatattttattgtgttttaaaatttattattcaaaattagttgcattctttggcactgcagtaataattgccactgaagcaatcattgaaagcatttgtaatagaaagaacaaggagcaccagagtgcaacagaaaaggtgcaatagagagaaggcaaatttctataaactctacattcattatctatagcctactatactttttaagtttctcccatatttttatttatccaacaattttttgtgagtccaccatatgccaggattgtttctagcttatggtgaatatgtaatatcttatgatgaagatagtaatatctttagtataagatattaccttgtttaggtactgtttactattaaacttataccatagtgtgtcagcagaatggggcgatggttaggagggagagaaatttctaataacaggtccaaattattttaagagaaaggaggattatttttgtgaaattagatctaatttgtggagaaattcaagttatctttcaagttcatgcaatcatgaaaaggcagggcccctagcagtgaagaaattgtgctagagtcagtttaaatcctgcccctggcatttattgggtgagtcagactatgaaaattactgaacctcttttcagtttcatcatttattcaacagacataatgatattgccaatcttgtaaagtcatgagaaaatgcatacaaggtactgaggccagtgcctgcaagctggaagacactcatatatagtactaatagctatttatcacccccttaattgccaacaagaaagagactgcaaaaacacctcaagctcccaatcaagctctattgacctatgctaggaaaaaagacatgaattagacacactagataaaagttaaaaagcctcttaattccaacaggtagagtacaatggaaagagctaacgacagcaccttctctggattcatcctcctgggcttctccaacaggcctcagctggaaacagctctctttgtggtcatcttgatcatctactttctgagctttctgggcaatggcaccattatacttttatccattgtagatcctcgcctccatacccctatgtatttcttcctctccaatctctcttttatggatctttgtttgaccacttgtactgtccctcagacactggtcaaytttaaggggaaggacaagaccatcacctatggtggctgcgtgacccagctattcattgccttgggactcgsggggagtggagtgtgtcttattgtctgccatggcctatgaccgctatgcagccgtctgccgcycactccactacatggtgagcatgcatccccaactttgcttgcagttggttgtaaccacttggctcacagggtttggcaattctgtgatacagacagcattgaccatgactctccccctctgtgataaaaaccaagtggatcatttcttctgtgaagttccagtgatgctgaaactgtcctgcaccaacacctccatcaacgaggctgaaatctttgctgtcagtgtcttcttcttggtggtgcctctctcactcatcttagcatcctatggtcacattactcatgcagtcctgaagataaagtcagctcaagggaggcagaaggcttttggaacctgtggttctcacctcctggtagtgatcattttctttgggacactcatctccatgtacctccagcctccctccagttattcacaggatgtgaacaaaagcattgcactcttctatactctggtgactcctctactgaatcccctaatttacactctgaggaacaaggaagtcaaaggggcaactaagaagactagtggggaggaccatagatgcatgagaaagttaacgcagggtttgcagttccaaacatttgtgcactagaagactgctgagaagctacaaactagttttaactgaattcaacaaatcttcctaaagcatctactgtgtaccaggcactgtttaggtacttgagatatatacagatatatagatatcagtgagtgaaacagagacccctgtcctcatgaagttaaccttatggggagagcataagttaagtaagataagctaaaattaaattgtggtatatgatgtattggaatgctatacaataatgacaaaaaactgtaagtacatacaacaatgtggataattctcacaaacacaatgttgagttaagccagataccgtatataacatatgattccactcatgtaaaaggcaaaaccaggcaaaacaaatctgttgttatgcaagtcagaatagtggttcccttggggagtagtgattgcaaggataaatcggagatgggggttatgggattctaatcacattctgattctttatctgaatgcgcgttatatatgatatgcaatttgtgaagtcatcaaactttacacatatattcacacataaatggatgagaattgcagacaggagaggaacacataatgtatctgcagtatctttacatatgttatacttcaatatcatctacatttaaaatttttatatgagtcagtaatcaaccgaatactatggtactaaataatcacattaagcattttttttcctttcacacaaagagtgagtttacattgcagttgatctaagttaattctttccgttgaactgaactactagatactaagatgtttttgatattagtaatatttagccagactagaatgaaccctacttaactttcattgaagatctctatcaaagatcatttctgcaaggagtttctggtctcctgtaaattccatgtagatcctagtgaccagttcttgaagcaaatatacagtgataattttcaaatgaaaattttactactaagtatttcaactgccatgaattaactatagtatgacagaaaaggaggtttagagtgtgcttgtgtgtatgtctgtgtgtatatgaatgtttgaactctaaaaaatccacaacttagtaaaaacctaaaaatattttcactagccagagatttcaagatatttaaatactggatggcatatacataaaatagcaggtattgaaagagatgtaaaacaaagtagaaaacagaatcaaattattatttggtaaattcaatgtatagtttaatcttcttgattatttcttattttgacaatggcaagtttgaaggtttgttaatgtattactctgcaagtgaaacgatgaagtggcaaaattttctttacataagtgaaaattgattagtgaatcattaagttccctaatgatcttctctccacttgtattcaataattttgagtgatttcttattattttatgagtgcagctcctaagatatgattattttaatggcagttccttggacttttaaaccataacagctagcttcattgataatcatatcatttttaagacacgaagatatcagactctatgtcctcctagacgtttgcttttcccttttcagaaaacaaacattgcttccattttactagctcaatttcttatcccattcaaggtgatcttttatgacttccacttctagggaagatgtgcttgattatagcaggccatattcccactgcaagtactcgagaaagtcaaataaagttttagcaactgtatttttaaagacatcatagagttgcaggggtgacaagggtgagatggatgagaattgcaaacaggagaggaacattctgaactgagctgatgagcaaaagcgtttgtccctatagggagaatttaccaggtatgagtgtgagctaaggattgggcttggcccagacagagggcctttgccaggagaaaaacaaacaaacaaacaaacaaaaacagcattattttcacataaggctggaatgagaaattgaagacttaacagacctcagatacgtggctggatgtttccagtggacatttccatttgcagtgcactgtatagaaagtagggagctagacagaagcttcaaaaagatagggtaaaactgcttgtagtttctttgtttttagggaacaaagacttaccagggaaaggagtcctgtctctatcacacagctttcctcattatgacatttgccaaactttgaagctgcgtagagcaagacacaaaatagcaaagctgaatattgttgcagggcagaacttaacctctcagagttgttcagggtagaggaaataagacttctcagactgtcaaaatcccaggagggagaagaagaaggagcacgaggtagactgcatctgtctacaactcagcctgaccctacttgttcctaaccaaggaatggaaggactctccctggtgcaaggtaacaccatctggagcctctgtggttcttttatacaccatgtcttgactgtgattaaaaattacaacacatgaaaagagggaaaatcataagactgataactgaggtagggaaatgccaatagatgagaagtgacagatgatttagacagtgaagttagcagcctaggactttaacatggctacagttaagacattcaagaaaaacagaggacaggatagaaaaagtgatgagaggatgaatttcataagagaactagtatctacataaacgaattgaatggatgttacagaaatgacaaatacaatttctatcaccacaatctctccaaatatggttgcataatggacttctagatgtgctctgggaacatccttctcatgattacacatacgaggcttgagggcgttgtcaacagacaagataactgacccattaaaactggtgaggtttcatactttttatctgcaataacaaatgagcaggatttcaatttttcctccaatttggaagtaagtaaatttgtgatgggatagtgaaacacagaaaattgctttctcatgacctgcagcactaaaaaagggtgaaagcatggtggtgtgcacctgtagtcccacctactcgggaggctgaggcagaagaatcgcttgaacctgggaggcagaggttgcagtgagccaagatcatgctactgcactccagcctgggcaacagaacaagactctgtctcaaaaaaaaaaaatccgatcatggtggctcacacctgtaatcccagcactttgagaggctgaggcgggcagatcacctgaggtcaggagtttgagaccagcctggccaatatggtaaaaccctgtctctactgaaaatgcaaaaattagccaggcgtggtggcatacgcctgtagtcctagctactcaggaggccgaggcaggaaaattgcttgaacctgggaggcggaagtttcagtgggcagagatcacgccagtgcactccagcctgggcaacagagcgagagcctgtctcaaaaaaaaaaaaaggtgacattaggaaaagaataaaaaattctgttggaaaccaaaaaccaatttaaaaaaaagttctgggcttcctaatacaagcttaatttgaacacgagaggagaatttatagaaaaaccagtagtgaagaccaagaatctgatccattaataaaagccagcatctgatgttgaaagtcccatggctaaggtattgcacttggttgctagagggccttgggatggaggcactgcctcagcacatgacagtataactgtgcagagtcagttattctctcactgctatggtttactggtctataaatagcatatgatgtcacttaaaaaaattagatataattcatctctttcatttctcttattcttcctttttaaggccagatttttgctactgtttaaggcaaaaatgtcttaatacaaccatttacacagctactaaatgagagtgttttagcattatcctttctacaaacacaacccctcttcatgatccaatttcaatccagagcctgaaagaatggtacttctaaactttttgacctatgtgagtctattatgacaacaaaaacagtgtaatttgtttcattagcttccatggtgcaagattccatcaacagcaattttcacgacttctgagtaagctgtgtggttttttttccaatgtaacatgcagaaataaactatggtaagacattcatgtgtgtatacttcgtatttatttcagaaaacactggaattagattattttttaaagcatgtaactttgaagtagtattgagctaaaggaaacatattttcttctactattcattttcagcaaagagttaagagattgacctatgagattacccatgaatttcatgttctctgtatatatgcaaccacatgtgtaaatgtgtatgtgtcaaagagataacttacttatagacattatttagggccaaatacaaaccaaaatgtaacattctgtggaggaatatgaagacaaatattctttggacatcataaggatgcttctttcaagatggggaacgaatccagacagagatttacgtcacgctaacaatggccaagacactcccttaaatacattaaaacaaacaaagttttcatgtctttagatatattaataaagtaactttccaaacagtatcttgcaggactgtttgacagtttccaaatacctgaaataggactttaaaaatatttggtaagtactatttgtggcctgctaacccagaatcaggagtggactcctgataatggctttgacacttaatagtaacatcccattgattgcgaatatcccaagtaacccaatcattagaaatgtccagtatgcttcattgagacaaaagtacaatagctgaatagcttcacactcaaagaggttaaaactattcccagaaatgtttccctaatacaaaagaaaaaaaaacttgcaggcttttgaagacttagcagattgtattcagttcagaatggttaaagtaaatcctctaaacaatgtaaatcaataaactttttacaaaaaaaaaaaaaaaagcaaattgtgtccactctctctggtaatctcaagaactccatcccctgatccctctgattcaagtcattcatcttctcttttctacatttatgcatatcccacctttctagtaaatcacatttccaagacatttccatacatttcccagagtctttcagatcaggttttaaaatatgctatgatactaaaaaggaggaagaaatttctcagctatgcaacacaaaagcatcagattggaagtcacctgcaaaggaaatgattaacaccaacctataatgtggtcttcccttctcgatgatgctggccaaatcagaactctggcaaatagtagctgctgaaatttgcggaataggagataaatgagggtcttatacgagttgctatatactgcttactgagctagtaatgtttttagcaggatgcatatgatctatttagcctgattattatataaataaacctagaatatacagactgcagtctgtatattataatataaacaataaaatttaagccaggcgtggtgatggtcacctgtagtcccagctactctggaggctgaggtgggaggatcctttttcagccctggagtttgaggctgcagtgagctataatcacgccactggaatatgaaatcaacatctctggagggtgaaataaattcatgaacttagattttaattacttgttttccttagagatttatgtaaagaaatttcctggagagttgcaggggaaattttggatgacacatggagaacgcatacatcttaagggctctggcattcaaagttcctccactgcaatgtctttctctccaagtcatctggagtcgtagttcttccagagcaccttcttaagtgctcctttcacatccttgttcctcagtgtatatatgagggggttgatcatgggtgtaatgatggtgtagaagagagagatgaacttgccctgatcctgagagtagttgttgccgggctggaggtaagcatagatagctgtgccgy

SEQ ID NO: 10611 - DNA, 32372 bp, Homo sapiens
  misc_feature (1)...(32372): n = A,T,C or G, or insertion/deletion polymorphism (see Tables 1-2)
aattttaggattgttttttctatttctgtgaaaatatctttggaattttgttagagattgcattgaatctgtggagtaatttaagcattatgaacattttaacaatattaatttctccaactcatgaacatgggatatcttttcattttttgtgtgtcatctatactttcttttatcaatattctatagtttttagtgtacagatccttcacctctttggttatatttactcctattttattctttttgatgctattgtaaatgggattatttttcttgatttcttttatggatagtttgtagttagtgtagagaaattcaactaatttttgtatattgatgattttatcctgcacttttattgaatttattaattctaacagttatttttgttatcaagtctttagagttttgtatacataagatgctatctgtaaacagagacaattttcctattggaaaatttcctattggatgccttttatttgttcttcttgcctaatctttctggataggatttcaagtattttgttgaatagaagcggtgagagtaggcatccttgtcttattcctgatcttagaggcaaagctttcagcttttcatcattgagtatgatgttagctatgggcttgttatacatggcctttgttatatagagatacgtggcttgtatacctaattcgttgagagcttttattatgaaaaaaatgttgaatttttctcaagtgctttttctttctttctttctttttttttcttttggagacaaagttttactctttcatccaggctggagtgaagtagcatgatctcggctcactgcaacatccaccccctggattcaagcaattcccctgcctcaatattttagcattttatcctttctcatctcattaaaaggtacttacttattgagctcctgctatatttcagtaactattctcaatgttgggtatatagaaatgaattaaagttttgtcctcaaaagttgtatacgagtcttggctgcaaggctgggaagcagaacccatgaacaaacaagatttcaccttcaaaattgtaaattccattcctaacacagccaaacccacctttcccagcaaacctaaaattatgttggattgttgactaagcacttataggaggcagtgacagagtacaagagtgctctccaaagggccatagtcttcatatttatcttcttcccaggtgacagcaagaaaaagtgactcttttttcattgtgtctcccaagtatccttattgacttggtatagcccctactgaactactgatctttcaccatctctgctgggatggactgagaagagaactcccagcaagaatttgcaagatatccataagcattgttattttttgaacagttttattctggcttcattgtggccaaattcttgtctcttagcttttcatctttattcactcccctggggaagagttggacctatctattagagcatcttttccaagattccccatgcctgtcacttgttcttaataaactaaataaactcatgattggctgaaacatcccttcaagatttcatcctggagggtcagcctgtcctgtgtggttgtgtgtcaggtactttccagtccagccatgttcccttcaaagcaagttgatactgctgagttactggttatttaattaagcctcccaaccaccagactacaatcaagaacttagtatcacaaattacgtaaggtaagtggtgttatctctattttaagcatgaaaaattcaagttttgaagaatttagatgatgtgccatagtagcacaactatggttaagtgagaagtcatggtgtatagattatattcactgatgaaggggtgaaaatccatttttcttcttccttaatgccattccttatatctcaccctttgcagtaagtcctcaaaatgttaacaataatcataaccattcatatttctgtcacagtgcgtacaacatatttttatgcatattatattgtttaatctttttgtacagtcttgtgaaaatgaagaacaattgcttatgctgttttcctaatgaggaacacaaggctcactggtacagagttggaaggaatggaggcaagcagagaaaggcccaggctttgtggagcttgatgcttgtataattatggataccttgttttagaaaaataatgcagaactactaatacaaaattagacacgtaagtgaatatttatttgaaatgaaaaagaaattgcaacaaattacaaacttaacaaaagcttacgaatatatcaaatatcatgaatcccaggaaaataacactttattattattattttaaatacctttataatacctttttaatattttatggctgattatttttgattgtctcttcttatgactatagtttttatatcatttctgtagagagaacagaaggataattcaatctttgctctagcatggttgatcaaaaatttaaagttattattggtagtttaggaaagattatttccatttccataacttatcagtaatgccacactgtcatgtcctctgcagtttctggctcaggtggtgctacatgccgggggcaagaccttggagagttctagccctttgattttgatttcatggcaccttattgcagcctcttagtcactgatccaactctatcaggtcctcaccacccccactgtgcctgtcctgggttcatgatatggccatgaagccttgaaggctggccccaaggaggttgccatgcagtgtctggttgatatttctccttgaggttaaatatgggatcanttagcctgatgagtgcaaccaagggcaggtaatcagtgagggttgtccagatgttgatgtggtaggtccttaagaccaccaccagggcacacacagcatccctggactggaacagtgctgcttgtctctatgccaaagtggggtttctgattcctctcctcatcccaggaggaaactgtgctgagctttggaaggggctcttgcaagtgttgacctaaagcttaagcttcaagagttttatggtagattagcctttattgccaaactcaaaaacgatttgcaggttagatattgggcctccagtttcttgcttctcaataccttcctaaaggtggaccaagaaaaaacatcgtagaggcctgtggggaaggaaagataattagtccatttattcttcttgattctttaaacatccttggacatcatgttgggtctctagagaattactgtcattgaactgtctgttgtcaggctatgcttaggaactccttaaagaaatagcccccaaaaacttttcctggagtctaacatgaggctgtcatagagggtgtcctctgtcatgatcacctttaattagccatcattttttagacatcagctttatgtagcttaaagcaatgctttccattagaactttctgtgttctgtatttataatgtgtaatatggtagctactaaccacatgtggttattaaacacttgaaatggaaaataaggctaaggaactgattgaatattttattttattgtaattcatatgaattaacatttaaatagcctctcgtgaccagtgcctacagtattggatagatcaaactcagattattaaaacagtgatagccaacctgtatgtaagagacctgcctcactcaggtcaactngaaccacatatggtcagtttctggtagtaaaagagtctatagatttttctgaacagtatttcctgccctggatcaggggtcactaggttatggtaggccaaagataggacactacaaaagacaaagagagggactaattctgtctggagtgaactggtgaagtttctatggagtgtttaatttaatagaaaccttgaagcatgagtgggagctcatccgcagcatggtgggctcaccggagcctgggcaagtgctcatgcgtctaaactgctccactggcctccacctgctactatttatcacgctcctttgtacagggttaataaaaggactaagctgaaagaccaccattctaatttggaacatctggagacatcagaaggcccattagaagaccctaaacttctaactttttctttcaaatactctgaaacgaaatccaccaacttatgaatactatcatttttttggtggtggaattccacaggactccattttgttcaccattcttgaagcatcagtaaaataataaagatgattcccactccctctttttttttttttgagacggagtctcactctgtcgcccaggctggagtgcaatggtgcactcttggctcactgcaacctctgcctcctgggttcaagcaattctcctgcttcagcctcctgagtagctgggattccaggtgtgcaccatcacacccaactaatttttgtatttttagtagagacagggtttcactctgttggtcaggctggtcttgaactcctgacctcgtgatccgtccaccttggcctccgaaagtgctggggttacaggtgtgagtcaccatacccggcccactccctcttttttcagagaaaaaactggaacctgaatgagtgaccttgtaagtgagttgctggcagtttctacctttgcagagaccaagttcttccatctacatggccttgtgttgtcctcccaataccccaaggcatggatgttttcttcatatttcacatgagggaggtgactgtctcagagaggtacagtgagcagaccaaagtctcagagcgtgaagggctcagcttgagtccctgcccagggtgctgtcaacccggaggctagaagagcttgttccttgacaaagcctcagatctgagtgccctgggttccccctgggccatgacttggttccttacattgctctgtgttgcagaattcatgctggactgcaccgtgcctcccccagggagtgcaaagatagcccttggaggggaatgatggaggaggaggcaatcaggtaatgagaggccattctgagcttgtgggaatgtagtgcccctggtgaggctacaggaagaaagtgagcatccctgggaatctcacatgaggaaggcgagaccaaatccctgtacttacaaaatgatctaggaaatatgcctcagttggcaggcatgatgacttctgagcccttgtgtttgattctgtagaagaaaaatattttcaaatattaactagtgaagttttacttttagagatatatatttttctttcaattacttccaccattaatattagaccatgaagctcatttctcttgccatagggaaggcagaacctcaaaaaactcaatgacaccaaagagttatatttatgcttctgcattccaatgtagagcattgaaagatgtggaatttaattgcaagggctagtctcttcaaagagaagtggttgcctaatccccaaaattcacagcaattatgttggcaagtaatgttttaaagcttacatggattgtctattttaacctcactattattgttccagtcttaaggatgaggaagttgatgcccagagagaggttaattagcttgtctaagatcacttaaggtcacttagctaagaagccaggatttgagcccaggtgtttggctttgagcccatgcttaatcactctgcacattatctcatgctgggtattctgctcatggtagggaatacagcagggaacaagactgccaggcttccctcaaagggctcattggttgagtcttccactgtgagtcttttgaaatttcatatgggccttgcaaagcaggaaaaaacaagagtacttattttactcatgagaaaaagaaagtaaaaaagagggaattgtcttactcaaggtcatagaaagacatagttgcaagatgggattagaaaccatatgtctcatcagcaccctatgtcctttctctgccctgggagcacactccatttagcaggcttgcggctagtgttaatgtctggacaattaatcaaaacttcctttgggctggatctccagagcccaagaacactggtggccaaaggatggtgtcttgtgaaaggagggcaagcaaaagtgtaggacaaattttgctttgggattttggttacacctgcaggtacagtgtccctgggataagggtggattctgggtcgggggaaggtctgtggataaaggcatttgtgggtgtgttcagagaggcagagtcagaaattcacggatatggtgatgggatgtggtgattgggaggggaggagggcttttctaatcaggacttttatggaaattatccttggtcaagagaaggggcatgttggcaacatggccaccaaggaaaaaaaaaaaaaaggagagatccagcacagttgctggtaagggactcttctgctgggctcccaccagcagctmtaggatcagacctggatatgagatatctcttacstgttgcgcttttgaaatgtttctgatgaacagactatcccacagaaggaggaacagcactgaaatcctttctcgcaatcttcctgcattgtacacaggtgagtacagttttcaggtgctgatatgcagggtggaggttccaagatatactctggaacacagaacaagtaagagaagggccncaccaacaggctggagtaatgttcagaactcagaaagcccagggaactgccaggaaacctgccaccctcatctgccttgcatggttccagggtggtggcatcaggttttgtcctcagctgctgccttcctctgagttctgagcagggaagcagggcatggatattttttgatcaagaacagagtttggtagaaccctgcacccattggtcattcaccatccttgtagttcagatgccaagcccccattgactatggttgtgtccatatcaagggtatcaatggtgtatgtggtgaacaagaaagaggtttgtatgttcgttctgcactgattcattgtgtggtcttgagcaagttgtagagcttctcattaacaacatagtttaccctggggttaacctaacatggrttatttgtgtacaggaagaatgagtgaaaggtaagttttggtaaaggatgaagaccatgcattaaactgaaggtactggatcagagagctgggacccaattcacaagtaagttctgggagtgacttctttcatggtaagaagggtggggatttcagaatggcgttcaaagattcagcttttttcttccttggtgtctctcgatcaggaggccagagcaccaggatgccccactttctactgttagagaagaataagcatcattatgttgacttcctatttcctcccctacccccaagtatttcagttcaaagctaagacctacctgccctgggagagtcttccctangtccacaacccacaatctcctttctattcctggactctaaagatgggccccattaatccctttccccaagcccttccaggtcctaatttttgtaccttgtgattctccctttctttgggggcaaaagtcaaaagtggggcattctattgcaaatagaggaattgtgggtctattcctctgcaaatatttgcaattagaaggaaatctataggatattatgatgatttgaaaggaatgaatgaagaaagaggtcatgactataactgtagtagcaaatggcaccagaattggggtaaaagaagctgaggttcaagctgttgacaatttaacagagaccaataactagtactcacccctggcctctcagctattctatagctcactggggcactgcaagaaattggaactaatccacactttgaagagcttggggctcaacagagcagtttagagatagacaccatgatccagagatctcagagaggtcacccttttcaagtcttgacccctcttctgggtatctggtcccaacttcactcacagcatttaccagtcttttagaaagcctctttgtgcctttcctcaaattctgnttctccaattaactctaccctgggcactcctattttcttgtagcttgcttagtccctcttagtcctacaaacctgcatgccttttctgaaacttcttaagcaggacctagcctccccagacacatgagctaccacacttatccctcttctgagccgccagtattctgaagatgttttccccatagaagagtggatgtatgatgaataacagttcttttcccacttggtattggttaaggtcaacattactagagccagagctcttttgagttgagctgggcagtggtggctgctgagatggactctacactgtcccattgatgctaattaccggtaattgtacagtacctctggagtttgaaaatgtggaataaaaggcaagacttcctttccctccttcccaaaacatcctccaaggccaaggttatgtagattctagcttgagttctaccaacttcgttgtctctctgttttattgcttgaaaagtgagtccaagcatccatgaaggagccacgggcagcaagactaagctggatgatgaggctgatcacatttacagcatttaatattactgagcatttaccatggtttagtaagagtgagctatgtctgcatgcattatctgttctcctcctgtattcattataaggataaaaacctaaggcccagatactatgcccaaggtcactcagcaacagagcagggattcaaacctagatcttgccaacaataaagcttgggcccttgaacatgacacggtatttttccaagaggtgtgacagactgtcagccctcagatcctctcctatccacacatgttacttccctccttgggcccagatccagcacctactcagaacacgctgcttgggactcccaggcaccagctgcagtgctaggcagaacaccaccaggaactggagaggcagcacaggcttcatggtgtcagtgggatgggtgagtaagttctggccaagggttgctgggtttgaccaggcactgctgtgaggagaagagaaggaaagagggcaaagtggaggcccagtgtgactagcctttcaccgtgtactccaatcaaaaccggcagggcaggaatccaagcacctcccaatyacacccactccagggtcacgtagtgttttcatatcctcctttattcccctaatcttgaccttgctatctctttcatctgtatctagatcttattcatgtcccttaacatttttttataattttcccctgtggaaattgtacatgttatatttattcacagaggattgaattttttttttttttttttgagatgatggagtctggctctgtcacccaggctggagtgcagtggtgcgatctctgctcactgcagcctcttcctcccaggttcaagcaattcttgtgtctcagactcctgagttgctgggattacaggcgtgtaccaccatgtccagctaatttttgtatttttagtagagatggggtttcactgtgttatccaggctagtcttgaactcctgacctcaggtgatctgccctcctcagcctctcaaagtgctaggattacaggtgtgagccaccgcgcctggtctgaggcttgaagtttttaaaaggaaattgtaaatgttatcataacttttcaactaattccttttgtttactgctaatgtagagaagttaactttccagtttgctcaaaaatctccaccatgacaattatttgacctcactgaaaccaataaacattgactcttcacttccctatttcgtagtcctcccctataggcgtttacttttctttctatcaatgtaggactcagaacctgtcatttaaatctccttgcttgaatctacctacaaaaactgcaaccctgaatgaatccaaccatcaatttcattgaagcttgaacctaggcagataattgttgctgggggaaaataactcaactgggctactaaacagcacaatagatgcaccatcaccaaaccaaaaagggtctggcaatcttactaagtttcttcagtaagccagtgttcccactttctacaaatactatttcaaacttgctttcctctctttaaagcttggatcttttcttctttccacaaatttgtaactagttagcttgctaaattctcccattgtttattatggtttctttgtgtgttctcttcagtgtttatcataggcaaataagcagttatagttttcttcttcaaactttatgccatttttaatgcctcactgtgctcgctaggcccttgagtacatcatatgtaagtggtgatagtgtgtatttttgtctgatacctgatttaaaatgaaaacttcttgtttccccttttagaattgtctccactttaggtttctcataagtaccctctatcaggtttagaaatttttctttcattcctaacaagaaattttaaattagtttatgtcagattatatgtattgcttttttctatgtatattgagatgataacatttttatatcctttaatctgttaatgcagtgaacattcagattttcaaacattaagccatttctatggtaatataaggtgatcattgaatattatcatttttatattgtttggtttagtttgctatttttaaggtattttacatctatgttcataatgaactgggcctgtaacttgtctttctcatattgtccttgcttggtttcatagcaagtttatgctgacttcataggatgtgctgagtagcagcccttctttatcaattctctataaattcttgatttaagataattagttacttgaactctcaactctgtttttcttgcacgaatatacccatttgcaccttgttgttttcatttaacaatatatcctgaaaactgctctccagtagttcataacaatttttcctctattacagctgcatttgacatacaccttagtcatatagccagtctcctatatttgggcatttaggtagtttccaagattttgctattataaataatgctgcaatgaacaattatgcataattttctgtattgttggaggtataatatcagtaaatttctaaaagtgtgatcattggttaaaaggataaatgcacggctgggtgcggtggctcacgcctgtaatcccagcactttgggaggctgaggagggcagatcatgatgtcaggagttcgagaccagcctggtcaacatggtgaaaccccatctctactaaaaatacaaaaattagatgggcgtggtggcacatgcctgtagtcccagctactcaggaggctgaggcagaagaatcgcttgaacccgggaggcagaggttgcagtgagccaagatcaagccactgcactccagcctgggtgacagagctagactttgtctcaaaagagaaaaaagaggataaatgcacatatagtttggctagatattgccgatttctacttcataaagattatacctttttgtaatgccaccaacaatgtgactgtgcacgtttcctacagtctcactaacagaacgtgttgtcatgcttttgaattttttccaaaacaattgggtaggaaatgttatttctgtagtttttgaggttcatttactatgtagcatgcaccagtacttcattccattttatgggtgaataatactccattgtatatatatatatcacaattgtttatccattcatctgttgatggacatttcagctgtttccttgctttggcaattgcaaataatgcagctatgaacatttgtagatgaatatttttttgagtatatatttttaactcatttgggtaaatatttgggagtagaactgctgggtcatatgtttaactttgtatgtttacttttttgaggaaactccaaactcttcccacagcggctgaacaatttaatacttctatcagctatgcacgagggttccaatttctccacatgcttgtcagcacttattattttcctttttagaaattatagccagtcaaaaaatgtgaagtggtatctcatggtttttatttgtatttccctaataactaatgatgttgagcatttctttcttcttcttcttccccctccccctccccctccttctcctccttctccttttttttttttttagatggattctcactctgtcgcccaggctggagtgcagtggtgtgatctcagctcactgcaacctccacctcccgggttcaagcgattctcctgcctcagcctcctgagtagctgggattacaggcgcctgccacccacacctgacaaatttttgtatttttagtagagacagggtttcaccatgttggcgaggctggtcttggactcctgacctcaggtgatccacctgctttggcctcccgaagtgctgggattacaggcatgagccaccgtgcccagccgatattgagcatattttcatgtgcttgttggtcatttttatattttctttgaagaaatgtatattcaagtcctttgcccattttgtaattggggttttttttttttttcttcttgagtcataagagttctttaatatattctggatactcaccagatagatgattttttcaaatattttctcccattccataggctgtcttttcacttttttgatagtcatttgaggcacaaaaatttttaactttgatgaagtccgatttttttttcttttgttactgtgcttttggtgtcttttctaagaatccattgcccaatccatagtcatgaagatttacttctacatttcttctaagaattctgtagcttttatatttaaatcattggcttatttttgaatcaggaagtatgaattctactttttgaagactgctttggctatccaaagccttggcttcggttcagccttgctggggaaaacatgcaactggctgggtcacacagccaacaaggcactctctgtttttcactcagaacgcacaaaatgggggaaatgggagaccctacaaagtacaacaatgaaaaggcagttttgtatgaactcgaggatcaagttttctgtttctcaaataaagaaaaatccggccaggtgtggtggctcacacctataatcccagcactttgggaggccgaggcgggtggatcacctgaggccaggagttcgagaccagcctggccaacatagtgaaaccccatctctactaaaaatataaaaattagccaggagtggtggcacactctggtagtcccagctactcgggaggctgaagcaggagaattgcttgaacctgggaggcggaggttgcagtgagctgagctcgcgccactgcactccagcctgggtgacggaacgagactccatctcaaaaaaaaaaaaaaaaaaagaaaaagaaatacctgttggaacttgattggaattgcattgtaatgccgtcttaataattttaagtcttccaatatagaatatrggatgtcagctaggtgtggtggctcacgcctataatctcagcactttgagaggccaaggcaggtggtttgcttgagctcaggagttcgagatcagcctgggcaacatggcaaaaccctgtctctacagaaaatacaaaaattagctgggcgtagtggcatgcgcctatagtcccagcacctgggagatggaggttacagtgagccaagatcatgccactgcactccagcctgggtgacagagccagacgctgtctcaaaaaaaaaaaaaaaaaaaaaaatgatgggatgtctttctatttcttgaggtcttctataatttctttcagcaatgttctgtattttgtggtatacaagtcttttacctccatggttaaatttatttctaggtattttatcctttcatagcctgttgtaaatcaaattgtttccttaatttcctttttggattgctcattgctggtgtttacaaaaacagctgagatagttttactttcttcccaatttggatgacttttatttctttttattacttgattgctttggttagaactccattacaatgttgactagcagtggtgaaagatgcatycttgtcttatttctgatcttgggagaaagattttgatcttttgcaattgagtataatgatcattgtatatagttttttataggtrcctttaatcatgttaaggaagtcctttatttcctagttttctgaattttttttaattatagaagggtggtgaattttgtgaaatgctttttctgtatcagttaagattggaaaactttgagaaggattggtgttaataaaaaaatgtttggtatagattttatcagtgaagtcatctagccctaggcattctttttgttgaagagagtcatgtgtatttttcaaaaattactgattctatctctttatttgttataggtctgttaatattttctattccttctcaagtcagttttggtgatttgtgagtttctaggaatttgtccatttcatccaaggttatctaatttgttggtgtaaaattgttcatagtattctcttataatttttttagttctgtaaggttggtggtgatgtcccactctaatttctgatattagttatttgtgtcttttctcttttcttcttagtcaatctagctaaagattttcaattttattgatcttttaaaaaaaccaagctttggtcttgttgattctttttattggttttctatttcctattccatttttctgtgctcacatgtttattatttccttccttctgctagctttgggtgtatttgttcttctctttctagtttcgtatgatgtaaagttaggttgcagatttgagatctttttttttttttttttttttgagacggagtcttgctctgtcgcctaggctggagtgcagtggcgcgatcttggctcactgcaacctctgcctcctgggttcaagcgattctcctgcctcagactcctgagtagctgggactacaaggctcataccaccatgcccagttaatttttgtatttttagtagaggtggggtttcactgtgttagccaggatggtctcgatctcctgacctcgtgatctgcctgcctcggcctcccaaagtgctgggattacaggcgtgagccactgcgcctggccgtgctcttttttaatgtaagtatttacagttatagattttctaccctgagaactacttttactgcatctcataagtttttggatgttgtgttttgtgttttcattttcattcatccgaaagttttttttctaagtagttgggactacaggtgcataccaccatgcccagttagttagttttttgtagagacagggtctttttatgttgccaggctggtcttgaattcctgggctcaagtgatccacccacctcagcctcccaaagtgctgggattacaggcatgagtcaacatgcctggctcaaattattttctaatttccgttgtgatttattctttgactcattggttgttttagagtgtattaatttcacatttttgagaattttccagttttccttctcttattgatttctagctttgttccattgtggctggagaagatagtttgtataatttcaatcttttaaaatgtatttaggcttgttttgtggcctaacatgtagtttatcctggagtatgttccatatgtgcttgagaagaatatgcattctcttcttgtcttaggtctgtcttaggtttatagtgttgtttagtaccctatttccttattgatttttctgtctacatgttctattcattattgaaagagggcctggaatgctttccaacaccaacaaccaattctcctatctctggacaccaactgggtgttccaaaatttaatttaattctgacactaactacttgaagttagtgcagaccccacagcttataggcttgatttcacaagactactcccaacttcaggtgccagttgcaagtcttgggcctcctgcacttttgatctactggctataaatcaggggctcccacaatcccatctgaaagtttgataatttgctgaaacagctcacagaactcaggaaacactttacttaaggtttatcagtttattataaaggatacaaatgaatagccagatgaagtaaatagggtgagcttcagaagggtcccaagcacaggaatttctgtccttgtgagttgtgtgtgccaccctcctggcacatggatgtgttcaccaattcagaagctcatcaaatcttattgtttaagagtttttatagagcttcaactccttccttctttaacttcctggaggagagtgggtgggtctaaaatttccagacctctaatcacttgayctttctggtgaccagctccatcctgaggctacctaggggccccactccaagtaacctcattagcagaaactsaggtggaatcgaaaggggcttcttatgaatatcaaaagacacacccatcactcaggaaattccaagagttttaggaaccttgtgccaggaactggggacaaagaccaaatatatttcttatgatgccatggtgggatattgaactctccaactattttgtagtgcttcgtctcccttcaatcctgtggtgtttgcttcatatattttgaagctctattgcttggtgtgtatatgtttataatttttatatctttttgatgaattgacccttttatcgatatataatcatgttttttgtttcttttaacaatatttgacacaatgtgtattttgtttgactttaatataataatcacagctctttttgctactatttgccatatgcagaaaattgaaactgggcctcttccttatgccttatacaaaaattaactcaagatggattaaaggcttaactgtaaaactccagactataaaaactctagaagaaaatctgggcaataccattcaggacataggcattggcaaagatttcatgacaaaatcaccaaaagcaattgcaacaaaagcaaaaattgacaaatggcatctaattaaactaaagagcttctgtacagcaaaatagactatcatcagagtgaacagacaacctacaaaatgggagaaaatgtttgcaatctatccacctgacaaaygtctagtatccagagtctacaaggaacttaaatttataagaaaaaacaaacaggaggaggagccaagatggctgaataggaacagctccgktctacagctcctagcgtgagcgatgaagaggacgggtgatttctgcatttccatctgaggtaccgggttcatctcactagggagtgccagacagtgggcgcaggtcagtgggtgcagcgcaccgtgcgcaagccgaagcagtgcgaggcattgcctcactcgggaagcgcaaggggtcagggagttccttttcctagtcaaagaaaggggtgacagacggcacctggaaaattgggtcactcctaccccaatactgtgcttttccgacaggcttaaaaaacggcgcaccaggagattatatcccacacctggctcggagggtcctatgcccaccgagtctcgctgattgctagcacagcagtcggagatcaaacagcaaggcggcagcaaggctgggggaggggcgcccaccattgcacaggcttgcttaggtaaacaaagcagccgggaagctccaactgggtggagcccaccacagctcaaggaggcctgcctgcctctgtaggctccacctctgggggcagggcacagacaaacaaagacagcagtaacttctgcagacttacatgtccctgtctgacagctttgaagagagcagtggttctcccagcatgcagctggagatctgagaatgggcagactgcctcctcaagtgggtccctgacccctgactcctgagcagcctaactgggaggcaccccccagtaggggcagactgacacctcacacagctgggtactcctctgagacaaaacttccagaggaacgatcagacagtagcattcgcggttcacgaaaaaccactgttctgcagacaccgctgctgatacccaggcaaacagggtctggagtggacctctagcaaactccaacagacctgcagctaagggtcctgtctgttagaaggaaaactaacaaacagaaaggacatccacaccaaaaacccatctctacattaccatcatcaagaccaaaagtagataagaccacaaagatggggaaaaaacagagcagaaaaactggaaactctgaaaagcacagcacctctcctcctccaaaggaacacagttcctcaccagcaatggaacaaagctggacggagaatgactttgacaagttgagagaagaaggcttcagacgatcaaactacgagctacaggaggaaattcaaaccaaaggcaaagaagttaaaaactttgaaaaaaatttagacgaatgtataactagaataaccaatacagagaagtgcttaaaggagctgatggagctgaaagccaaggctcgagaactacatgaagaatgcagaagcctcaggagccaatgtgatcaactggaagaaagggtatcagtgatggaagacgaatgaaatgaagcgagaagggaagtttagagaaaaaggaataaaaacaaatgaacaaagcctccaagaaatatgggactatgtgaaaagaccaaatctacgtctgattggtgtacctgaaagtgacagagagaatggaaccaagttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagtggatctctcggcagaaactctacaagccagaagagagtggggaccaatattcaacatccttaaaggaaagagtttcaacccagaatttcatatccagccaaactaagcttcataagtgaaggagaaataaaatactttatagacaagcaaatactgagagattttgtcaccaccaggcctgccctaaaagagctcctgaaggaagcactaaacatggaaaggaacaaccgttaccagccactgcaaaatcatgtcaaaatgtaaagaccatggagactaagaagaaactgcatcaactaacaagcaaaataaccagctaacatcataatgacaggttcaaattcacacataacaatactaactttaaatgtaatggactaaatgctccaattaaaagacacagactggcaaattggataaagagtcaagacccatcagtgtgttgtattcaggacacccatctcacatgcagagacacacataggctcaaaataaaagggtggaggaagatctaccaagcaaatggaaaataaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcgcccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacattttttttcagcaccacaacacacctattccaaaattgaccacatagttggaggtaaagctctccttagcaaatgtaaaagaacagaaattataacaaactatctctcagatcacagtgcaatcaaactagaactcagcattaagaaactcactcaaaaccgctcaactacatggaaactgaacaacctgctcctgaatgactactgggtacataacgaaatgaaggcagaaataaagatgttctttgaaaccaatcagaacaaagacacaacatactagaacctctgggacacattcaaagcagtgtgtagagggaaatttatgacactaaatgcccacaagagaaagcaggaaagatccaaaattgacaccctaacatcacaattaaaagaactagaaaagcaagarcaaacacattcaaaagctagcagaaagcaagaaataactaaaatcggagcagaactgaaggaaatagagacacaaaaaacccttcaaaaatttaatgaatctaggagctggttttttgaaaggatcaacaaaattgatagaccactagcaagactaataaaaaaagagagaagaatcaaatagatgcaataaaaaatgataaaggggtatcaccaccgatcccacagaaatacaaactaccatcagataatactacaaacacctctacgaaaataaactagaaaatctagaagaaatggataaattcctcgacacrtacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaaccaatagaaaaagagggaatcctccctaactcattttatgagaccagcatcatcctgataccaaagccgggcagagacacaaccaaaaaagagaattttagaccaatatccttgatgaacattgatgcaaaaatcctcaataaaatactrgcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaccacctgattatctcaatagatgcagaaaaggcctttgacaaaattcaacaaccttcatgctaaaaactctcaataaattaggtattgatgggacgtatctcaaaataataagagctatctatgacaaacccacagccaayatcatactgaatgggcaaaaactggaagcattccctttgaaaactggcacaagacagggatgccctctctcaccactcctattcaacatagtgttggaagttctggcctgggcaattaggcaggagaaggaaataaagtgtattcaattaggaaaagaggaagtcaaattgtccctgtttgcagatgacatgattgcatatctagaaaaccccattgtctcagcccaaaatctccttaagttgataagcaacttcagcaaagtctcaggatacaaaatcaatgttcaaaaatcacaagcattcttatacaccaataacagacaaacagagagccaaatcatgagtgaactcccattcacatttgcttcaaagagaataaaatacctaggaatccaacttaaaagggacatgaaggacctcttcaaggagaactacaaaccactgctcaatgaaataaaagaggatacaaacaaatggaagaacattccatgctcatggctaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcagactatactccaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttatacctaaaaccataaaaaccctagaagaaaacctaggcattaccattcaggacataggcatgggcaaggacttcatgtctaaaacaccaaaagcaatggaaacaaaagccaaaattgacaaatgggatctaattaaaccaaagagcttctgcatagcaaaagaaactaccatcagagaacaggcaacccataaaatgggagaaaattttcgcaacctactcatctgacaaagggctaatatccagaatctacaatgaactctaacaaatttacaaggaaaaaacaaacaaccccatcaaaaagtgggygaaggacatgaacagacacttctcaaaagaagacatttatgcagccaaaaaacacatgaaaaaatgctcaccatcactggccatcagagaaatgcaaatcaaaaccacaatgggataycatctcacaccagttagaatggcaatmattaaaaagtcaagaaacaacaggtgctggagaggatgtggagaaataggaacacttttacactgttggtgggagtggcgattcctcagggatctagaactagaaataccatttgacccagccatcccattactgggtatatacccaaaggactataaataatgctgctataaagacacatgcacatgtatgtttattgcggcagtattcacaatagcaaagacttggaaccaacccaaatgtccaacaatgatagactggattaagaaaatgtggcacatatacaccatggaatactatgcagccataaaaaatgatgagttcatgtcctttgcagggacatggatgaagttggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagggatagcattgggagatatacctaatgctagatgatgagttagtgggtgcagcgcaccagcatgtcacatgtatacatatgtaactaacctgcacattgtgcacatgtaccctaaaacttaaagtataataataataataataataataataataaaagaaaagacaagcaatcccattaaaaagtgggcaaaggacatgaacagacacttctcaagagaagacatatatgcagccgataaacatgaaaaaaagctgaacatcagagtaatgcaaatcaaaaccacgatgagataccatcttacgccagttacaatggaggttattaaaaagtcaagaaactacagatgctgttgaggttgtggagaaataggaacgctttcatgctgttggtaggaatgtaaattagttcaaccattgtggaagacaatgtgatgattcctcaaagatttagaaccagaaataccatttgacccagcaaccccattactgggtatatacccaaaggaatggaatcattctgttataaagacacatgcatgcatatgttcattgcagcactattcacaatagaaaagacatgaaattaacccaaaagcccatcaatgatagattggataaagaaaatatggtacatatacaccatggaatactatgtggcataaaaaggaatgagatcatgttctttgcaaggacatggatggaactacaagccgttatcctcagcaaactaatggaggaacagaaaaccaaacaccccatgttcaaacaccccatgttctcccttataagtgggagctgaacaatgagaatacatggacacagggaggtaaacaacacaccttggggcctgtcataggagggagagcatcaggataaatggctaatgcatgctgggcttgatacctaggtgatgggttgataggtgcagcaagcccccacagcacatgcaacaaacctgcacatcctgcacatgtaccccagaacttaatattaaaaatatagctcaatcatatagagttttgtgtaatgaattgataagaataatttataattaggccgagtgtggtggctcacgcctgtaatcccaggactttgggaggttgagacaggtggatcaattgaagtcaggagttcaagaccagcctggccaacatggcggaaccccatctctactaaaaatacaacaattatctgggtgtgatggcacatgcttgtaatcccagctactcaggaggctgaggtgcgaattgcttgaacctggaaggtggaggttgcagtgagccaagatcacgccattgcactccagcctggtgtggagtgagactctgtctaaaaaaaaaaaaagaagaatttataatgaacacatccattatatgcaaatagccacttcctaaaggggctcatgatatgatttctgctttcacaactgtggaaattggagtgtctatctgtagctacgttcaccgcccccccaaaaaaaattatgtcttttctttttgagaaataatgacattgtaaatatttgcatgactaaataaaggtggcagacggtaggtaacaaaagataggtgattcaaaaatgagaaaataaaagattgtttacattaaatatacagaggaactaaaagataatgtaataaaatatgggttaattctaagcaccttttaaaaaattatatttcttcttttcttttttccataaagcattttataaytagaaagcagaaataaagagtaccttytggaaaagaaaaactctgttagcaagaacacaggactggttatgtgatgtgagaggaggcatcattcctgcagaagycctatcctacatggagaaggacagggccaggagaaggcaagggcaggaagcaaggactcttgctctgccctgacttgtccagtggaggcagcgaggagctgaagatcattccttctttatttccttccctctccacaggcagctctgcagggaagtctgtgactgcctggccagacttagggctcacgctctggtcagagttatggcaccccagactctgctgcntgtcctggttctctgtgtgctgctgctgcaggcccagggaggataccgtgacaagatgaggatgcagagtaggtgatgggctgctggatgggtgatggagagttgggtagggggaatggaggagctgtgtccagtctgagtaggacctaggacttrcaacctttctgcatatccagctctgaccacaatgctgtgcagactctgggctgtcccaaaccatggccctccaacccctttacctggccctgggaatagtagtgggaatgaagggggaacctacatcttttgttgtttgctcccagtacttagagacaaatggtacatcccatagtgaaaggtgaaccagggctgagaatccaatgggaaagcaagacaattattctttgatttatgcacatttgtgaggagtgaacatctagaagtggttatgagggtaggtgtaggtgtagaaatgggtataagtgtagggtaaaaaggacataagcaatgaaaagttggagtatacagggcaaagttaagtataacatcaaaggagccaggagagtggtggtgggaagcgatactagggacagtgayggagaggagaggagaaggagggatgagaggcaagttcatcttcttttctgggctctgcaaattctggagactaggggagggtttggaaatgtctcaggcttctttgagctctcagggtcagaccatagattctatgggggtgacttcaccatgattaatggggagacagagttctgaatgcaggtgtatggcgagagtccaggaagcccaggcattgaagtctactggggtgagatgcagggcagggagacaggatttaagatactgccaatcactaggattggtgatgggctggaaggaagttccctgaagagtccaggagagtcgtggtggcaggggtgccttggttctggggccatggaggagcttcaagcttgagaaggctgctstataggtgcrtggtttcattgaccctgctcctgcatcatttcaggaatcaaggtctgtgagaagcgacccagcatagatctatgcatccaccactgttcatatttccaaaagtgtgaaacaaataagatatgctgttcagccttctgtgggaacatttgtatgagcatcctatgagtgggagagtgggctgggatgtgcatcctgctccctgaacccttccatccgagactgtgcccacatcygaagcacaaggacatcaaatcatcagcacaagaacatcaacaggaatgccaccctccccagtgtctgaactccctgtccctgtcaaataaaccagaacaaatgcccatggatcctgcctcttttgctgccactacaggtgatcattgagagcccactgtagcccccaaagatgccccactcatcttgtgtcctggtgtttgatttctctccctggctatgcttctctaccctccttctccttctttggcccatgtatccctcccagccctcaggatgcccagccccttgctgttttgctcactgaaccagtactcccagggggaggaactgctcatgtgcagcgtctcctgatgctaaggagaacatttctcaccctggartcagaaggacccattaagcacgagatgggtggcagttagaacccaaggtaaagagtgggaggcccccaagcactgctttggtctccttagccttggtactcccccacctcatgctccccaatctctttctgagcttcagattgctgtctctttacaatgaggataatgagtcccaggaaggccagcgacatgcctaaggccacaagagagagagaggatatgatgtggccggaagaggatgtttcctctgagctcactttttctcacttctctccattacttgagaccagaggcatcctagtgagagtgagtgcctgcaccaaccccaaagctcctcctatccagcacccaccaacatggctactcctctgatgggacccaatttgggtctcaggatctaacactccagcaccttccattaactgaatagtccctatctttcccaagccctcttccttagaggcttattctcttttcttttgatcaagaggaacaccaaggggtggggaacaggtggttcatgctgctattgctaaggagtaattggcacagagtggcagtgggtcttgcctgtcatcctactgtgagttagtggaaattaaccactgtggtacagactctcccttactctatgcaatcgcaactcctctgaaatgatcctggggccagatccagggttgcatcacatgtggctaattggaacacggagtcaaatgtgaagaggtttcaggaggacaggccatgcccagaggcaggtgtgcagtgttatgctccagtctagtgcttcttgctgggctattcaatgaaagagacatcagagaagaaaacttcccccatcagaccagaggccatgagccacctctgaggcatcacaccaggctctggatatctcagatttgtcttcacctttctcaagagcttttcttggacaagggagtcttagaaaagagatcataatcaactaccaacacagacatcatcagcagtaggtaggctataagggcatggtctctaagagatcttatttggtgcttcctcagatagcctcccttagcaagcgtcatctcaggccatctccaaacactgctaggagacactattaagagaggcaaatttacctttcagggaccatatagagaataacctcccccattcaagttcagtgcactgtaccatgtggacatgccatgggtgtcaggttgacctattccatgtcactggcatgagcatcatagactatgaattttactggaagcagttgctctgctttcttctaatcactggtgccctgacctgtgttccagagagctctctggacagctcacagtgccccagggaactcaaagctgaaaggagtgcccatttggttatgactgtgtgctctctcttctatgaaaacatctatgtgctctcatattatgtagagtaaggtagtgaggacccttagaagaacatggacgtcttggaggcagaggaagaagcaaaggcaaattcttccaaaatctggatctccaaaatgtcaagttctagcctgaaaagaatcacagatgaggcctgttgtgtttgagagcaaacacatagtcttatggttgccattgcttttgcattgtttgttctttttctatctcctaggccatgctgcttttcgaagtgaatgtaaatggggagactctagaaggatactgccatctcatgtatgcaacatgacactgatccacccctaccttgtttctgtactttggctgcatttgatgctcacaggtggttctataccaatgtcgtcaccagcaatgtttgtccctcccctacctctgttagcagtctgcattattccaaactcaggatacctaattcatgaactacaggacgttatttgaaatctaaggttgcgtttggtgtctgaggcccctgttgtgacttctttcaccgtgaaatgcatgttggcacaaaaatagaatgttcacgctgtgaaagattcaagggaagtctcctatccagaagtcattgttgccaagcctaaaggcttacccttagatgacatcagcaacatggtgaaataggagactcctgactctcccttcacccaccaatgcactgaacaaactattcactgattgattctctgaaaaaagtcaggaaccaattgagagactcctacccactgggcaactgagaaaaaacatctgcatcaaatgagtgggaaaagctgaggtgcactcaggcatgaactccaccttggacactgtgccatacaaccaggaaaggaatccctaacacacaacttctctctgtggagaggagggtttgggcctcacatatagtgctttagctctgaaattccccgtggttcggctcaattaatcaactctggaagtggaggggattaggaatacatgagtctttctgacctacaggaaaaaagcagtggttttatgctacagaacaagcacttccaggggcctcactctctggaggcagtgcagagaaggacttaaaaaaatgcagcttcttgtttttctctgggaggggtttatgacactcttctaggggctacttggtggctgggcttctaattaacttgcattaattaacttgcattggggagttaaagaggcaaatagtagcctgctggtagcctcagaagcagatcaacacttcctaagccttttcccctggctcactccagtgataactccaggtctattactccttcctggagagagtttgtccacatgtagaatgcctcaacttttgcagcttctactggaaggactgcactctaaaactcccagctttaggagcagagaggactatgcatatgagaatctctctagacaacagacaagagtggtaggtttatacaggtgcacacgtatttctgggggtttcaaactcttggagtggtacagaaaaggggcttaaaaatgcagctccctgttactccctgtaaggggtttatgccatgcattgagtggcccaacttttacagcagctaccacctgaaactatgcatactcaagtcttcccagatcacatacaaaaaggtttttttgtttgtttgtttgttttttaaacagagtctcactctgccacccagactggagtgcaatggcataatcttggctcactgcaacctccacctcccgggttcaagcggttctcctgtctcagcctcccaagtagctgggactacaggcatgcaccaccacatctggctaatgttctgtatttttagtggagacagcgtttcaccatgttggccaggctggtcttgaactcctgacctcaagtgacccacccacttcagcctcccaaagtactgggattacaggctgagccattgcacccagccaaaaaggtggttttaaatggacataataacactgccagggtctacatctcctgggagcagtgtagaaaagggactagaatgctgagctcccattttctctttgcaaggggtttcctgcttactctattggtggctacttgatgaccttgcttttaatgaatttgcattgaggacctaaggggagaaagtagctccctgtcatcctgagcttgagctgagcactttctgagcctttcctttggctcatcccagtgataaatccagtcgacccattcttcctggaaggagtttgtccgtgtactgagtacctaagcttctatagtttccacccaagggactgtctccttatcaacctagctctggggactaatggggctttgcattcccaatgagactttgcattcctaagcggcctgggactacagaaaacaaagacatgggcatacaacgggcccactttcagcatgtattagtccattctctcattgctataaataaatactcaagattgcataatttataaagaaaagaggtttaattggctcatggttctatgggctatacaggaagcatggcactatctgcttctgaggaggcctcaggagcttttactcatggcagaagacaaagccagagcaggcatcttcacatggctggaggaggagcggggtgagggatgtactatatacttttaaacaaccacatctcactcactatcatgagaacagcaccaaagagatgatgttaaaccattcatgaaggatttacccccgtgatccaatcacctctcaccaggtccaccgccaacattggggattacaacttgacatgagatttggatggggacacagattctaaccatatcaagcagctatctcaccaggatcagagggtgcagtttggacacaagtataggcatttgtcacagattatctctccagcttagtgcagagagagggagagataaatactggcattcaccttcaccataggatggaagaaaccagaatactcaccaccctccccctgccatacatgcaaaaagacagagaaagttttaaaaacagtgaggaaatagtgaattgctacacacaagagaaccctcccttagattatcagcagatttctcagcagaaactttgtaggccagaagggggtgggatgttatattaaaaatcctgaataaaacaaccctgtcaaccaagaatactatacccagaaatcttttctttcaaaaatgaaggggtgataaagactttctcagacaaacagaagctgagagagtttattactactagacttgccttacaagaagtgctaaagagagttcttcaagctgaagaagaggacactaattagtgactggaaaacatatgaaagtataacattcactgataaaagtaaatacattgtgaaatccaaaatactctgatactgtaatgtcagtgggtaaataaattatatctttaataacattaaaaggcaaagctattaaaaacaatgaaacctacaataatttgtcaagggatacaaattataaaaagatgcagattgtgatatcaaaaacttaagacaaattttctcttctctgaggctagcttgacttctctttgttctgcgttccactgttacctaaagagtgtccttagtgcctgcctcacagcccagcacaaggatatgagctgcagagagtgacaatacaagaaaggctactctgtggatatgtctctggtgcaagagctggtttgccctgtcctggagaattttcccaggatggggaaagccatgtgcttcttaatccttccctgatacctcaggactaaactgggaagtgatgtcagcaagatggcagaatagatctcctgggatcacttcctgacacaaaaataaaatgaaaaactattcaaagacaagaatgccaccctgaatacaccagaacttgagaagcagagaaaccccctgggctcatagaattgagagaagcagtgacaggtaagagaaatggtcatttcagcctgttccaccctctctcccaggccataataataccactcacagagaacttccctagacccacagttgctgagatgagaagaaggaattggaggtggatatttgatcttcccacttgtctaggaatcttaatggtaagtccactccagtttcatcccactagagaaccaagagggctgaaaaacctggggtgaattggggacaaagagtaggtcactgattgcagcaactggcatgtggatcttggtgattgttcagtgctttgatcagtggggatgccatattgaagagactggtgggggggccagagtattgtaggggacaaaatttatgggaaggcccaaatccacaaagcccaggtgca

SEQ ID NO: 10612 - DNA, 12751 bp, Homo sapiens
  misc_feature (1)...(12751): n = A,T,C or G, or insertion/deletion polymorphism (see Tables 1-2)
agctaagaacccatgctactttgaatagcacagactcttgagataagacatttttgctacttgctagttgtgtaaacatttaggaattattcgatttctctaagcctaattacttagggaggctcagtttgctcacatatttttgtgatgattaaataatatatgttgctagaatagaaccaggcatttagtaggcagttaatcattcaatactagcttcccatattttcccttatacacttccagaaacccaaaaataactttaacgaacaaaaaatagcaagcactgtcctaatacttatgaaagcacaactagaatttgccagtcttacatataagaaaaaatagaccacttcactccaacacaagccatagaaaccacaaagaagcattattagtgtttaggtcgttttgaggactttgacagtaccatgatagacacctcagaaactagatgaatgacatatgctaatcaaagtggcttgatggctgaaatgtaacccagtcaatctcaaattatgtcctttaacaaactcagctggcactttcctttcaatacaaataagccaaacaatggaaaaacgaatgagcaggttttcccctatgttggtaggaaaggacaatggtggagtatggagttattataactgctgctagaccacatacacagaggaaattacaagtgaagcaataagttcaacagatgccctttccaaaaaatttttcatgaggaataattactctaaaggatgagaaatcccctacgttttcaaagcctcttccctcaaaaatgctcagtgttctccacacgctatttaaccatccatcgtgagacaatttgcagttacctccacacttcccatgtgaagcatgagatgtaggctgggtgcagtggctcacgcctataatcccagcactttgggaggctaaggcaggtggatcacctgaggtcaggagttcgagacaagtctggccaacatggtgaaaccccatctctactaaaaaaatgcaaaaaattaaccaggcatggtggcaaatgcctgtaatcccagctactctctggaggctgaggcaggagaatcacttgaacctgggaggcgaaggttgcagtgagctgagattgcgccattgcactccagcctaggcaataagagcaaaattccatctcaaaaaagaaagaaagaaaagtgagatgtggagagataaatgacttgctccaaatcttactgtgggtcagttatagaacagagaggaggagtcatgtcttcatacgtggaataaaactgtatttcctcaaaattttctgcctctatcccagcacacacacacatgcatgcatgtgtacactcactgcagttacaacatattcccagggaaatacattgcagtgcttcgagcaacagattcgtcaaaactcagaacgtagaaggatgtcaactcccttctagttcaaactactcacttgacagatgggcattagaatcctaggacctggttttcattcttctaggggaaaaaagctgcataaaatgaaaagttccaaggtaattcagaaacataagatactaaattttgtataatacactaaaaatgatctctaaattgctctttgttccaaggtaattcagaaatataagatactaaattttgtataatacactaaaaatgatctctaaattgctcttttagccccctggatgggaagaaaaccagggtatggtgctacagtagagttcatatatttgaatcaggacttctcagcccttgcttggccgctgattagtggtgttacttgggaaagttactgaacctctccaagcttcatttttctcctcaagattagataggagagctttatttttacagctcaaacccttctcaaattctgccaataaatataaaagtattaaaacggttaggaaggtaatcaatcatttttccttcagatccacctttgataataagcacacgtaaaatgatggtaaacgttgacttactctaaaagtttaagctgttataattaagatgaaagagcctcttgttgatttagaaagatgattctgaactctatctttgggagctctcaaccacagacaagggagagcagggattttctcagccacacactgccaagaaggtggagagaaacctagcccccatgtcactggggcctagagaaattcttggcctgcatgttgctacatcatggcaacatgatggaggcgaggtgagggggacgtgcagtcagctctggggaaagtgaaggtcacccttaccagcgaggactgaaaattctaggggttggggaggacttggcaagtagagccaggaagacaacccgcaggttctagagattgtcaaacacaaagcaattgataaaaaggcaaatattgataaaaaagatgaatatactgaagataatggataatgggagcaagatatctcactgacgggaagaaggggtataaatatggaaggggaaagtaagaataaaccatgcaatgctggagtgtaatagaggttatagtgtgaagttgtaagttctaagacagatttatagactgatatataaataaataaaaatgaatgtgtgtttctatgtgtgtgctgtgtatatgtgtacgttcatgtatttactagatctgtctgacaagagggcctagaaacaataacatcccaatagcagtgagttatacctagcacccagatcttggtttctaaatacagttaatcaataaaaggagcaagagctccttggagaaatgactgattccaaagctggagcagacaaagtcaaagatacgcctgaaacatctattacaagaaagcaaggaagctctcaaagaatgatgggaacataaaaaggatagaggagccagtgtgaagcaggtcccgaaactgcctttgcaaaattatgactgagacagtaaaagagatctaacttaactgactccaccttgtttctaacctttaagctgtccttgttccttcctgtgcacaggctgaactaattttgggaggaacttagtttatagttcatagtttaaaacatagataataacagccctttcccaaaacaaacctccttcttgcctggggactagactgcctttgtagaactaacaagttagctccaagattagaaattacggcttaagagtcatgcagctaggggctgcaagattctcaccctccctaaactgctcctaagatcaatgcttgagataatttgcagaccctgcacttgatggatcagctggcaccacccagatcgataaactggctcatccgatcttgtggcccccacccaaaaactaattcagcacaagaggacaggttcaaataattccctaggattccatctcctagccaaccactcagcactcctggctcactgacttcctccacccaccaagttgtccttaaaaactcggatgcccaaatgctcagggagactgacttgagtagtaataaaacaaaactctggtctgccacacagctggctctgtgtgaattactctttctctactgtaatttccgtcttgagaaactagctctgtgtaggcagcaggcaaggtgaacccactgagcggttacactcccaatggccaaatctgggactacttgagtatcaaaataaataatgatggtaaaggattataaccaattgagtaaaataagaatcaatgagttcttacaaacaggaaggaaggaagggagggaaggagagagagagggaaggacagaggaagggagcgagggaaggacctcaataccacatctggctttgtagggttccacatcatgcccagatttggtaatgccaactcttaagtatagaagaaatgacagaattagaaaatcagagtaatagctgaaaaaatcatcaatggatgctaaaagagtgaataaaagttagaagaggaaaaggatattaacatagtctcaaaatatctccattcataatctatattaattacttattaaaatgcaaaatacttattaattttacaatggagaaacttggcagaaaccatctttgccaagtaaaaaaaggaacatcatcaataatgggacaaattaacatcttgtgactcctgaaataatgcattgagaagaacggagcaaaagttctgtggtatacctgccaaaaatgtgcaacctgaatctaactgtgagaaaataccaaacaaacccaaactgaggtatattttacaaaataacaggcccgtaatcgtcaaagacaagggaagactgaggactgttcttagtattcttaggttaaagaatattaaagagatatgaaacaactgatactacacctaataaagaacactattgggacaatctgcaaaatctgaacaatctgtacatttaatggccgtatggtcatcaatgttaatttcctgattttgatgcagtactgtggcttggtacaagagtgtccctgtccttgtccttgttcttaggaaatacacactgaagtatttaagggtaacaggtgaacaggtctgcaacttattcccaaatggttcagaaaaatatgtatataatacataatttatatatgtatgtacacacttcacagaggaaataagtcaaaaaaaggaaatgggatagcactttataattggagaatctcagtgataaaactgtagttttgcataccaattttacaacttttctgtaagtttaaaattattcaaaaataaaagttaaaaaataatttgatatgtttgttgtaatttagcatccagatatttttcttacaggagggctttttagactatcaatcactctatggcttctataacttaaaaaaaagtgattacatatggtacatattattctgtaacatgcttttttccttcaatatatccttgatatatttctatattaataaatataggtctatggagcaattattaatggctgcacaatattccatcacatggacataaaaaatgtattcaatcattttcctgttattggatacttaaggttccagattttttgctattataagtaatacttcagtaaatgtccttatagttaaatatttgcaaacatcatgaccttattctccagagcccttactattttttctgcttacatattcacatgtaatatatgtctgttgttaaaaattcaaacattatgaaaactggaaattctctattataaaaaaagcaattcttgccatatattagaaaaataataatttggtaggctattatcaaagatgcctgacaaatgaaaatggaattccaataccacgactgcaaattagtcagaataatgcaaaatttaacaaaacacatacaccagagaagtggctggcatagtgatgtcacattaaaaacctattaataaatgttttgacttataatgaggttttcaggggtagtgaaagtgggtgtgctagaagcccaggatatattacattgcagatgcttaatcaatatagtggcacaactagcagaagagttgtctcccgtttgtctccccgcatccctcctactactgccacactgagaagaagtagaggtcataacctgacctctgcctgtcgttcccagctgaaaaacaagtgaggctgtgtcagtggagtgctcactgacaggaatcagagcactcggccacaatgagaaaggcctgtgtgcatcagagtgtggatccaaggagtggaaaggagggaaaggggtcagactgcatgtttgaaacagcatccaaatcaggttgacaactggccctaccttctgcaatgctgtccccgcacgccagcaggaacttgcatcgatagcattttagttttctttatttaagattaacttccaagtccagcactagatcgtggagtcccgcaccactcccactgatccctgaacgcagatcccttctcctgagagttgtgagcaactttcccctgtccccagtactgactgcagtggcttgggaccatggccacactccccacaccttggcttcacatcacatacatcrttccctctctgggtgcacgctggnggtccccgacttctgcactatgcgtgaaatgcccctgggacacatcatgaggcaggaattggagaaaatttccctagagtacatcatgcgctgtctgcgggaagtcagcttctgctacccgcaaaacttcctgggcaaggaggtggtggncaactgcatccaggagcacattaaacagctgcattgcaagggggccctgcgngacagccagctggctgggatgtgtgcagtgtctctaaagggtgaactgtggggtgatcagttcaccccacagttctgggagcaacaagaagggccgcgaggccattggcttcctcctgtccctcactgacaggctagtcctctagtgcaggagccactgggaaaatactatgtcaaggagaggtccaaggcaatggtggcttgctatcttaaaaatggaataggttacattcatcatgtggacacctcaacaacgatggctgctgcaccacctgcatctactatctgaacaagaaytgggataccaggctacacggtgggatcctatggctattttcagaggagaaatcattcgtggcagatgtggaggccaattgtgaaaaagtcctgctctcctggtcagatcgcaggaagctacasgargtgctgtcttcctatgagaccagatgtgctatactgtttggtactttgataatgaagaaaggacagaagccaaaaagaaattcaggaatttaattaggaaacatctgccctcactgaagattgactgtgctccaaaatctgctggccttgttcactttagcaatggttcctgaattatctttaagagttgagatccggctgggtacagtggctcacgcctgtaatcccagcactctgggaggccgaggcaggtgggtcacctgaggtcaggagttcgagaccagcctggccaacatggtgaaaccccatctctattaaaaatacaaaaaattagctgggcatggtggtggacaccagtaattccagctactcgggacgctgaggcaggagaatctcttgaacctgggaggcagagactgcagtgagccaagatcgcaccattgcactccagcctgggcaacaagaatgaaactccatctcaaaaaaaaaaaaaaaaaaaaaaaagagttgagatctaaagatggcctcttcagtgatgaaaaactccccatccctgtcttatgtgtgggacttagtgttttcttgccaagactgcatggaccttcagatgctctctttgccagatgaactcatttgctattccacctccagaaattccagcagacataccagttggccagcagtttacctgatagatttggtaacgctggctatcaagacaagagcctaggagcacatgtgaggaaaataatcttgtattttatgtatatttcctgatttgaaaggtttgaaaaagaaaaacaacggcagatgccacagaaaggcacaatggaagccttaaaacagaaaacagaaatttatgtcatctgaacaatttccagatgttattaatccggggctgttgaagtctctggagaattgtcacaacctaatgacaacattattacctctataaagggctgctgtcatagtgatcaatctgtacatgtcccatggtgtggacactcctttttccaaatcttacaacctggattttctgccttggccccattttgctaaaaataatgactttctgaataaagatggtaacaccatttattctctattttcacttcttacctgaagaatgtaatccccagaagctaaaactagacattaggttttttcatgttgctttggtggaatggaatctgaatttaaaccaaaggataaatatctacttggtagtttggtgtcaacctctgaaaacaacatggaaagaatcaggtctacagatataccaagtacatgtgtacatcttgaacagtctgaaaagagagatggagttggaaatgtgggtgtacctgttttttttcagttttcttttttaatgagctcattcttaacattattttcaaaaatagaatggtgtattttaaaaaaagaaatgaaaatttaaaaaccctcaaaaagctaaaaacacttataaataaataaataaaattaactttcttctctctaggatccacctgaaaggacggtatcttctcaattttgaagcggctggcaatctgctaagtattctggaaaagcactgctctagacatcaaaaactctgttaataaaacttatatgtataaaattatgatttaagtaagaatccaagcgtttaaagactgtttcctatctaaaagtcataaagtatatttccttctatatttcctgctattcaaaggcacttaaaaataattgttaacgaacatatctaagcaattattttttgagtatcagaaagatgttcaacactgcacaagaatggcctgaaaataactcttaagataattatatgtacagtaaaacacttaatataaaattgtacagcaaccttttaaactaaaaaagtcacaaaatgttcaagaacacagtttcatccaccaaagcaactaattaatcttgtaagactaaggcagagatgagctaacacaccagatattataataacctacaagagataagatgcacatttttatcaatagtatctgaagttttgaagaattgtagcataaaaatgaaaatcataaaagcatacagttgtcgtatttccagaatttctgttatatacaacttccaaaacagagaaatcacaaattatagattatgtaattcctccccaaaaagtagctatcgatttagagactgcttttctaataaaatatgattaacactctataaaagaaatataccaatttatttttgagatgttctttctaccatccttcttgtgtaaaaatcagcaaataagaaaaatagattattgccctgattcaaggtctttaggattctcttcatgtaagaaaatgaaaaataatgtgactttggtgctgatatttcattctcttatcctaaaatgtttgatagccatgatgtatgtacttcacaggccagatttaagagagcaattcaggggtaaacaattgaaggagatgaaaagtacatgaggctctggatacaggagacgaatggtacttccaattgcccattgaacataagatgctgcagaatgtcagacaatcctagccacctttggaactacgtctgctggtgctccagtgtggaatgagtctcccaaagctagtaaagccagctccaggtcctcagctcatggagctagattcctgaacaaggtgcaatctgatagcatttccctgtcactggtaaatatattaggtaaatagatgcaacagaaagaggtcataaaaaaagtaaaatgaacacctctgtatatttacagagcatggaaactattcaatttttaaaacctgctcaataagatttatgaaatgatgaacaacttctggtgaatgctttcttcaaagaactgtttaaggagtgcatcttagatgtcaacttcaacaccaccattaagaaatactgtattacatgtactaatcatgggaataatattcactgaaaatgaaaacactaaacataaaattaaagatcattatagctctaaagggttgtaaaaatcattatgtcctagcccctcatttgtaacatttacatggaagcagagagaagtgaagtgtttacccaaggtctaggtataaattatcaaaatcataaagactaaaacccaaatctttagagttccactttattcacttaacacatgtgctatgtgtcacttcccttgacaacagaccatcatcggggcaggaggagggagaaagagaaggcaacactgcagctggcaaggagggctgcatctgggccaagcaacaggatgatattttacatacattatctaatttcttccctattgtaaccctgtgaagtagatgtcattatctccactttacatagaaggaacagaaagcacagagaagaacctgtccaagagtaaacggtagagccaagattccagccaagatctgtctaatgcaaagatgcagctttcaactattcctgctttcccagtactgtcctcccttcttaccccatggtgcatttgttctgggtctgactgtgacaccagcaatgactgggtggcctggctgcctggccgggtgatgtccccacttggatgctatctttatcagagagcacagccatcccagggagaggaaagtcttcttttctcaagagcacaggaagcagatgcacttcttagctaaattcaccagaataacactttattcatcaaactctcctgtttacaactaactacagatccaggctaacggcatagaaacatacaggaaatacaagatgtactaattaatcaactgattagtattagtaatacaataaaacatacaatatataaatgtattcaatgtatgaatttacgtacattgttgtatgtaaattcaacaatgtttccattatctggcacctaaagtatatgcaactaagaactggaattatgtcaaaaaaaaaaaaaagaagaagaagaaagagtcctgagttagtacttcttaataaggacatgggactggtggggaaggagaacaaaatcacctggagggattttccccatttagaagcctattcctccctcacatacacacctcaattcttttatcacaaatgcccagggggatatgctaatcctgtcaggaaagcagctggggcaaatcatttgaaaatgtttgtcaggtattgtaattttgagagcctacaatacatgccacaccctatagggttaaaactatggtggtaagtgagaaatgtagttatccacgtttccatgtccagctagacaggagtgacagaaggattggcagggaaggacagtgtgccgtcacgagctcaacatgatctgacagtaaaaagcttaaccactaaggagtaggcaaaaaaacagtaacaaataagaagatacataaatcaaaaagcacaagagtctggactgtgagctatgaggccaatcatctcagagattccactggcccctgaaagcatcactgtattctgggataatataatcagtaatgaaacagtttggaataatcaagaaaaaattaaattgtatttaataaaaattgttaagaaagtcagggaaataaaaacactttttaatagtttttgtttgtttgtttgtttgtttgagacagggtctcactctcttgctcaggccatttcagaaataaatctattaggccaggcgcagtggcttatgagtgcagtggcacaatcatggctcactgcaacctctgcctcccaggctcaaggaatcctcccacattcaaggaatcctcccatctcaggcccaaccttgagtagctgggactacaggcgcataccacaacaccaggctaatttttgcatttttttttttttatgcagagatggggttttgccatgttgcccagactggtcttgaactcctgggctcaagtgatctgcctgcctcagcctcccagagtgctgggattacaggcataagccactgtgcccggcctaatagatttatttccaaaatagctatatttctctgattttgtcaagggtcagtgatatttgaatgtctacttatatgtaaatgatgggtaaaatgcaacatggtgtagtgatacaacggaatacgagttctggagcaggtggccccgggtccaggtggtcctggtgctcaggaggtttggttgtctttgccataaggaatgtaactgaaatcagcaaggacatgacgtttccaaaggaaagcacaccaaggttgtggaaaagtcacactgggacagaatctgagaaccacagttctcagattctgagaaacatggacacttcagggatgacagaggaggtgaaggagcttgcaaatgagacgcaggggtaatcagaaacagaaaggaagacctcaggaatgtaggcaccaaagccacaacaacaaagcattaccagaaggaaggaacagtctgctgtgtcatatgttgcatggtaatgctgaataaacaactggggagtatgccctggacataatgagatgacaggtcattagtatattagtttgaacttctcaagacaaacaaataaatataactctttgcagaattcttttttttttttttgagagggaatctcactctgtccctcaggttgcagtgcagtggcgcaatcttggctccctgcaacctctgcctcccaggttcaagcaattcgctcacctcagcctccagagtagctgggattacaggcatgtgccaccatgcccaacgaatctttgtatatttagtagagatagggttttgccatgttggccaggctggtctcaaactcccaacctcaagtgaggaggacgcctcactccagagcgttgctgcggaaccagagcttagggcggcagcagagcaagaggtgatgaggcctcccaaagtgcctgtttcagcctcccaaagtgctgggattacaggtgtgagccaccgcatcgggccttcttttcagaattttagtcatgaagggaagagaagaaaggaggacgttgctggggatgaaggaaaaggaaagccagcatgtaggttctttcataaatggctaagaaaagcttgagtatgtctaaatgcttaatgggaatgagctggcagaaaggctgatgacacggaagaaagaatgcccaatagat

SEQ ID NO: 10613 - DNA, 50084 bp, Homo sapiens
cagcctggtcttgaactcctgatcttgtgattcacccgccttggcctcccaaagtgctgggattacagccgtgagccaccgtgcccggccttggtttttatttcgttagtattaagaaacctaataggcattcattcaagtggacgtatcaagtaagcaattgtacatagaagcctaggcaagctagaaattaaggaatcatcagctttagatcatattgaaagccttaagaccagatgaaatgaatgagcaagtaagtgactgcagagaaagactgccacagactgagctctggagtcagacaggaggaagaagcagcactccctgagctgggggttgtgcagagctgtacagagagagagagagtgccagaggtttgcagagggttcccttcaagtcttctactgagcagtgcaggcaagtgaagaaatacctgcatttcaaattcctactgtggtaggcactcctaccccatgccagataaagaatcaccagcgaatattagagaaaacaatccccagcactcacgcacggcccagaggaactccgaattccgccaatcatggtgaaaaccttcacaactcaaggatttgttgagtagaatgctgctcagggcccaccccctaaaaaaagtgtaaaaacatgacctgaagcatcaagctctttccaaggaacttacctgcaccccagaacaaagctcaaaaatattcataaaaataaacattatatgtatctcaaagtaaacttctcaatgtctggcattcaataaaaaattatctggcttgtaaagtaggaaaatattacctacaatgaagagaaaagccaatcaatataaacaatctcagaaattacttaggtgataaagttagtagaaatgacacatgttccatatgcttgagcactaaacacggaaaccagaggacccagatgcaggtccagacaccgagtgaaacttctgcaggtgaaatggcaatgcctgagacgaaaaatacgctggatggaattgacagcagattagatactataggaaagatgagtgaatttaaagacacagcaatggaaattacacgaaaatgaaaaacagaaagaaaaaagactgacaaaaaatgaacaaagcctgagttagctgtgaaacaaattcaagtgatctaatatttgtgtagtagaatcgccaaaggaaaggagaggcaggggcagaaaaaaatatttgaagaaataatggctgaaaaaactccaaatctgatagcaactataaactcaaagaccagagaagttcagtgaaactcaaggacaagaactttaaagaaaatcaacaccaaggcacatcataatcaaattgcttcagactagtgatacagatgaaatcttaaaaccaagcagagataaaagacacgttgcataaaagaaataaagataagaatggcagttcactccttatcggaaacaaaatgagccagaaaacactgaaacagtatcttcatgttagaaaaaaaaaattgaaaaccctaaaaatcgaaattgagcaaaaatagcttcaaacacagaagtgaaataaagacttttttggacatataaaagctgaaagaattagtcaccaggagatctacacttcaagatctgtcaaggaaagcccttcagacaaaagggaaatgagaccatggaaatctaatctatacaagagaataaggagtcttagatatggtaactatgtgagtaaatataaaacacttttttcttattgtttaaatctattgaaaagaattggctgaaaatgcagtatatatgtacaaagtattgaatagtattcagtcttaaacaggaaggaaattctgacacattctacaatgttacagatgaatcttgaggacattatgctaagtgaaatacgacagtgaggaaaagacaaatactgtatgactccatttatatgaggtactgtacctagagaagccaattcctagacaggaagtaaaatggtggttgccaggcactgtggggagaagtgaatggggagttgttgttaaacaggtacagagtttcaggtttgcaacatgaagcgttctagagatggatggtggtgatggttgcacaacaatgggaatatatttaatgccactgtacatttcaagatggctgagttgctacattttatgtctattttaccacaattaaaaggaaaagagagacagagaattagtagcttattaagtaaaaacaataacaatgtatgtgggtgtacaacatatgtagaagtacaacatccccagcacagatgctgggggaggatggaagcaaatggttgtcagtttcttatactctgtataaagtagtgtattatcacttggaggtggactgtgatgaagacctatactatcaaccccaaaaccaccactaaacctcacaagaagttattcttcctaagtgacaaatgagataaaacaatcacaaaaatgcctctgtccactgaaaaggcctagaaatagcggtcccctggagcagcaagcacaagcgtacatatatattaaaaattgtcaaaatgtacactttaaatatgtgcaggccaggtgcggtggctcacgcctgtaatcccagcactttgggaggctgcccagcactttgggaggctgaggcaggcggattacctgaggtcaggagtttgagaccagcacagccaacaaggcgaaaccccgtctctactaaaaatacaaaaattagccaggtgtggtggcgcgtggctgtaatcccagctactcagaagtctgaggcaggagaatcacttgaacccgggaggcagaggtcatagtgagctgagatcacgccactgcattccagcctgtgcaacaaagcaagactacatctcaaaaaataaaataaaataaatacatacgtatgtgcagttatgcctatacttcaataaaattgtttcaaataaaagcacgatgagctgcctggacaggtgaaaattccagtggtagtcataatgtctttccatagactttctcttctcctttctttcagggacataacaatattgcatttcctgtcctctttgaaattaagtgttgccacatgacttgctttggcccatgaaatgtaaatagaagttcttatagcaattcctggtaagtgcttctctaactaatgcacaatcagtcctaatgcatagccactcctacctgagtgattgtggagatgcatttagataaaacacactcggtcagcctgggtctaggagggcccatgagcaagtctctgctcgtgggagtggacaggtagtctgagcgaggaactttgctgcgtaagtcataaatgggttgagagatctgcattactgcagttaatctagcccattctgactgaatattccctagcaacagaggtatctgatcatggacatagttttgacagtggaaggtaaagtggcccagtgacctctgaggtgtctactttcttgaagatgtgagttatatgtcatagtctccaccagcctgggtgtggaattgagcttccattttcaagtctccacttgtatgtctggaatttggctccttctcaaggtaacacccagggattgctgagttcccaagtgctcagacacaagtccactcattttcttcaattccagttaccaaagaaagtcaccattccaccgaggctgtgaccagtgccctccaccaggcctagctccaagaatctcatgcatcaagccccagggctcctcacgttgggcattaaatgtaaggtcatgccacattctttaacattgtcaggaagcaggaaggaaagtaccagatacttgaaggacccactgacctggaaaaaagtgggatctagtttcagcttgaaaaaatccttcttcataattacatttcccttaggcaaatctctaacatgcctaggcttttgtatatctgtttttactgcgtcacaaacctcccccaaagagaagggagacgataactggagaaaaccacaaattaatcttccaatatttttttcttccatataatcagcagtgcctcagaatcaaagcagtctctaaaaatattttgaagaaatttattttcttggatcttcaaagatccaaagttactgagatgcaaagaatcttccacagtatcatccaaggatactgaagggctccttcaaacctcgcccttgtatatttcttcttccagttgtgatactgcagttacatttgcaaaccaaatgatccctttgggtggtttttccaaaacaaatcgtctttcccaaaggcctacctaagtcttcattttccacaaagtagaaaactgcccacagctttgaaatggcagcataatttgtatttctaccaccttgtccaggtttcagggatctctggtccagtttcagtcaataatgctaactatcactgcagctcactgacttctttcttgtacatagcagtttttcgcaggaagaaaacaaatctaacgaataggaataacttcaggtgatgctgttttcttcccgcttcctgggatcactgtctttcctctgaaatggttttaatcagaaccaatctgttatactcaggagcctaaatcaaacacgacatgcagagagacaaacaagaaagcaacaaatgatctgagccactgaacaagaaatatatataaaacagttttaggaattacagctgtcacaacttttcaccatggggccttctctgtgatttagaaaaaactgcatttatttgttattaggatcggagacaagagaaaaataccgacccaaatagccactggggaagagggaagctctgatgccaatttatgtggaggatggagccaaactgactcacacacacacacacaaaagtatgtactggcattttccacacagtccaggtcacttgggagcttagccaaggatattttgagcattcgactacctattgtgaacaaggttgggaactatgaggcgctatgtggccctgatcaagctcagatgggccaaatcctcaaccaaaattctctttcccataaatgtttatctctacatttcccacagaaggggattctaactcagttttgcttctgaaaccaaactatccaaggccaggtgagatgactcatgcctgtaatcccagcaatttgggaggccaaggagggaggatgcttgaactcaggagttcaagaccagcctgggcaacataacaagaccccatctctacaaaaaatttaaaaattggcgcggtgtggtcgtgtgagcccctagccccagctactcaggaggctgaggcaggagaatcggttgggctgggctgacagtgccagaccctgttaaaaaataaaaattaaaaaaactcctaaatttggaaacacatccccagctgagggccgggagatacttctcaaccgtaatccagaaccctctaaaatgggatgtggagaggctgcagcctgtagtcttgcgatgaccttttagcacctgggcatcttgcgcttctgtcattccgcccacacccgctcagctccatccaagagggcccggcagtttggagtgaaagcttagcttcccaacgggtaaatgaacctgcctcccattcacagggcggcctctggctggacacctggggcctactgcctccttgttacacattaaccaagttctggcctccatcgtaacagcgtcagggaagttttttcctggctgacagccgcagatgatgaccgaagacaacgtcttaactgagacgggccaatttggcaaatggactgctttcctccccagtgcgggcaccttcctcctctgtccggcaactggaccccactgtccccagccctctgtcacccccaaacctgcccaccgcccgcctctacccgaccctccctcagggaaatcgggactcagcccccaacgcccccacctgccgctctgcccacctcagcgcacaccgccagagcgcccagcccgcgcacgtgcttccggcgcgcgccgaagtcctcacgcgccccgccccggcctccccgtgcgcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacggtacgaggcccgggctggcggggcgcgcgggtcgggccgcggggggcgtcggtggcgcggggccgggcctgggctgcgggggtcttgagggtggcggtggcgccggccggagccgggggacggatctcggaggtgtctgggcttgggaccgggatgggggacgcgggccgctgggggctcgggtggggtagcgggtgcgcggggcgcgggggcgctgtgcacagcgcattggcgtgatccgccttttcaagtttcctcttgctctttctctgctcttgcactcttagcgcttttcccctctcagtctaatgtaaataactgaaggtttgaaaagccagcttgatgttcggtttcagctgcgatattatccccagcgagcctgtgaagggcttagggcgacgcctgtgttcctcaaatacttcagtttgacctttcctggtttggaattccttgctttacattgggattacagtgaggagttattaataggctaattcattcatctcttcctccggagacctcttgcttcgtttatttctccctccctctcagtgttttttagccttttctgggttgcattttggctatttataaacatgtcttgtctccttcttaagaccgtaagcaccttggaagcaaagccctggctgtttaatctttgtttcccctgcagcacccagacctggaggtgcttgacaaatactgttttgaataagcgaaasctttcccagtgcatatgctgtgtgcttttttttttttctccccttttttggccttgcgtggtaagaataaacaacttgtactttgtatcagagttgaatattaatagatgtttaccagtccctaatcactctttcagatgtatgtattctcagattaagactttgatttggagttttacagtcccagagagaggctcaagttcaaaattacatacctcaagccaaattagtcctgtctccatctgtcctggcatgctgcttccttctctgcaacaaatactgtggaatggcattagggaagcgagcaccgtgctgggagggctgtacatcctgcagaaacacagcagacacggctctggtctcatggagcgtagtctattgagggaatgcagtattaatccawttgtgatactaatgagtgaataattaaaaaccaggcaagagttctgaaggagtgtggtccgtgaaagtgtgttagaaagaaagatgacccagacaggggtgtcagggaggcattaaccaggcagcacgcagaacatctcaggcctgtgggaagggtaactcaagaagggtgtgttttgagtaccacgctggagaggtggatgaggaggcagagaggagagggtcttgaggaaggcgtcagtttgtcttgtaagaaaaaatgggaacttttggaagggcttccatgctggggtcacagtgcatttggtccaccttcagtgagtgactcctgtgactggtactgccctgttcttggtgacaaaggggcatgacatctgttcctagaaggcgtaggaaatcctccagtaagtcgatgccttcatcaggacaagtgtttgcaaatgtttctgcaaatggcagtggtctggttcttcctgtagagaaccacagtcagaaatgttgtaaggaaaacatggtctttagcaatttttggttacatctttgcacttctttattttcaagtgctctttagcccaggcttagtttctttaacctgagtaaggagcacggagcactaggggaagggtggaatgtccaaataagaaaagcaagtgggggtcatgaatcagtaagaaaggattggaagagttcaggagatagagcttttatgtttcatttttcgtatacgcatgataacaactgataaaatagagcwtatctttggcatctccacttcagacacagttaactgaacttttgagcttcacagattgattacattctgatcataaggctttgaccattagtattcttatttcatggtaacttccaagtatgtttttactttgcaactctgaattgaatcttttcttctaatagaggaaattaatcgaaaactagtagaaactaataaatagaaaatgaggccagaggtgatggctcacgcctgtaatcccagcactttggaaggccgagttgggcggatcacttgagctcaggagttcaataccagcctggccaacatggcgaaaccccagccctattaaaaatacaaaaaattacctgggcatggtggtacgcttgtagtcccggctacttgggaggctgaggcatgagaattgcttgaacccaggaggtgaagtttacagtgagccaagattgtgccactgcactccatcctgggcaacagagtgagactctgtctcaaaaaaagaaaatgagttttagaaggagcaagcaggacagttgaagtttgccaagctgaagtaaaagtcacctagaaccaagtcctaggctgtcactttgacgtatcagtggccatatttatacagcattgttccttaaaagtgaaacagtcaggctctcttctggacatttgcctctgagctggtgaaggaatgtttgcctaacctttaaactcctttgtactctgtgcttatttgctcttctgtaaaaggaggctctgtgtagcttgacagagagatgaggaatgaaatgtactgggtttttgtttcccttttttttttttttttttttgagacaggacctcgctctgtcacccatgctggagtgcagtgacacaatcacggctcactgccacctccatctccccatctcaagtgatcctcccacttcagcctcctgagtagctgggaccacaggtgcatgccaccacacctggctaattttttttttttttttaattttttttgtagagacgaggtctctstctgttgctcagtctcatcccgaactcctgggctcaagtgatcctcgtgcctccacctcccaaaatgttgagatcacaggcatgagccactgtgccctgctgaaatgtactgtttatgagctacctctcattaatgtgttcatttaatatgctttttaacatattaaaacagtatttcaccttccatagactgagtagtgttgaacatttttgttgctttgaagtcaccacatgaatactgtactttatgtaatatcgtgaaacaaattgaaatcttaggttttggatgaaacccttagtctgaatatgaaacarttctaccaaatgccattagatacactacattcttaaagccctggccagttagtatggcttgggacttcccaaggaactctgcttcagccatctgagacctgggagattacaaattggctgaaagtaattttgatgctaagcagcgatgttcagaaaggagctgaaaagtatatgtagtgggaaaatgccaggaatttcttttraaattaagtgctggggcagttcgagagtgaggaaaaatctaatacaaaatctctacatatattagagtttatgccgtctacaatgggaataacaaatgaaacagaagaatacaattcaaattgctggttctatgctcatttttattaaaatatactcttaatgtttttattttgtgcttcattttgaaaacagcacagtattacagtatttgccatataattttgagaattatcagaatattttccttaaaaatgtatcattttaggctgttcaggttgaattgtgttccccaaaatatctgtttaagtcctaacccctagtacctgtgaatgtgaccgcatttggaaataaggtctttgcagatgtaatcaagttaagatgaggtcatcgtactgaattatggtgagccctaattcagtgactggtgtcattataagatgagggaaacttagacacaaatgcattcagagagaaagagatgtgaggatggaggccaagattggagggatgcatctaccagccaaggagtgccaaggggtggctggcaaccaccagaagctagagagaggcaaggagggatccttcccttgagccttcagagagaccttgaccctgtcagcactctgaatttgaatgcccggcctccagaactgtgagacaataaacttctgttgttttaagcttcccagtttgtggttctttgtgatggcagccctaagaaactaaaatataggctttgctcatcaaaatacgattcatgagaaatttaggatgacaaggcaagatgaagtgaagaagatatccttggtaaaggaaatagcatttcttttccttttttttttttttttttttctttgagatagagtctctcactgttgcccaggctggagtgcagtggcacaatctcggctcactgcaacctccacctcccgggttcaagcgattctcctgcctcagcctcccaagtaactgggactacaggcgcccgccaccacacctagctaattttttttttgtatttttagtagaggcggggtttcactatgttggtcaggctggcctccaaactcctgacctcatgatcccgcccttctcagcctcccagagtgctgggtttacaggcgtgagccaccgtgcccgtgtataaatagcatttcaaagtcacctggttccaataaaktatgaaataacttgctcttagggaaatcaccccaattgccctttaccttaatttcatgaaagatggaacaggtaaacatgtcaacaaaggaatcctgtaacaccaaaacaaaggacatttcttcaagttgaataaatatatgattatacatgtttgtcattttctttttctcattcactgaaagctggtgaacatttcaagtaccaaagtttgggaaacattgcaccagtggcttatcaaactaatgtgcacacgagtcccctggtgtattaaaatgtagatcctgacttggagggtgagggagatcggcatctgaccagctcccgggccgtgcaggtgctgttggtccagggaggcatgtaatgactccatgctcgagaactttgaaagcatggttttttgaaaaaacaaaatattctttctcatggtcatttgaactgtaaagtattccaatccatgcctgtgactttactgctgatgctctgatgactgtaacatctatatttctagtcacatccttcactcaaactacagatctttttttcagctacctaactacacctgggtggcctacaggcatctgaatgcagtacgtcccaaacccaacaaattattcacgcctatgccccatcttctatttttcctgtgtttgcctagaagataaagttagagtccatttttaattcttccccatccttacctcctggatctattgggtttcagagtcttttgagctgacttcttaacatggtttaagttactgtttaccctgaaagatgcaaaggaaagttaaattagggccagtttacatgattaaaaggtaagcaaattgggtttcattccaaagttcttcgtcgtagtgacttgagcagctgtgctgactatcttacagcttgccacacagcatctgcaccactgtccctaggcagcttccacagcacctggaacctgggttcatgaggatacaagagcctcctgggccaggatgggagtagttttccactttagaagaactatatatctatatataatatagatatatataatatatatagtttatatataaattatttacaatttatatataattatttataatttatatataattatttatatttatataaattattattatatcagtggaaagtaacaaagagttggcctgctaagtaactgccttcctcaaatcagcctcctcagtgtgtgtgatcccaacgaatgggtcaggaaaatcaaagacccaatcacgaacctggagcaattgttgggagtctgtgctgcaaatgttaaatttacaagcgtcaggattccgctgtgccgacaacgtttaattcaggcttaggtaaaccgcggctcctacaggcacactgcagagtcccatgattagcttttgctgcctgttccacctcctttacttcttattcttcccgctcctctacaggtcgtgtgctcttctgctgcccaaaccttccacctctcctaaccagcatttcatcaaggttcccactgttcaattcctccctgaccattgtaccaaaactttttgtcctttaaagtacatgtcatcttatattctgtcctctgccagctcctcgttgctgtyatctgatgaccctggggatagtcctttttcaacaaggtcatctatcatatggtcttgctctttgctctaactcctgactgatcctaggtcactgcattgtccttgcagaggtcaatcaacaactccgctccacagttccttgactttagtcaagatgaagtcaggtctcttctaccacctcttcaggtactcacttccctgactgctccctggactttgtcacctatcccattctgaccactccaactccatccagtcttcactgtaagagcttcaggctgctggtccatctcctccctttcttctttttttctgagacagagtctcactctgttgcccagtctggagtgcagtggcattatctcagctcactgcaacctccacctcctaggttcaagtgattctcgtgcctcagcctcctgagtcgctgggattacaagtgtgcgccaccacgcctggctcatttttgtatttttagtagagacggggtttcaccatgttggccaggctggtctcgatctcctaacctcaagtgatccacccaccttggcctcccaaaatgctgggattacaggcatgatccaccatgcctggcccctttcttcttttcaggcaatgagctgctctctcttcagataagactcatggcttttccttccacctcgtccttctttttctttcaactacacacactttgcacagctccagccctggctacccagccatctgccttgcctgctgtgcagacagagctccttttagattgagatcattgcagatgtatggtctctgcttccagctgggtactcagtaatacttagcaatcatttttcttatcctggccacctctctctccacatcagctattttaaaccttcacacatctcctcaagcccattctctcactcctagtagatgaccaccagtagatgtaaggaaaagatgccatgtctgcaaacttgcttacctcatccttaaccctttccatgttgtctcagaaggtctctgttgtttaaaactaaccccagccttctactttggaccccatctctaaagcttcaagtccccacttcacccatcatgtctgttcccctccttttccctttccactggtagcttcctgactttgcgccttcctcctttaaccacctctgtctctcctttccctcacagctaaactgcttataagagctgtcagtactttttgtcaacagttttacttccttcattcttcaactgactgtaattaggattttgcccccacctgaaatgatgttggtttcaccagagatgctgatgatcagtcagtggacacttggcagcctttatcttacttagcttctcttttcatattcggcccttataagaactgcttccccaaatctccactgtgttggcttacaggtattttcaacttaatctctgaattggcaacttattattttaccttaaagcctattccttctcagaaccttcagcatctcttatctcagttttcgtaatcacagaccctaagcctttaattcctaaagaaggaaaccttctttaaatgactccattctacccaaattctagtgctataccacagcacttagccttttctgccaggaagtaggacacatgaaatgcatcatacagtcagaggccatacatccgtgcttcctttctgacatttggaaatcttgaaagcaagacgattgcttggggaaaaaactaggaaggcagaggtcatcgtgtctgctgaatatggcttaattttcttgaacactcaaggtcatcattgactattgactgctgcacagaatgtgctgtgctattacggccactttctagctcatcccctgctgtccccatctgcctttgtgcctgtagttcacagtcctactttagtatatacctttgatctactgcagtttggggcattaggtaatagaggctgcttgaagtgaatgtaaaacaagtcagtcaattccaaatgaggtgtctcctgtagagttaatcttttttggctttatgtttgctatttcagtggctaggagacctttttttcctggtctttattttgtctgtgttcctgaatggctgacatttgctcaagattgaattctaattatttgatacctttcctattatctcatttgacttttctcatacggaaagttaaaagtacattagtaggatgtatctgttttagattttctgttttggggtgtggtctttcccttcaatcttaattcattctggagaaaacccttatcaggtgaatataattataaactgagtgagaaaaatttattgtgaatttgagccctcaagttaacrttcactataataaacaccgaatctaatttaagtgggcacaattatttaaccagttgacacttagttatataacctacataggcattttgccttcattaattactctgtaatatggctattcacctgttcctgttaagcctttctgtagttgttaagcactatacacttaacatataaaacatacacatggtatgctatatatatgtcatccactgttaagcaaggaaaaagaaaaaaccacagattaaaaatacaaaataaacccataaaactagtacagattctgccatattctgatatggagtcatgatgagtgagatcatcattgctgcaaaccagcaaacattgaacactctgagagaacatgatgcattcctgccagaatgatttctgtgagatccaggtaattcagcactaactgaaactcctcatgaagttggattctcatcatctaccaaggaataattcattatctccttatagttttatctgcgttatctaaatacatgtatcaccacacagaaaaagaattgatggacagctcagctgcttatctgctgctccttccttgtggtattgtttccttcttgaatcctttgctagttcttccagtttggggactgtgcatagtaaacgtacagagtcattgtctgataatatcacgtatttttttttccgttaagctttctattttgagatcattgcagattcatatagttttaagaaaaaatacggagttctcatgcacctttttcctagttttctccaatgggaaaaacttacaaaactgttgcagaatatcacaactaggatattgatgttgacacagatacaggacacttccgtcaccacaagatctctcctgttgcccttttataggcacagacttccttcctatcaccacattttccttagcctttggcaaccactattctccatttctatgattttgtcattttaagaatattatataaatggaatcttgcagttgcaattttttcggattgactttttcactcagtataattctctggagatacattccaggttattgcatgtattgacagtttaatccttgttatttccgagtagcatttcttgttatgagtgtaccaaagattgtctaacaatttacctgttaaagaacatctgggttgtttccaattttgggctataccaatacaactgccataaacattcatatacagggttttatatgactcaaagtcttcatttctccgagatgaatgtctaggagtgcagtttctgagtcatatggtagttaaatgtttagttttataagaaactgccaaccatactgttaacattttacttaatgttaaaatctcgagctgtaatggtgagtttgtctgtttggccttttaattctgttagtttttgcttgacatattttacagctgtttggcatatacacgttcaagatacctatatcttattggtgggtttacccttatgtattaatagttatgtaatgaccctttctgtctctggttattttctttgttctgaagtctaytttatctgatattaatacagccagccctgtttttctttgattaatgtttgtatgatacatccttttccattctttcagcagtccatatcattataactgaagtgagtttcttgtagacggtgtatgattaggtcatgctttttaagtcagtcttccaatctttgtcatttaattgatgtatttattccatttacattattgtaattattgatattgtatgactcaggtttgccattttatttctcagttttcttttccagcctgccttgactggccattttaaagaattctgtttgatttaccaagagtgctgtggaatgtatctctgctcatagctttttcagtggtcactctgtgtattacttcatatatacataacttatcatagttatatatatatatatatatatatatatcatagtttactgttgtcatctttttatcctgtcttgttttaattgtcttaaatatttcctttacatattttagaatcatatagataatactatttttcttaaacagttaaacataatgaagaaaactcaagataagaaggaaagcctattgtatttgcccatgtttttgctttccatgttctttcttccactcagatgttccaagattccttcctttatcattttcttcctgtttagagaaattcctatagctattcttttgcaggcagatgtcctggtgataaattctgttaatttttttttaaatcagagaatgtcttcatttaccctttattcyagaaaaatagtttcacaggacatagggctctgggttgaaaggttttctttctttgagcacttgaaaaatacagtcactctcttatggcctccctggcttcagatgagaaatctgctgttattcgaattgtatttcccttgtagatatggtatcatttttctctggctacctttaagactttttatttgtcttcagttttcagaagtttaattatgatgtatcttgtcatggacttctttgagtttatcctgtttgagttcattcagcttttcaaatctgtagatttatgtctctcaccaaatttaagttttcagtgctgtttcttagagtgcttttttcaaccactttctctttgtcctctccttccaggactccagtgacatgaatgttagatctttttcattgtctgcaggtccttgaggctctgtttatttatttcaaccttttattctttgttgttcagattggatactttatcattttgtcatctagttcactgattctttcctgtcacttccattctgctgtcaagcccatccactgaacttttattttggtagttttatttttcagttttaaaatttctatttggttcttctgtgtatcttctagttctttgctgagacttctagttctttgctgatgatttctaattttttcatttgtttcaagcatgcttgtgttacttgttggatatgatgactgctttaaaatctttgtcagataattctaacatttgtcatcttgacataggaatatgtctgttaccttttttcgttcagtttgaggtcttcctggttcttggtatgatgaggagttttcaactgaaacgtggatattttwatattatgttataggaccttagatctttatttaaatcttttaattgttttcctctcttggacactaccttatcactgccatcatgtctagattctggaatctagaagttcagattccccacttgcttccattgacacatgagaggaattcatcttgttactgctgctgggtaaggattagaatgttctcgtccctctttccctggtgacctccactgacactgtgccaggggcacacaagagctcattacacagccagcagagatgaaagccctagctccctacttggtcttctctgacaccatctttgtggggatattgatatgcccggttgtagccttgcaagggtggaagtttaggctccccattcggcctttgctggcatgggtacaggttggaccatagtttttgctgtggtgcttggctagaatagagtcattattgtgtaagagttttcctctctcttgcttggctgccccttttttggtcccatggctacagagagcaggcttttgctaggactttttttgtctgcatccattggcatttctgggttgccagcttgttctgctccaagcctaggatacaagaggcaaaaagaacccagggaacttccttccaaatcattccttgggccctgaaatccckggtacactgaaatctctggtacactggccttcttttgctccactctttcagagtcttttttttttttttgagacggagtttcattcttgctgcccaggctggaatgcagtggcacaatcttgcttcactgcaacctctgcctcccaggttcaagcaattctcctgcctcagcctcccaagtagctgggattacaggtgctcactaccacgcctggctaatttttttattattattatttttaatagagacatggtttcatcatgttggccaagctggtctcaaactcctgacctcaagatgatccacctaccttggcctcccaaagtgcaggaattacaggcatgagccactgcgcccggcctcagagtctttgatatttcttttctagggtggttttttttgttgttgttgttgtttggttttttttttttttttttttttttggactgagttttgttctgtcrcccaggctggagtgcagtggtgcaatcttggcccattgcaacctccacctcccaggttccagcaattctcctgcctcagcctcctgagtagctgggattacaggcacccaccaccacgcctggctcattgttgtatttttagtagagacgggggtttcgctgttggccgggctggtctcgaactcctgactgaggtgatccatccgcctcagtctcccaaagtgctgggatttacaggcatgagccaccacacccatccttttctagkgtttttagttgttcttagtgagaaaaataggaaaaagttcttctactccattgtcttggaagtggaagtccacctgggctttaagggtaatttttttgcacatcaaatgcaacaatgatgggttgttgttgcccctcttctcagccctgtgaagatagtaccccgttgctttcggacctttggaatcaagacacctagtttctttacaagccttctttcctttctttcttattgcttttacagtcttcatgtgtattctgcagtttcacaattatgtatttatgtgtagatttatccttatttattcttctcatggttcagagttattttttatttgaacaatcctttaattttaattctataaaattctcagccattatttattttaayatgggctctctaccctcattctcttatttttttaatttcaaaattcctgttagatccatgttagatcgtttccttcaatcctccatgtctcttgagttcttttatatgttctgtcctcagctctcagtactgcctactggtaatctccaggttttattctgattcactaattctctcctcagttttgtccattttactctttaacctatccattgaataattagtttacagacagagtgctctgtcacccaagctggggtgtggtggcacgattctaactcactgcagccttgaacccctggactcaggtgatacaccctcctcagtgtcgcaagtggctgggactacaggtgtgtgccaccatacccggctaagtttttatttttattttttttaggaacagaattttcatatgttgcccaggctggtcttgaactcctgggctcaaacaatcctccctccttaacctcccaaagtgctcatattacagttgtgagccaacgygctcagcctggaactttttaatgctaacaaaattctaatagcattatttttagtttgattgcctgtaaccatgtgmatattatgagaggttgaataggcttcatctctcagtggtgattaacatagttcttaagaaacgtgacagagctaggccaagcatcagtaaaggaacacactcttggagcttaattgaggagggagtgcttgatctgatctggaaaagagtgtggaggtgacactttcaaagctacaaacaggggagccaggaatacagagcagagcctttgaggccacagaaggagtcaggcagcagtggggattagcagtggtgggtcaggagcaagggtaaggagtggacttagcagctgagtcaaacggggaggagggagttggtgttctggtactcccgagctcctaagctcctaagctatgcagaattacagttctttggtaacagaaaaaacaaagtgaattaacatgggtaatatgaagttactgatactacatcatgctaattaaaaatttccatttggaaatcctttatttccattttataaaaaataatatcccaaattaaatatattactatgtgtaaagaagaagttattcagtttgtcattgaatcagacaaatttcgcacttgaagtgctgacctaaacttggcttatgccgttatacaaattacagatgagggaaaagaagcaagaccacgtaaatctgcaagtgcagacaaaacttatttttttccttttcccttttcccctgctttttaagaagaagaaagaggtagactcttcaaagtctaccaggtttattcttttgtacagaaaacacttgaaattttctaaactaastttgctgccaactgaatatgcatatttctttgaatagtggctagcaaagggacaagttttattcattccaagagtagttttcagactttaaccttgcaaagtaattattcaaagagcacagtttggaaaaccactgaattaacatgtcagccaaatatcttaaatgtgaaaaggtaagtcaacatrtgtattgtcatttcacaagatactcagttacctctttttcctgttatattaacaactragatactaaatttgatgatcgtgatctaagaagaaattcacagcacyattttgaagttattttcacagtctctttttatctttcagattttttgtttaagttcttggttattggaaatgcaggaactggcaaatcttgcttacttcatcagtttattgaaaaaaaatgtaagtgtcatgaaattagtcattcttccgtgcatgtcttctgagagccctctcactcagatttgtttacagtaaacttaattttttcagaggaaaaaagtaatagtttgaaagtattttgaagggttatgttattgaactttgggtgatgtgattttttattaagttagcatttctatttaacaatggttcagtatatggttacttctactgtacattttgcagatgctgagagaccatatagtgatgttgaagatagcagaggggttctgtggcaggaatcctgtttcctgacagagcagccagagaagctctaggcatacattttggataaaataacaacatttggtcctcatagtgggcttgtrttgtagttaaggcagttgctrtcatcaattctgttttataggccagaaacagacctcttgaccacacagcccatcttttaccattgactttcactgttttggtaaaggaggttgaattttttatttcaaactatgtgagaccttggaaggctgtagaagactgtaggtttgaaaggcccttaaaacaaaaaatgctttttaataatggaaagaatcgtggagaaagacctgtctagttagtggcaggtgggtgaagggtcaaaaacagagtgtcttatttaattaagtttatcttaagaaagtatatgtgaggcatggtaggtggtgggtaaaaaggagaaagaaccagtttggggtgttttggcagaaagctttgaagaataataaaatcctagaaatttactctgcttcttccattttcatcacccaagagcttgttggagcctgtttgtttagtgacatggacccagtgtggcttagtcacagaactggtccttactgaatttaacaagtattcattcactggatagtttatttacaagttgccaagactttgtgtggtacagtcttagaaaagaatacccagagggtactgggccaagtacccagcttatgtaatcattctgtcctcctcagagaactcccctgcatggtcctctctgcaactcctcacaacagtaatgaacggaaggtctctctttgtaaccaggatgcccctggcctttagttactattttttttaaggatcttascctgcatttttcctggtagtttactcctaatggaatttccatactagttctatactgtctgggcatgaaacagactagcatagtcactgtaaccatttatctaccctctgccctgtaaataataaatccagttgccagtggcatccctgatctctgaaacaattaaattttgttctgcagttacaaaatataaactagccaatggactgtatagctgcgatattcaatttcagcttatctgtttatcatcacagaaatgttctttcataggcagtgtattcccgctgggtttagcaaaatacttattttgcctgtctcctgcccattcaaatagtactaatttctccaacaaattcatcccaaatcatttccatagaacactacgattaatgaaatctcaaacacctgtagcttgcatagggttttgttttggggtttattggagggtgtattgttttggggtttgttggagggtgttttattttggggttttttggagggtgctttgttttggggttttttggagggtgttttttctttggttcaatttttttcctccttttcccttttcctctgcttttccttccactcactgttatttctttaaaatatttaaccattcaaatacagtagttgaaactgtctccacctcattacttactgagttccacacctgtcactgggcgttatgcccttcagaatggtacgctggtatgtcagcagtcaccatctgtgagcatcttaacagtgcacagttggatgtggttcggatatggcagggctactttcaggcataggtttttaaatgtatcatttgtttgggggttttgagaaaaatctttatgtctctttgagaataggggctgtgtgtattatctttaaaactaaatgcatcttctcaatggaatgttggagaaatgaatggctagagtaatgtccattccccattgatgtaactcttggttttagtgtcacttgtttaaatctataagcctgttaatgttctaaaattaaataygctgttcttgtttttcttttttagtcaaagatgactcaaatcatacaataggagtggaatttggttcaaagataataaatgttkgtggtaaatatgtaaagttacaaatatgggatacagcaggacaagaacgattcaggtagcttttctctaacttaataaaaatatttgaaaatttgatttaaaataattgatgatattctctcaatatataaggtctcactccctccccaacacaccccttccttgtcctaatctcagaaacttcatttttggaaactttgattgacaagacagctaaaatttaggttagctctctgcagcatggattactaaagaatacaggaggatctccgcgcaactgcattataattcggaggctgacccattctcaggaggatgtggcactgtgtattgtacagtatgtttctagattcaaatcaaagcacaagcttgtttttctgtgttccttttttaaagaagaactttttaaaaccttgtgagggtttgttttgttttacattaactagagcatgttctgatgtttgatacacactccacaaaatattctctccacactttaattacaatagggtcataactgaggctcagaatgacttcagtcactgcaaatgaggttacatgtttagtattctgtaactactaaagcaagaaaatagattaatattttagttgtggtttttgcacagatgcacaaagtcagaactgatattcatagttttataattmagtgaaataaaatccaccccatttgtaaacatttcacttgaagttgagtacatgtcgtatattaaataattgaagtttggctgggcacaatggcgcatgcctgtaatcccagcactttgggaggccgaggcagacctcctcacctgaggtcaggagttcaagaccagcctggccaacatggtgtaaccccttctctactaaaaataaaaaaattagccgggcgtggtggcaggtgcctgtaatcccagctactctggaggctgaggcaggaaaatcgcttgaacccgggaggtggaggttgcagtgagctgagatcacgccattgtactccagcctgggcaacaagagcaaaactccatctcaaaaattaattaagtaattgaagttcaataattgcttcaaaaataccataaccacctttaatcaccatcatttttctggaagcattgattaaacatggtggattcaattagacatttatgtcttccctctcagaaccccactgaaatgtctgttaagtaactgaaattgaagtaactcaaaaaggccaagattgagtgagtgcacaattatgattgagagatttccaaaaaaatcttaaagataggaagtagatggtgctctgacagcagaaggagctccaccttaagtactgtaatgggggaagccatttcttcctctggagtcccagaaaaggtcaggatttggaagcatcaggttctacaggaggtagaggttacagaggttcatgtttacacacgaaataagaggttcagtcttttacgttgaaatggagtctagactcaaggtcataaggcccacctgagggcatggggtcaggcctgaaaagagggaaattaagtgaaaatgaaagcctctggcccccaacccacctcccctacctcttccctggtcgctggcagccaggtgtgtatgtcccacataggagaaaggagccttctctgcagaaaaatgaatagtcagaaaggaaaggcttgaaggtagtgacattttgctttcccagtcaaacagcccagtctctatccagtcatctgaaagtgaaaccctccaagcccacctgctccacccacacataaagagcttcttttagactttttcattccttgctcttaatgatcaggcagaattttgaagaaagtttctatagcaaaagagagagctcaaagtaaagaagctggaactttgagggagtaagaaaaacacactaaaaccacagtatccttaggaagaagagcagagattgcattggagtatgtaatagaaacaaagtcatacttaaaaagagcaatcagaataatatgttaaataaactcatggtgaaaaatgggagagatgacataaagaatcctccagaattaatccagaagatgcaatgactattaggagttccagaagagagaagagcagagagaataatagaagaaaatgtttcactgaaggaatgagattccagattaattggcccacctaaaatcaaacatagtaaggaaaaagtccagaccagagcgtgccatgtgaaatttcagaacaccacagatgaagtaaggaagaccagaaaggttccaagagggaaaaagcagccacatataaagtgtgaaaaatggaattgctttgcacccttccacagcaacattggaagctaaaagaaatggaagcattgccttcaaaactcagggtgaaataattcttcaacctaaaattctaaacttagccaaactgtaagtgtgcaagtaaaggctgaataccaacagatgtgcaagaawgaggaggaagccaagattatctttctcagagacttcttagaaatgtactttcttagaaagtttaggaggatatacttcaccaggacaagggcatgatcccagaaagaggaaaatgaagccagcaggaagatccagctcagaatggcacaggtctagagggacagtgagggaagactaagacagcagtcagtatgtgatggcactgcccttccaggaggaccaggggaacaagtgaggggctctgtaagagctcacgactctgtcagagcggggaagaaacagctctgaaattcagtttcctaaaccttttgtagaaatgagaagaaagaaactgtaagatccatgagtgtaagggtttttgagttttctgtttgtttcccctgtgcccagaatagtgtctagcacacaggggcgcagtatgtgctcttttaatgacttaattaaaggaaacccagttaccagaaagagagaactcacctcgcttgtggagagtagggctcccagagaggagtgaggcaggagatggctgtgtttaatttagagacttttcgtgacatttcactttaaaactatccacatgtattatattggttaaattacttttgtaagaaaatgtggcacatatacaccatggaatactatgcagccataaaaaatgatgagttcgtgtcctttgtagggacatggatgaaattggaaatcatcattctcagtaaactatcgcaagaacaaaaaaccaaacactgcatattctcactcataggtgggaattgaataatgagaacacatggacacaggaaggggaacatcacactctggggactgttgtggggtggggggaggggggagggatagcawtgggagatatacctaatgctagatgacgagttagcggttgcagcacaccagcatggcacatgtatacatacatatgtaacctgcacattgtgcacaggtaccctaaaacttaaagtataataataataaataaataaaaggaaaaaaaaaagaaaatttaacacctcaaagtagtattcttaaatgtgtatatttgtatactggagtaatttgtataagaaactatttgtcaagacagtgttgtaaaataaatttgaaagtaaaattttaagaagtagatgtgatacagcttatcttgaagagaactcgtagttccctcttcctctagaagctaggtgcctgctgagcaagaatagaaaggcgctgcctcttaatagatgtgaacaagcgaggcctttccccctgccttaggaggctgtggggtgaagagcaaacagtccactctgcacctctacctgccaccagtccttaaagcgtgtgcctcttgstaacagtctcaaggcagagaggaaaagcttcaagctacatgaagaccttgaagcttcctgactaagagctaaaaagtacatttaaaagtagctcktctttgccaagcagcaaagtaataattagtaattttgtttgtttgtttgttgcaagctgcacgggtttctttgttctccaaggatagttcattcctctggtgtctttttttttctgacatcaagtctatggggtttttcttcacaccagccagtcggattctctgacaccagctgggtgtccaacacttcaattcacttttgacactacccagagttaaaggggaccctccaggctaaggagacctagactgccacccccgcttcagacaccagtcacaactggagtgcccaggcttcctgcacttcttggccaaatacagatctggcagttcccacaccctccatccctcacatccccatcaggttggagaatttgttagaatgattcacacaactcaggaaaaacatttttcctggcatttactggtttgttagataggtgtcaattcaggcacagcctggtggaggagatgcttaggagacgaggtatggggatgggccacctcccagcacctccatgccaccaccagcccaggagctctctgacccccatccttttggtttttttgtggaggttttattacaaaggcacgattgattaaaacattatccattgatgattgactcaatctccagctcctctttcctccccagagggctgaggtgaggctataagttccagcactctcctcactcggtgagggctcccacggccacagccccgatcccaaggctctctagcctgctactcttcccacagttatctccttggcttacaaaagacacctttatcactaaggaaatcacaggggtttgggcctctgtgccaggaacctgggacgaagaccaaatatatattttttaatttaattaggccacagttaagttctgggaatgtctagctagcagtggtccaggccctgtgctaggcactgggatcctctggtgagtgagacagcagagccctgccccatggaggggaggcaggcagccaacacagagacagagacagaaagagcatcccaccaagtgggatggtgccacccaggagacagcacgctgagatagagggggtccactggatggggatgcttggggaacgttgctgaggagatagwgttaatgagacccaagggacaaggaaagccagcggtgtgacgagcccagacgggagtggcaggggctgggagcagggaagagaatggggccaaagggacaggtacagtgacggagatgtcctgtcctgggccttgatgagttgggctgctctgaagaatggactgtgggccacacatggcagcagggacagcagcgtgggcagacacaggatttgtgtagtgtaggagactgcactaggctggcggagtgaatgtggaggtgcacaggaattgaggatgaatgtggagctgatttgctttagaaacagggtgcgtggtgatgcctcttcctaggccaggacgggcctggagggtgggaccaaaaagagtcctgctgtgcagatgttaagtttgacatgtttatcaggcagtctcatggagatatggaggcagcacttggatctgagctggagacaaaatttgagtcgaatgttaagagagcccaggacccagctctggggaatcgcaatcycagcagggcagattcagaagaatgaccagagccagagaagtggctggtgagcgggaggaagactagcagagtgcagggcgcagaggctgcgcgagtgagtgaggacagaaatgcccactccagcttcggttgcagagagggtggggaccttgacaggcttttggggagtagcagagatggacactaggttggcggtgaagaagaggaagctgcaggtaaagacagctctttcagaaagttggatgtggggccaygcgtggtggctcaygcctgtaatcccagcactttgggaggccgaggcgggtggatcatccgaggtcaagagttcgagaccagcctggctaacatggsgaaaccccgtctgtactaaaaatacaaaaattagccaggcgtggtggcgggtgcagctactcaggaggctgaggcaggagaattgcttgaacctgggaggcagaggttgcagagagctgagatcgcgccattgcactctagcctgggtaacgagcgaaactctgtctcaaaaaagacagttggatgtggagaagagcagacagtgggacagtaactgaaaagatggtgcagcatatttctgttttgtgttttaagatgggcggtaccagagccaatttatttttattttgctaataggaaaaatcctgaactcctggcttttttttttttttctttctgttgcctgggctggagtgcagtggcatgatcgctcaccgtcacctcaaattcctgggatcaaacagtccttctgtctcagcctcctgagtagctgggattacaggtgtgtactgccatacctggctaattttttgtagagacagggtctctctctcttacccaggctggtctcaaactcctggcctcaagcagtcctccctcctgggcctcctaaagtgctgggattataggtgtccggccactaatgggaaaaatctcacaaagagggtgagattgacaatgtaggggaaaacatgtatgaccaaaagacgccttcttgaatgtgagagtggatatgacatactgggacactcagttttcccgtagtaatagggcagggatgcaggtgggtgtagggccgtggtgactatggattcctgtggtgactatggattccaccgcgccgagaggtggcgagaactggaagagatggagaaaattgtgccagggagtggggtagrtgaggagcycgcagagaagtgagtggattgctgagccccttagtgtycatctagggggtggtgctggcttccgcagacagctcaccctgctaggagttctcaaaggagacatccatcagagagctgcatccgctgtgaaggaatctcctacttgccacagtgatgtgatttcaggcagaataacccctcacatgtatgttcaaatatctttgaatcatttctcttttaaaccagtgtctgtccctgtgttgtggtttacaaagcaagcatgggtgttttttcatgggaaagtgggatacagtaaagggtctcaattggttgaaagtaaaaccagtataattcttccaggtccgtgacgagaagttattaccgaggcgcggccggggctctcctcgtctatgatatcaccaggtaatgccagctycccctggtgaaggagggtgctcagtgccctgcagcccaaaggctggtcttggcgaggtgccctccgtgcagtgtgtgctttgtgtgtccagggacggtggtgtggctggcatccaggaagccccttagcccttccatctggggtctcagaggtctttgaacgagcccctaccactgctttcccctgcagagaaatgtgtttgtaaggttttaggtggataaagcaatccatgctattacattacayttcttgacatgatgcttggacactttccttaaggttcacaaagctttatgtatggaaagttattagaagtgagttgagagagggtgaggacacagactctgggctgagattgctgggttcaaatcccagttgcagtcactagctgattgaccctctcaggccaggtgcttcagctgcctgggccttagtttccttgtctgtaagatggagatagtaataatcacatgatcctcaggaggttattgggaggtttaaattagttaatgtgaagcagttagtagctgtttgtgacatatggcaatttaactgaaataaaaaattctgttcctcgattgcactggccacatttcaggtcctcagtagctacatgtggctggtgactaccatatcaggacagattatagaacattcctatccatgaggaaatcacattcagcagtgctgatctcagtagcactgtcttagaaatgtgtcatctaaatggcatcatctgggggccctttctgggtaggaacctgtccagtgagaggatgtcactcagcagccgcttccctcttccaatctgtgtcccgggagccaggcgttctgagaggaggaaggcagtttctggcccagcccttcctgcacttgcccaggcagtgaaaggctcagcctgctaaartgtgaagtcatcaatcaggctagcaaagtgccatgagaagaactcaatccttagacacatgagggccaaaaatagtaagtctgagagttggtcctggagtcagacagagctggtcaagtcctgactttgccactggctgctgtatgacctagggcaacgtaattaatctctctgggccttggatttctcagagaaaaggggaataatggcagtctgtgtcatggaatcyttataaagaatcaatgtgataaagtcctgtaaaacaaagtgctggcacattgcaaggattcattaagtggcagcaattagctatgaaatcttgcctaccagagtctagtgccttgcgcatgctaagagctcaatagatatttgtcaattgaatgaaggaacatctctttccttttgccccatgactgggcaaacgaaaaataacaaaatatctcacttgctgtctcattttaccagaaacaaaatggaacaaactgtgggtatggtatatacttggtgcattcacgttgtctgagttatcttaaaggtgttggtgccattaccctgaaatgttgaaaagcggtatgagtagtgagaatgactggaaagagttgctagttttataaaatacatgtattattttcacaatcttatattacgcagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatggcaagtgaccttttacttcttactatttttcaaatcgcatatttgaggataayagcatttctttgaatttaaaacatatattggaatttcaagattaaactagatttaggaaatgtggaatttccaattgtttttttctataaattagacctattaagcatatttttagtatattgcattctgcctgcagaagttactataatgataaaagcaaatgtagtaacattatgtaatgacttttcagtctagggtctttgaatattagagatcttgggctaaagtgaaattaataatatttaaagactctaaccaaatgatgtcattattttttaatgtattttgaaggaaatttggtgaaatattaacccaaatagaaagggaagcggaagaagaaatacttggctttttggcttcattttaagtcatttggttatagacaactttgaaacttttttgaatttccatatagaatacatgaaaatgccacataaaattaatggttgcttaattaatggataagagaatgattttttaaaacttcagacattttaaataactttaatttttagaaccaaaaactagaatcctaatatcaatatttggactctaagattccaaattatattgtaacttgactagtttcttgctaagaaaataaacatgagagaaatccatatgccatcatgacagtttttaaaaagctgtttagaaatcagaagtttagaatgttaacaaagatgaaaaggaatttagatgtcatctaaactcatttttacaagtgaggatacaagaggctagagaggccatggtttgctgagagagcaagcagaacaggcctttctgctgagatgaacagccactctggtgggtagaaagagtattaattcctatactgtctcttcatgggctgtatgacagattgcaatatagtcccctaaaaagtgtaaacacttgtaggtcatatttgtggtgacactcagattgtttgaagaaggacattgcaactttccctgaaatcaatggcagggccattttggcaagccagctcctttctgatgggctgtcatttggctggggaagcctggttgcttgctcagccccttcaccaggttaagtgctagcacaagatagcagttacttttcagaaaaggctaaaattcttttaacatttaaaaaacacataatgacatatattgattttatatttacagaaatatatggttttaggtcataaattatatttcgtctgcttttctaagagaatgctacacaggcttttgtaagtgaaaattatgatcatcttctaaacatgactttattttgtttgatgtccattttagagctgatgtttttggaaacaagtgcgctcacaggggagaatgtagaagaggcttttgtacagtgtgcaagaaaaatacttaacaaaatcgaatcaggtaaaagcctttccattaagcaacttttcttctgcatattttacactgtagctcagtagatcaccttttaattaatagtttcagggtgatttagtaaagaatgttctctctctacctgccaacctaaaatcatcacatatgggttcaaaggtcctgttcttatcaggatgaaagccccrtccttatcaggatggtttccatggtgatgaaagtggatgggcacaccagctcagctgtggaaaggtagtcaaggtttcagggagtgtttgcatttagaaccatagtctttctttggtccttcactaaacggaggaagaataggcctttgtccactctgtcaacagcacgctaattctgttgggccagtggtcatgtgtaagggagttataggtacatggtatagtgttgattgttgcagatcgggcatcatggaactatggagtccagagtaattttrtttctgaagcttactgagcatgcctcaattataaaatgcctcatttttgtatttgcttattaaaataatttaaaataatcctaatgtaggcagctgacgaaatactgtgtagttgtcatttactaaagtaactatatatgggcatcaccttttaattgattcattcaaacatctgagtgcctatttgtcagatgctgggatacaaaaatgaataaatcacaccccttgccccccaagaaactgtctttcatgggagacagtcagaggataattataatatcacaaggctgatgtagtagctgagagatgcacaggctcagggtaacgtgaagaaggggacctgccccagccagaggatagaggaggtgtcagggagggctttcaggggaggtcttagatgagctcagtctttcagaatataaggaagagtgagccagcaaagggagtgaggaagagggaatagcaggagaaaaggttgaagaaaggcaggagccagccagtcctcatcaaggatctagaactttatcttgtagattaccaattgtcaaccctggatgagcactagagacactgagatgcattaaaagttctaatcccaggctctgcctctggagacgctgaactaattgggctgaagtatggtcgaggcaccagtgtttttaaatgtttactcatgctgttctaatgttcatccaagattgagaaccactgctgtaggtggtgggttgtcagcaggtgggtgatgtgattgggttgtgacttgagataagtcatgtatgtaggaggttatgttgaaaacaaactgaagggaggacaggcctggaggccaggataccaattataaggcatttttgagtaatcctagtaagagatgactgattaatgctttaacaaggatatggaagcagagatggagagagagatggatctaagatatatttaggcagtagcatcttatgactcatatgcccaatagtgggacaggacaactgactcttaggtgggacaaggtgaggaggaagggccagcaggggaggaggaaccaaggatgactcgcagctgtcacactggtgtctctagacagagatggggtggagccagaggagaagcagggaatgtgagggagtaaagatggctctgttgcaaatgtgcggcctttgcggtaacgctgagacatgaacatggagttatctagtaagcttggggaagagttcctggctggcagtataagtttgggaaccatcaatatataggaacagctaaaactgtggaagcaatgtgatcgtccggagaacagtgtttaaggagagcagtgatcaacagaaccctggagttggaggatgagcagaggaagaggaatctacaaaaaagatgaaaaaggaaatggtcggaaatgtgtgaagaaaatcaagggaatgtgggtgtcacttaagccctaattataagcaaatcaaaggagtgttcattatgtaatgtaatagtaacagagggaagcctcataagctaagactgagctgaaaaacacacattgggatggggaatagaaagtcagtgatcattttgatcaagaacaatttcagcagaattatgaaggtagaagatggctggccgtccgttaggaagaagtaggaggtgagcaagcagagtgtccactcctctcctgaggaagcacaggctggcactgtagggtgcaaagggttaatttaaagctggggttgtgggtgatgggagaaattccagcatgtttaaatgctgagggggaaggagagaagaatgggcaaggagagggcagggaagaaggagggtgctaggtgaagtaggagggaggagagtcgggcccaggtagaagggctgggtttcaacagaagtggacatgtcatctttttgtatttttttttatcagaaagaaaaaaaaattactaagcttggtacaaaaaccaagacactgttacataaatccttacagttggcttactgttgagtattattaagctcagcatgaggttgtatttacatgaccttgctattttaatattgtatccctgaatgcatcagatagaacaactcatatgcagtcttccaagatgtgtttttttctgagatcatcaaaatcataagtacctctaggtgaaaaaaatataagagtataaattaggattcttcagcagtactttttatttttttaatgggtaatacattcagaaaccattgttttcttccctttttttatataaaatgtatcatatgatagactaccacgccttgcttttttacttactattgtataacctacaaatcattacaaatcagcttatagtttccgtatatacatataatacataaggtacatatatataacataatgtcatacataatgtgtgtgtgtaatgtgtaatatgggttgagtatccctaatccaaaatgttccaaaatctgaaactttttaattgccaacattgccactgaaaggaaatgctcattggagcacttcaaatttcagattttcagattagggatgctgaactggtaagtataatggaaatatttcaaaatctgaaaaaatccaaaatacttctggtttcaagtattttggataaggactgctcaacctatatttggataaggaccgctcaacctatgtgttaccataattcatgagccagtctactttggacatttgggttgttgccagtattttgctattataagtaatgttacagtaaataattatatatatatatatatatatatatatatatatatatatatatatatatatatatattttttttttttttacaygtgcatgagtctgtgtgtcagacaaatgcccasaagtggaattgctgggtcagagaacataagcatttgggatcttggtgtagaggctgtcacattttctcctagtgatgggcttatttcactaaagccatgtccacagcatgtagtatcatcatacttggacttttggcccatctaataagtgaaaaattatatctttgtaatttaattttaaattattttatataaataatgtattcacataatttgaaattcaagaagtataaaagagtatgcaatgaaaagtccccctgttaccaccccctcctgtcctcagccatctagaactcctccgaatcagccgttccttatgtatcctgctagagatgttttgtgccggtgcaagcaaacatatatatagttttttccctttattcagaatggtgggatatatacacagtgttctgtactttgctttttttttttttaatctatttttggaatcaaagaaacataaaagccttttttaaaagaagacttgcttggtccttaggtgagctggacccagaaagaatgggctcaggtattcagtacggagatgctgccttgagacagctgaggtcaccgcggcgcgcacaggccccgaacgctcaggagtgtggttgttaggagagcacacaggtgggtttggacacctccctgccctgagttcctggcaagctcaagtgcagaggcctgttaaagctttgggaagctgcagtatgaaaaagagrggatcccagccgggtgcagtggctctaattccagcactttgggaggctgaggtgggccagttgctttagttcaggagttcgagaccagcctaggcatcatggtgaaacatcatctctacaaaatacaaaaaattagccaggcgtggtggcgtgcacctgtagtcccagctactcatgaaacttaggagaattgcttgagcctgggaggcggaggttgcagtaagccaagatcataccactgcactccagcctgggcgataaagtgagaactgtctcagaaaaaaaaaaaagagaaggagaagaacccataagttaaagttggatgttctaactgaaagaatttatactctataggaaattcttatgctcttgttcagaaagaaaggaagggcaggtggtggttgatgggaagggtgagatatcctgattccttatgtcagtgaggagcccttcctggattgattgaggtctaaatgaatgtgccttttgctaaaacaggaggcctatttataaaattgacaaatgtctccctttaactttttaaagcttcttcttttttcccatttaccacagtggacgttttatttatagtcgacatcatgtagtaggcacaggcaagtgttaaaagacaagatattcacgaattctcttttaggctttaagctgtatttacttttgcatttatagttatgcagattttgaaattgttcttaatattttttaggtgttcatacagtggcatttgggacacawtcgttggaacctgaagaatctgaagttttttttaccaccatctttttctactctgtawggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaamtgcagtttcagattttattttttttaatcatatgaactaaaattgtcaattgtraggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcytcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacmccatatatccttctgcatcctttggccaataaaagttgctggagaaccaaaccatggtggttcttaatcaggctttgcctttagggagaatgaggaggagagataattgggtattgttcaggctagtaataaatgtcatgtttctatttcccgcaactcattargttttcaggaagctcttaatttagatttctaggaaagtaattattcagtcttcctagaaaaagattataaagaccatttaaactggagattgtaatttattcttttacagtccagcatttaagtgaaaatgagaacatcacaatttgggaatctgtaatggttttgttgaaaacattacttgtggcttgtataagagtggctgaattcaagaacattgattcttagcagatcaataatagtatttaaagaatctgatgctaaaattagaaacctaaatgatttrtaatttgtactgtgacacagcagatgatgtttccttattttctgacatctttttatgtttttggagaggcacattagaggtgctttaaaaaaaacctgtgaatttttaatattttgtggtgccatttgtgaagcacctctttcctgatccatctaactactcctgtacgtacagtctgagtttgtcccacttgttgacttggttacttccctattgtatttatttctttaaagggttgttttagaattttagaggaatttatctgagaacacaagatctaccactttcagtaggacaagtgacccaagttgttggtcaccagcctcaaagtttagaaaacactacctactacctactgatagaaaataatgtggttagggaatctgtttttttcttttaaaagagcatttatgtacttttttccttcatatatccccctcattttttttctttttctttcttttttttttaattttattttttgtagagacagggagggtctcactgtgttacccaggctggtctcaaactcctggcctcaagggatcttcccacctcagcctcccaaagtgctgggattacaggcatgagccaccatgcctggccccccccaggtataatataatataaatataaatttatattatgaattatatagattctccctttatatacttataaattttttataacagattttcaaatgtagagaaaaatagcctaatgaaccactatatcagccagctttaacaattgcctacattttgcgatcttgttttctttatctttacccagcgttttcatactatggtacttgaaaacatccgaggcatctgtcatttcacccaaaaatactcagggccgggcgcggtggctcacgcctctaatcccagcactttgggaggctgaggtgggtggatcacgaggtcaggagttcgagaccagcctggccaacatggtataaccccgtctctactaaaaacacaaaaattagccaggcgtggtggtgggcgcctgtagtcccagctacttgggaggctgaggtgggagaattgcttgaacccaggaggcagaggttgtagtgagccaagatcatgccactgttctccagcctgggcaacagagaaagactccatctaaaaaaaaataaaaataaaaaataaaaaaaaaaaattggtcagtatgcatctttgacaatagcattttctaaaaattttatgaaatttccataccattgggaacttaacaaagccaaggctatttatgtttttcatatcttgcaatcatataaagttggttttctgatatgtgctaaaacagcaaaatgtgtctttcgtgaagcattggagacagtgacttcccagcatgtgtccagttgtacagaagtgctattccctggcccaggggcagttgtacctttagcagggayaccaggaccatcagcctgctatacatagccagcatgsstttggagggctggtaccccttgttgtactggttttaaaacactcctgccaatgtagtaacatgaggcatatttactttaaatcatctctacaaatttgaagatatcatcttcaaactactctatttgaagaatgtattttactgtaaaggcaacatttaactttgatgcatgcttgtccggaccatatgtaactgtatacaaggggggttgagccattcctttttttgtttgttgttgttgttgtttgtttgttttaattttcagagacacagtcttgctgtcacccaggctggagtgcagtggcacaatcatagctcaccacagcctcaacctcctaggctcaagcaattctgcctcagcctcctgagtagctgggactacaggcatgcaccactgcacctggctaatttttttttatgtcttgcctctgtgtttcctaggctggtctcaaacttctggcctaaagcattcctcccaccttggcctcccaaagccttgggattataggcgtgagccaccacacctggccctccatttcttaaacttgcaataatctggtgtgctccttcatgctgaagggcactgtcgtgaaacttctgtggaaaactccatggaaattggataagcctgtgctctcaaaactctcttaacttcttgatgcaatgtgtaaacttcattttaaagaaaactagagtgaagaaaacaaacttgcttaatttctgagtattttacattctaagatgtcatgaaaataattatgtttactaaatattgaaggaccaagtaatgatgcatgatggtaaaaatgctaatttctgtatgtttggatgtgagccctcaaataattttaaattgaataggaaattttataatatgattgattttaggtaaatctaccacattgttagcttttacagaaaagtcatcatattggtttgcgtggccataaaggtacctaccatgcccttatactattctcacttccagcagaaaatgctgcttttataggacactcgtgaacctctctgaacgcctctggctttctcacagtctctgtggggactcaagttcctcacctggaatgctcctcagccagccctctaagtcagtcgagcggaaggcctgctgctctttggggtgcagtgtgcaaaacttctctgctgcggcgctttctctgacctcagcatatgcagacacccaactcccatgattctctgtctggacctcctttcttgctattgatctcattgattgtaccttgtccttgtttgtcttctctcctgggctaagagctccctgggacagggctgctttggtgtgcctgatgcctgacacataggagggaccccagggcttgtgggaaaaaatgatcacagagccaactgtgtccctaagtctttcaagggtatctgcatatcactggtgcagcctttccactgcaagatcccactttgcaaaatttccaaacaggcagttaaaacccttccttcctgcagtaggtcgctttgtttttgaatattgatgaccttccgggattgatagctcacaatatgtaggtctcatgttttgttgtcaggtaaacaacaacatgttggggattctgtctgtgcactcctacttgactcctggcacatctcacagcacagcctgtgaacaagcagttatgcctgctgtgttctccatcttagcagaattcgatattgtaggaatagggagctttacctcgagggttgtcagatgcaattgaggatataattgtcaataaacctctgatctaaagcctagccatgatcagctgttatagtattttatgatgcctcataaatgattaggggtgaaatgtgttgaatctctcacttctgttaattacacactctaagttacagttgacaagtccccatgttgaagcagaggccagaactataattagatcttggaaacttagtaactctgctgccttttcaaaggaaaagaggaatgacaaatagttttcctaccctaattttaagactcactcttttcacctgacacttaaattctgaattctatttaagttctttatgtgtgtttctatctgattttccaacttcagccctatctgagctgtgagaacttgactcctgcacttggagagagcccactgtgaggatctgcggttgccgagggctccttttgctgttcactgcatctcccgtcccttgtcgaagtataggactcaatgcccacctttcttttcttccttaaaaaccatagtgtgccagagaaacgctagataatatttagtttaacaagaacctatttctaatactatccattgaaatgtctataatagtaaaaccttgaaggggcatagcatattttacaacttaagggtattctcacatttagaatttaatttaaccttcagaacaacccattgcagtggtcatagcaggtattaggcccatcttacaaatgaggggcccgagccgcccaggcaaggggctggccaaaggccaaacccagggagcaggcagcagccttggttgcaggtccctctgcacagcacagtggatgaggaactgggatttctgttgactggaatctttttttccccaacattgtattatgaaaatttcaaatattatgaaaatttgttttaagaactacaagcagttctgattttaattggtataggagtattttccatttaaaaaaaaatttttttttttgagacaggggctcagtgtgtcaccctggcaggagcacagtggtgcaatcatagctcactgcaacctcgaactcctgacctcaagctrtcctcccacctcagcctctcaagtagctgggactacaggagcacaccaccatgcccagttaattatttttatttatttatttatttattttgagacagagtctcactctgtcacccaggctggagtgcagtggtgtgatctcggctcactgcaacctctgcctcccaggtccaagcgattttcctgccttagcctcctgagtagctgggattacaggcatgcgccaccatgcccggctaatttttgtatttttagtagagacagggtttcaccatattggtcaggctggtctcgaactcttgacttcatgatctgcccacctcggcctcccaaagtgctgggattacaggcgtgagccaccacacctggccactaattatttttttttagagatgggctctcactattttgctcaggcttgtctcaaactcctgggctcaagtgatcctcctgcctcagcctcccaaagtgctggaattacaggcatgctccacggcacccagctagtactaaattatctggagtgaggggtaagcttctatcatcattgtgaaaccatgttttgattttttttttttaaatcttgcaagtttggtagcttgctttttttgactctgcctccagcaaattgaattcagtaaattaaaagtattacaggttggaagtacatgagtgaaaatgcatgtcaattggctttcagaatgcccgtcaccgtctacttctcagcggttaaggcagtctggtactgacatgttggttagatctttctctcgttaaggtgagaaggtgcctgtgaggccttcatggggaggctgttctccacactatgtgattggatctgcctttctagctgcagcagttagtgtattcattctggcggcattcctgtgctgtctgccaataaactattgacccacgctagccctcagctgtgctactcatctctacttagtctttgagcaacagtagaagaaaaatttcattattcactcatgaatttttctttaatctgtaactatgcaattattctactactggctatcctcttttcctcttttttatttccaggaataattttggctttaaatgctagcctgttgctccagacttctaccatatgtagttacattttaggaaacgtctagtggcctgaagtttaggcacagagtctggtgtttgttcacagggatcttctgtggggatgatactttactctggtttgttccatggctgggtgacattatacaggtttgttccatggctgggtgacactacacggcaaaggaatacttgagctgggcttcaaggaaacatttagctatgtggtcattgtagaaagcacagatgacaaacgggggctgagtgtaagtatccacaagtgatcacgggtcaaggcctgagggcaacgcaggggcaggctgggttgccatgcattgtccatggggcagcatgagaggctgtcctaggaggctgttgccaggaagtatgtgcttggtccagacttcccaggttctcgtcaaagaccagacagcaacctggacacagaggaactcctcagttcttctgaaatcctgaagctctaaaacaatgaaacagaaatggatgcagcagctgtcataggtattagtcaatacctaagtgttaagaacagtaaaacattaactaatagcgatgttaattttcacaaaatagtcatcttttttttttttttttttttgggagatggagttttgctcttgttgcataggctggagtgcagtggtgtgatcttggctcactgccacctccgcctcctgggttcaagtgattttcctgcctcagcctcctgagtacaggtgcctgccactacgcccggccaatttttgtatttttagtagagacagggtttcaccatgttggccaggctggtctcgaactcctgacctcaagtgatccacctcggcctctcaaagtgctgggattacaggtgtgagccacccgacatgaccaaaatagtcatccttaactggtttggaccatctttcattagtaaaatcaaaagcatatgtgcacagtaaaattcctagctgcagacgcaggctcacctcccacagccaaccccttagccccttgaactgctcgcatgaggacctcagacacacttctctaaacaccccttttcatatgaaaatactggaggcagagtgtccttccatttgtgggtttctatttttatttttgagacaggatctcagtctgtcacccagcctggagtgcagtggtgcgatcacagctcactgcagcctcaacctccggggctcaagcaatcctcttacctcaagcctcccaagtagctgggaccgcagttgtgcactgccatgtctggctaatgttttgttttgtagagatggaatttcgctatgcttcccaggccagtcttgaattcctgggctctagcaatcctcccgcctcggcctcccaaagtattgggattataggcgtgaaccacgacacctgacccatttgtgttcttagcatgctttgagactgttccacgctttccttttttgaatttcccccctgccaaggtccagcttatgactagaggcaggcagtgtggatgtgacacagtctgatccgtgtcctgcaccatgtgaacacctttgttgagtgtatctgcacatatggatgtatcagaaaacttttaggagcaaaattgctaaatcaaaggcatactctttaaatatcaataaaggtacattgccctctgaagaacttgaccaatttacactcccacttacagagcaggaagcccaaccatttaaaatgcacaactttttaaaagagatttatggtttatatttttattgtaatattggccatcaattttatggtagccatgaagactgtgtccttttattctacaagtagcagtcacacaggcttctggagcgtcgcattatgacgtacacgtcatgggaatccccggtgacagtccctgctgtggaagaaagtggagcagaacctgggtccagaacaagggcaagatgaagtcagacctagggcttttggaaatgctggatgagcatcagcagcagtctgaagatgctgtactgtgtattttattgtgggttaacagaatcatgtcaaaattctgttcctagaaaaagttcattgttttggtgaaaatccaggatttataccttatcatccaaaaattgcatgcagagttttaaatattgtaatgtgccagagccccattccagaccagcaggcagtggaggggccccgcgctgttctcctctccgctgccagacagtggcctcctgagtgggaagctccgagcaagagcccaaagaacattcacttacaggacctcccaggtggctcagttattagtctagcttaagaatcacacagctgagaatcttcagtgggagggcatatctttgaagagtgggtgtttgtatctgtttctcttttgttttctctaggattattttttaatggctaatgcattcttaatggtttaaaaatcaaagccgcatgagaaggtgaacactgaaggctccctgcccatcccatcactccatttcttcctctagccctgcaggtaaccactagttagtttgtgaatcctcccagaggttcttaatgtagatacagatatttttattagccttccctttcttaaaagataacatgttacatacaccatcttttgtacacctaaactctatcttggagcttttccacttctcagtacattgagagctttctcattaaaggctgcatagggttccattttgtggaaataatgttttctttagccagtttcttattgatgaactgggtcatttccaattgggtcatttctagttctcttttgaggtaattgcaaaataatttagttaaacagcatccttaatttttgttttcactgatatgctcctctcatttatcagaaaaggtaataattttccttccaatttaggcctttccctatacattggcaggaaccatttagaaaatttgatggaagtagggagcaaatccaacaagaggtgtgcaagactttttattcatgaaaactttaaatcctgctgaaataaatataggaagaccgacctaaatggagacatactatatttggggataaaaagactcaatattagaaagctgttaatcttccaaaattagtaaattcagtgcagtttaatgaaactgccaaatggaattaaaaatagaatttgacatgctcattttaaagttcatatttagaaaataaccaagaaaagagaacaaggtgggcatgtggagacttggcctcccagatataaaataaactgcaaaacttattttgcagtttaaaagaatatagtgagctcaggtttgtccaaactgatccacagaagagcagcatctagaaaccttcccatgtatctaagaaaccttcccaagaattttttttttaaatgatgtaacactttatatcagtaaggactgttcacagatggtgttaaacccatctgctacccatttgattaaaaaaggaaggttgggccaggcagggtggctcacgcctgtaatctcagtagtttgggaggctgaggccagcagatggcttgagcccaggaattcgagaccagcctgggcaacatggcaaaaccccatctctacaaaaaatgcaaaaattagccaggcgtggtagttcatgcttgtagttccagtgatggggaggctgagrtgggaggatcacatgagcccagggaggtcgaggctgcagtgagctgtgatcacaccactccactccagcctgggcaacagagtgagacttagtctcaaaaaaaagggaaggttgaatttttacttcatattcaaaaaaattaacttcagttggattaaagagctaaaactagaagcaaagtttttcttctaaaacattggaagacaatattgcattttttataatcaaagggtctttctgaaagtgacacaaagtccccc

SEQ ID NO: 10614 - DNA, 193757 bp, Homo sapiens
accatgaataagctagagctgtgaggcagaacagaggtgaacacaagacaggtgacgtggagaaaagcaaagtggcagagcactgaaatgaagctatggatgcctctccagtttggtttccgctcttcttgaaaaccaattgtttgcctttaacaaaaatataaacaaaatgacaaccttgtgcgtcatgacaatgagtcgctatttaaccagaggtcacagtgagctattcatgggatttaaagaagacagcaacgtaagcaattttagatagtatattgggaaagtagtaagaccattctgaagttgccctttgagccattccactgaggcctaaccaaatttcaaacaagaaggaagcaataattcttttgtttaccttgttacttgaaggggaataactttctacttaaaatattatgctagccatgtggaagatagattatgtgtgctagaatattagtaatttctttccttttcagagccaattatgcacgtttcagttacttaagggaaagtctgtataattcaacattaataaagaccgttctatacatttccaacagtaggaggaacttaaaagaattgttttgcccatggcaaagaatgccatgcattaaattcaagttaataaaaaatttgtatagttcccaatattagtaaggattacttttggatggcgagatcatggttcatgttttataataaatatatatcactattataatgcaaagaaaacaaacttagagaataattgaagacttgtttgtttcctttctatttaacaaaacagattttaagtcctagtggtctagttaaatctatatgaggttaggaaaaaagttatataaagtgtcaactactgtttttcacattgtacaaaaacattgatttgacttcaaagaagacagaatgattataagaaatagactaatctcaaaggatctaggctctactcaaagtcttgtatctgtgtcgtatattaattgaaccagttacttcatctctctggtctacatttttaaatctgtaaaatgtgaattggacaaaataatctcaaaatcccaattacgtgagtctcttaagcctttatgtcactactacttggtattactacaatattttccaagtttaacttgcaaagcttgtaagccacttgaaattatgtaaaacctctcaagtcgtttagaactacccacagaaaatatataaagcctaagaatcaggactaatggcctgaacatataatgacatgtttaactgttttggtttctctaggcagaagcctagagtatttcaaaaggaaaacacaatgattgaaaattgaatacactaaatcaaaaatattttcatgactttaactaaatagaaaaagtctggcctcaaatatagccaatgaagagaagaaattttacattactattaccagattttgcatacaggcccatactgcatcatcagaagattacagatttggattatacataagtggttgcctatttgaagtttaaatttacttgtaaacctctacttcctagagttgtaaacacacactcaccctcacacaccacaccaccaccagaaccatacacatatgtatcaaattcaggttttctagttttttactataaaataacaaatacaaatttgaaaatagcaaagtattccaaagcataaatgataataattaaaaacaaaatcttgatacaaaaaagtaggaaaatgaatacagataccaatagggtatagtttgtttcttttaaaagtttacataaaattctattctatttcattaaaaattaaaagttcttttttttagaagaaacattgggctcaggaaaattaaacacctgtaagatattgaaaacatttaagtttgcaaagttataataaatacaaagtataagatgccaaagcaaatttagtgtgcatgaacacaacaccaggaagagtcatcctatttccaccaaatacattccctcaatatctatagtaagatataacccccaagaacggtagtaaaaaatattttttcctagcatttttggaggctgctgggcttgctgatattagcaggttggtctaggctaaaaggaggatgtgggagaaacctcatcaaagtgatgattcaaaattcataaataaatgaacacacgggggaacattttaatcactcccacagtagagtaaatgaaataatggcagacacccttaacgaactatacagccaaggaagccacaagtaaatacaatatatccaagcttcttccaatttaaaagttgtattaagaaatgcgtacataggccgggcgcggtggctcatgcctgtaatcccagcactttgggaggccgaggcgggcggatcacgaggtcaggagatcgagaccatcttggttaacacggtgaaaccccgtctctactaaaaatacaaaaaattagccgggcgctgtggcaggcgcctgtagtcccagctactcgggaggctgaggcaggagaatggcgtgaacccgggaggcggagcttgcagtgagccgagatcgcgccactgcagtccggcctgggcgaaagagcgagactccgtctcaaaaaaaaaaaaaaaaaaaaaaaaaaagaaaaagaaaaaagaaatgagtacatagtaagagaccttaaaatgacactagtgcaaaatagattggaggatatggataacaaaggaggacagcatctcacttttacaaagatcttcagctcccattttcaaccttgggctacagtcttaattcatacggcatccttccagtatcatctgccatgcctgaaatctgtcatgagaaatccatatctgaaacacggcagattgatcgcatgcttttattgtctctttcacgtcaaaactcaagcaatgacaaatgaatacaaatgaggatagagaaaagaggaatgaatgaacaatttctacaaatttttggagaacagaatacatggtagagtcaaggcagctacagtctaagtgcttactgaagggggaccttatgtcgcgccataaaagtcatgagaagcaccagaagtaggggtcacaaaaaagatggggactgatcttcatagagcgagatcaactgccagatttcggtctttaccccaagcaatcaaaagactaccccatccctctaacagaaaagagtttattttctggcaaattcaaacctgaaaagctacactgaagtatactaggcatagcagtgagacttgggactgacaacctaagactaaaatgagaatgtacatgttgaacttggggcacccagcaccctttccctgccttgcccccagaacactggtagcaggtgtacatcttccatgtaggagcggttggcagtcttctctgggtgtgtggggagtggagtctaaatacatgtacctgaagcaagctctctgtctaatcttgctaacacaaaatccaccaccaaaaccttgcccactggcagggtgccttcttttttttttttttttttgagacagagtctcactctgtcccccaggctggagtgcagtggcacgatctcggctcactgcaaactctgcctcccaggttgacgccattctcctgcctcagcctccccagtagctgggactacaggcacctgctaccacggccggagaattttttgtatttttagtagagacagggtttcaccatgttacccaggatggtctcgatctcctgacctcatgatctgccctccggcagggtactttctatcagtttttagtgattcactcattaatatgaatgaacacagaagaatcttaaccgtagagaaacgcctccaacatgaaatgggccaacacgaactggctaaattacctcagaagaagtagtggcaccgcagcaagcagtataccaccaaaaaaaaaaaaaaactgcaaataatatcctcacagtgagaaaaaatggcacatccatgagagtaacagtatgctatgaagaaggggcaaaaagacaacttaaaaagagctcatggagctaaccaatatgatcacctaaattaggatgggagttgggggatcagcaaactgtttctgtaaaaggccacgtagtaaatattctaagttgcaggatttgccatctctcaactctgccattgtagcttgaagacaaccatagacaatgcataaaagaatgcacatgaatgtttctttatttacaaaaacttaattttatttatattgcttgacccagtggtatcattgctggatttgattgtgccataatcttctgacatctggccaaaatttgtaataaataaataaaagattggatcataaagcatagacattactctgtaggatggaaagagataaagagatggaaaataggaaagaaaaaccaaaggatcaatccaggaaatccaaaatttgtccaatagaagtttcagagaaagagaacaaagaaaaatgtggagagatcattttttgaaacatacaatacatttgtatagaactgaaggacacgtctccatatttaaaaagctcactgactgcccaaaaactaacgaaaaaaaaaaaaaagcacgaaccaaagtatatctgtaaacaatttccgaataccaggagggaagaaagtatcatacagaggaaaaaaatagatcatacacaaagaaataagaatcagaatattgtctgattctctacagtgacagtggtatgggaagacagtaattcaatgtctcaaagattctgagggaaaattatttaccacccagaattatattacagcaatctatcaatcagtaatactggactaaaaaacttagacatgaaatttttatttcacatgcaccctttcctaaaaatctattagtggaaggtgcttcaacaaaatgagtggtaaactaagaaaataaatacatggaatccaggaaatagggatcctgttctggaaaatggtgaagtactaggtacatagctagarttggatattggagccaagaaatggagtgctgcaggcaaataggattatctgaaatgcctgagtgtttggaaagcttcggcatttgacatatatatatatataatatatatatatacacacacacacatatatacatatatacatttttttttttttttagatggagcctcgctctgtagccaggctggagtgccgtggtgcaatcttagctcactgcaacctctgcctcccgagttcaagcgattctcctgcctcagcatcctgagtagctgggactacaggcgcctgccaccacgcccagataattgttgtatttttagtagagatgggatttcaccatgttggccaggatggtctcaatctcttgacctggtgatctgctcaccttggcctcccaaagtgggctgggattacaggtttgaactactgtgcccagtccttgacatatatttttaaatgttgggacaaacaacaagccctagatacagacaaaaaagcaaatgtaaaagaggtagagagagaaagaaaataggaacaatccttaaactgcaagaaaagcaaaacgctgaatgagaatggcaacacagtctagtacaccacttaattcatcagtgtctttgtttacacagtgattgtgagtcatatcgcctatttatttaatactgtaataataacatattaacatgggaagcagggagagtaaatgatactgaatcctcagttaaaatagcaagaaattaaaatatcaacaaaattcaaaaatattataagaattaaacagtagctaaaataaaatgattgcacctaaaaagagtaattggtaagaaattgagagggaagagcaaggatgaatgtttttaatacaggccttttctcctatttgctttttaagctacagtatgtgcataaaatgcagttctctgtgcttccttaatactttccatttctcagactcacctattaaatttcaagaatcctgagaaagctaatactataagccattatcagctaataccataggattcatttgttgataagtggaaaaatgtccaaaaagaactgggtcaccacaggcacctggagacaaagtggaaatgaaagaaaatcagtaaggaagaggtaaggaggtgctggggggaaattgaattgcaggacactcagttgatgtccagagagttggagaattggttggtatggaaaaactccacaccctggtgtcagaagtgtggagtatataaaaaaacaattttcttttcctttttaatggtggccaatgaaaacccaaaaggagattacatctaaggtgacaggattatgtgagttgctccctacttgctctccaacgtcaacaactcagaaagggatttttctggccacagtatcaaatggtcattgccctcatccttgttagtcttcttcacagcacttattactagttgacattgcagtgtgtagctatttttattttttaccatctcatcaacaagaatgcaagaagtcctccagtggaaggcactttgtcttattcwctactgtatccccagcacgaagaacagtgtaagagtttaataaatactcattgaataaacaagttaattttatttttattaaggatctgtggcatttgctacccgggactaagtaaatttttgctcgagttacaatattgscacatgggggctctgctgttagttgcaagagtatcctaagcattccccaacattcttaagggaactgttcaactgggaatggccacagctacagctaccaagtactaacagtataaggaaggatcctctggtttgacatataggctgatatattttagagtaatataaggacccacagactcctgttctctgctacttcattgcaaactatgcagggattctcatttgtcagaagtttaatatctttcagatctgggccctaaaataaaaacgtttttaaatcagacattgtttcagaaacaaaaataaaaccaacctatggcatagctgtttctttatcaaaatcaagattgtctattatctttctcctcctggtgactggggaatttaattcctaacgctgatataattgccaggaagtcgaattttaaaacacaccagtgtatccagttgaaactattatatacagtgctttaaaaatacaatatgaaattttcttcaaaaactcttgtcacctcagaatacatgtgaagtggatatagcaaaatgttatgataccatttaaagaacactgactgactttacattcaaagcacagtcatagatgcaaagtaaaacatcaaatattaaggtataaatttggttaagaggtttttatagtccctctaaaagtcttttctccactgtgagaaaatacaggaaatttaggaatatatataaaactagacgttttacaatgtgactctggtgccacatgtttcttgatggaatttgttctgaaagaaaagctagaaaactgatttctctcagcttaagtgactacaaatgaattttgattgctatcctattaataagaattttttgtgcctcagttagatgaacacttcaatggcaatacaaaaattagcagatttatttagcaagtaccaacaacaaataattgctgttgctaagggtaaaaaggcaattgtgatgggatgtgaagaacagaaatcctggtgatatgaatgttaaccaataaagttctcaaacttgccatttagcgcattcctgaattctctgayggcataaataccacaaagtagaagtacaactttactctaagctctaagtcctgtattactcaaaagttcttcaaatcttaaactgctaccaagaatgaatagatgcccmaaatatccactttggggctggatattctgctcaaattaatgaatagactcttgttaaacatatatgccatgaaaactgactatgtgcaagttaaagcctacaatgggaaaaccaccaaatgcagaacatggaaaaagctaaagtccaaatgacgtggcatccaacacatcaatggcattacaaaatgaaagagacttcaaatacatcaaaaacaaatgcaatgtgtgggctttttctaagatcttgatacgaacaaacctacttgaagaacttgttaattttattaggtataataatgctagatggttaaattaaaaggctgttaggaatgcatcctgaaatgtgcatgtgtgtagatagataaatagagagagagagagaggttataaagacatatgttggctgggtgcggtggctcatgcctgtaatcccagcactttgggaggctgaggcgggcagatcacaaggtcaggagattgagaccatcctggctaacacggtgaaaccctgtctctactaaaaatacaaaaaattagccgggcgtggtggcaggcacctgtagtcccagctacctgggaggctgaggcccaagaatcacttcaacccgggaggcagaggttgctgtgagccgggatcgtgccactgaactccagcctgggtgacagagcgagactctgtcttaaaaaaaaaaaaaaaaaaaagacatatgttgaagatttgcttttaaaatactccagaaagaaaaaaatattgcacttatgtgggaagaggtgtgagtatcgacgaaataaaattagcaaaatagtaataatttttggagttgatatttattatactagcctctcaacttttgcgtatgctttacctttcctactgaaaggaagaaaaaaaagtatttccttgaagtcatatagtcttttcagccttcataagtctgccactgaagtttatagtgttggctagatttctgtattcccatatttaccttaggactacctttgcaggaagtgacagtgaggaatgcaataaaacctgagaatatggattgacgctgctgcataaatgtatcttcaggtgaatgggagggagacatgttggataaccttgcaatgtctcattcattaaatttgtcttttcccagaaagacactgagagaccattttaatggtcagacctggaatattctttattcatttatctaagtcagagatattcactcataaccatatgtgaccagacagggtttttaatggagcccttaaagcaagcagatggaaatcaaggatatttcagggaagtgttaatgctctgatgaagatctggatataattacaaaagtagacatgcatatgagtattctaactagaaatgaagaaaattattttcacagctgtaggaaactctatattggcattctgacaaccctgatatattgttgggtcacaaacattaaactctttacaaaagctaaatcaaatgcgtctattggtgaaagtactttataagcgaatacacagaatatcaatggtgtattctgtataataaatggttgtggtattaaaattagtagaaaagaaatactgaggaatgtttcctataatattagtaaattctggcatgtccttggtcatgttcatgacccttgataacccttaatatatgctcatggccacagaacctatacagaatcaagggaaaattaattttgtcatagatactctgattgcagaamtatctgtaacactttataaatattgtacaatgtacttactcataaatcatgaaaatggttcctaagtaaaaatccttaaaagtttataagtcaggttttataagtcccattttgcagatgagcaaactgagacccaaagaagtttgcacagaatcagttccaaattccaaatgtcaactgacatatgcaataaacagtacatgtgttgagtccaaatgtttccttacctagtctttatgcaatctcgcatttagattttcatcaaatcttttggctctactgccctccaaggccatatgcaaaratgttgcctctgtctagttcatttgaatggaaatccatttgctattgtttgggggctaattttgcaaatcatttcataactttctgttcaaaaactacctttaaaatatttaaaaatacatcatggtgctttgaggcttaagattaagaaatattttcaagaactaaagtctcataaaaatgaaggaaagcaagagccaaatccagatttaatccaaatgtgttaaactcttggtcttgctcacaaaatgtgacccacgaaaacagttatggcttcaccatccctagggttgcttagccaataaaaatgaaccatctttactttccctctttatttcatacctccacttctatttccttagaaaagttctgttgattttattgtaaatatatcccgaatctaaccaatgctcaccacttccactgctaacaccctggcccaaacaccatcatctatctcctggattgatatggtggcctcgttactgtgtcccctgctaagagtgatcatctcagtcagtctgtgcttctataaacaaaaatactatatcctgggtggtttaaacagtaagcatttatttctcacagttctaatggctgggaagtccaaaatgaaggtaacagaagacctgatgtcaaagacagcctgatttctggcttcttaatagctgccttctcttgtagcagagagagagaagaagcaagctctctcatttctgtctctttttatccttataatcccactgatctgtcatgagggctccaataccatgacctaattacctcacaaatgctctatctccaaataccatcacattgggaattggggtttcaatatatggcttttggggacggtaaatgagaacatccgatccacagcagtgatccttttaataggttatttgatcacatactaactctgcacaaaaatctccagttagctccccgttttctccataataaagccagtattcttagaatgtcatccaaagccctccatgacctccatctccaattattctatcacttggtctctccattctagactcattggcctccttgttgttcatggaacacatgatctgcttccacattaggcctttgcactggccactccccatatatacatttaagtctcacaagctcatatccttcaaggtttgctcaggccagtttcttaatggccctaaccatcctatttaaaactcagcccacctcataccttgcactcccaatcttccttatatttttcttttttttcatagtacatatgacctactaatatactgtatatgtttatttttaattgtctgtcttatccctttagaatgtaatcttcacaagggtacaggcctttattttgcacacagatgtattcccagtgtctggaacagtgtttagcacacaatggttattcaaattaaatatttgtaaaataaataaaatatctgaagtcaacaactgttaagatatcagtccattctctttcagttatgaatttctaagtttatatctggcaactcagtttcatattggactaaaatttggcagtattgccaaactgagatttgatttatttacccaatytaaacaaaatatgtttagctatttgaagtcctataagcacaataaaataaaaagtctttagatacatgacactatttttataattgtataaatcattaaggccctggatgcattggggatatttaactcgtcaggtagtttacggtttgttctgtatgcgatattaagtgcaaaagaagttgctagtttctaaatacataatgcaatataattttgcttctgctgaaaggcaaatcagaaataatcagctcgctatagtcgacaagtaaaaggagaaaaaacttttaaaaagtatacaggcaaattactaaaatcttttagaacacagtcttttctttttctcttgagggactactctatgtctttgcagtaacttcygcagcctcaagtattcagtgtggcttagaatcacattattttgttttggatttctcaactagcctcatggataatcttccctcttcaaacaatttattatcytgaaccagatcagacctggttgtgatgccgacttaaggggtcgtgccaaagtaggggccatacacagttcctggaggctgactcagtccaagagtggctactgattactgttgagaaagagattgatggtcagtatttttttccttaatattatttcattatgaacatttttccttgtcaatcaatacattgctaccaaagcaatttttgttgtagcacatcattcctgtcatatagttttgttttatttttattttattttttatttttgtgggtacatagtaagtgtgcatgtttatggggtacatgagatgttttgatataggcatgcaatgtgtaataatcacataagggtaagtgtggtatccatgcccttaagcatttacgctttgtataaaaaacaatccaattatacttttagttatttttaaatgcacaattaattcattattgactatagtcaccccattgtgctagccaatactaggtcttatttactcaytctaatattttataccctcagttgttagtattaagactaaataaatattaatcataagatccaaagggtaggtgtaaagtcagaactatgcagtaagataagatcaggaaccaagataaaagaaaaatgtctgaaaactaagagcaatgtgtgtaacacagcagagaataatattcaccgtaaataattcaagaagatttatcccaggaaaagcaaagtgagagcccacattctcagtgggttcctctgttcttctgtcaatgggaagtaaagtatgatgagcaagaagcacaaagttaatgggtcctccagcctcctggagtggctctctgcagctcttgggcaaaacagatgtctcaatgactacgtgggagagtgaggggaaaactcagagcctttcaagcaacagaggtgtgagagagaagttatcaatataattctcattagtctgtttttgagagatacaagttgtcaagcccatttgggatattaaatgataagggttcagtattacccttctgtgctgtgcaaaggagaatagtcaaaagcatatttactgttctcatgaaatttgtagtttaactatgaagacaagatatctgtgaaaagtaaagatcactttctgatcaactaagttttctcactttctagtttttgtctttgtatatacctcctttaagaatactttctccaaaattgtttccagtctcactgactgaggaaattttcaggactcaatcccatgtacaaatgttgaacattacataatcagttatactatatccattgtacttgtgactgatataaaaacatatttttttcaatagctatttattgcatgtctgcaatgtgccaagtgctgttgtagatattaggaaaaatgaagtagacaaaacattgtctttgtccttgtggaacttacatctcagtattataagtgtgcaaaccctctcttcctactaggagaaaatattatttttaatcattccttcacagtgagtttcttaaacttatttcatcagagactattgaaaagcacacactcttccatccccctagaatgagaatcctgggggagggattgggcagtctatctttttaagaaactcactggatgtttcatgtgcattcacagcttaggtaactctgggggaaagcactgccctattaagaacatactgcccaaggaattggtaatatccattgtactatatctgtaggaccccttttgattgtcattactagcctttatcaaacatctcatccttggagaatgtgaaagctctccacggttttccacagacagttcacctaacaaaaaacaacaaggcaaactttttcaagaataccattatttttaaataaaatgcctctacatggcagatgttattatgttctactttggagatgaaaagaatcgaacattattagtyatgrtccacagaaccagaagatttattttaaagataaagttcagatgatgaacataaaggaagttatctcatcaaagaaggcaagactgagtaaatctcagaaatccaccatgtacaatatttaaaaatgctcactaaagttgttctttgtgagttaatgaaggtcagtatagtcaatattcagtacgtaatcctagcaagtacaaataaagttaatattattcaaatatcttacacaggcttattgcatgcaacacactgttctaagtaacatacagatattaaaatgacttaattctcaaaacatgaagtgagtttttgtttttatgcccgttttgcagatgagaaaactgaggcatagggaaggtaagtaacgygcttaaggttacatagctggtaaattgtagccaggagttggaatctaggtgccaaaatctatgctgttaatcactaaactacgctgccttagtttttatacttctttaggaacctcagaccaaaagaaatttaggcaattctaatagaacaagcaagaatttgctaatcacagcttccttgccccaatcctttaatcggcttcattttcactgacttcttttttaaatgaagataacaatgttgttgaacaggatcatctagtggttagtggttcggcataagaatgactcgcttctgaagctcagctctagcactcgcttgctgtatgaccttgagaaagttacctccccaagtctgtttcctcatctttaaaagagaggttataataggacccacatcatactattgtttaaagagaaaacaacgtagcccatttaaagcacttagaaagtgctccataaatattattagtgtaataaatagcagcaacatcaataaagtatgaaccaaatgatctcttgattcgtatcctaacactaaaaatggtttatttcccttctaattaaaagagaattacaacaaccaaaacaacaaacgaaactatagccataaaatcaattatatcgtctgtgagaaaaccggaaaggctattggacacattaattcacttgtcatcagtcatcccctctattccaaaatgtttgtgttctaacatcctgagacaccttgcataatataatcactgtgactccaagaggtcaaatgggcaggcagttaatgcttctctgtgaaaagctcaataattcattttataaatttcagtttaaagcctgcgttgaggttaagaaaaattgacgttcggtctgtgaacttaatgtcaagctccagaaaaactctgggcagcacatgtttagcaattaagtggacacagacaataaagacgttgccaaattgtaaaacaagacttggaaatcacagaaaatgttgctagttattgatcacggtgaccattcagttcctactgagccacccaaaagaaycattcattttccagcagagagcctgctcatttgcaagataaaagagagacatttctgcacatgcccataatgttcttcaccactgggggcagctttacataagaytgcattcactgaaaccaaagcaacagtccgagcagctttcagaatgacagtctgcagaagtgagctgagcgtgtgcgcggtacggggctctcctgccttctgggctccaacgcagctctgtggctgaactgggtgctcatcacgggaactgctgggstatggaatacagatgtggcagctcaggtagccccaaattgcctggaagaatacatcatgtttttcgataagaagaaattgtaggatccagttttttttttaaccgccccctccccaccccccaaaaaactgtaaagatgcaaaaacgtaatatccatgaagatcctattacctaggaagattttgatgttttgctgcgaatgcggtgttgggatttatttgttcttggagtgttctgcgtggctggcaaagaataatgttccaaaatcggtccatctcccaaggggtccaatttttcttcctgggtgtcagcgagccctgactcactacagtgcagctgacaggggctgtcatgcaactggcccctaagccaaagcaaaagacctaaggacgacctttgaacaatacaaaggatgggtatgttttgtcatttttcttctttccttcttaaaaacaaaaaacaaaaaacctctagtgtgtgtaataattctgccttaattattttagagattaccttgctctgctctaagactatgaatttatttgcttagtggcatgtttccktgtttaactatttaaaaaaacaaaacmctaaagacaattctctttaattacaaagagataatatgtgatgttaagtgttatttagatttaaatttttaaaaatgaaaaatatatgcctatttttgcttgattaaggattaattcttttttggggggataacttttctaagttgtttttatttccaggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccytgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgaggtatgaaccattgtgataaaaagagctcttaaaagctgggaaataagtggtgctttattgaactctggtgactatcaagggaacgcgatgccccccctccccttccctctccctctcactttgctggcaagatccttccttgtccgttttagtgcattcataatactggtcattttcctctcatacataatcaacccattgaaatttaaataccacaatcaaygtgaagcttgaactccggtttaatataatacctattgtataagaccctttactgattccattaatgtcgcatttgttttaagataaaacttctttcataagtaatcccccacattcgctgttagcctcctggtgggaccaaatctacagttatagaaggtttgcacctcactggcaaatcaaggaaagaggtgaatgattccaggtgctcggagcttgagctgattcttggagatgactcagttatgggaacattttacagacaggcagagcctttaaaccaatgcctgacttagaaaagaaaattgcaggaaactatcaaaagatggtgctaggttaaagcagcaccctgagcagtttccagaggtgtctgaattacagtaaggcaagcacagggacaaagtgatgaagggttaaaatactgcaagcagacaactgcaaaatgtgaggagatgacaaaaatgtaaagttttcgactcagccttgtctctgaaacccatctctgtaaaatcagactagaggtttcactgccaatttcttctagcctgtatgtttcataaataaataaatgaaacagcattgagaagccagatttctccaccacacctcacattagttagggagttttcagataaggttcgcgaatgggaragcagcttgctacaggcatgtggttgagagcttaccagaatttctctttccagttttttcgaagaccctaatgtagttagtagaatccttagctctgtcctgttctgttcagaatttgtcaggctgccctgttgtgttccattacatgtcctgcacacaccagtcccctaatgacagacacttcattcagatgtgtaaagagaacacattccaagacgtgccttccacccacagcctcattgaaaaggacgactttgataacaccttaataaatgtayaaaacgaatcttagaggaaaaaagaccaacactatgacagttctctgttgcttttctattgctgacattacaatgtccctgcgttcatctgtattgtgaactcatccatcagtacagttctgtacagaccctgttggcaatctgcaagctgcatgcatgtttttatgtcattggtgaaagtttattgactgcagcacgaatatcatagcttccatatttgagtaacttgaaccacagtcaattaaggtttttagaaagatatatttagtctgtattctccttcatcctccaaaatgaacagttctattatagaagcaaatatcaggaactgcaacattgaggctgtttcatttaatttggcttgccaacccctacatctttaaccatgtccctcttctctgaaaacagaatcactgcagcaacaaagaaaaagtgaatggctatttttactaatttttttttattgtttgggggtttttcatatgctgagaggaaaaatctaggcaagtcaccataaaataaaattttaaggatgccagatyattaaaatcatacttttataagcaataaagaaaaagaaatagttaaagtggatttctcaaggtactttgatattgattaaatcttacaatagatgccacttcagaaaaacatcttagttacaatgtttacccatgaataattgttgaatatacatgtattcatgacaaaaagtcacatatttccaatggattaataatgcagatacttcctcacagcttactggatgactgagcttattgtgatttttttactgaagttgtaactttacatttttcataaagcatcagtaaatacatattccatcttaaaaagaaattttctttggctagcctcatttttatctgtactaaagatgtttgtattaatgaaatgcagtcttaaagtgaagaaccccatttctattctttttcacttaaccttctgccttacttgtgatggataccaaatatatttaggcaaggaatacttatatttttgaattattgcaaattctcaatgccatggtgctactagtatatataaaatatgcttgctgtattgaaaagcattcctaaaattcaaagctacttggaatataaaatatgatataacactaaatgaatcaccaatattttgaaagctgtcactttttaatgcctaactttactaataaacataataatagataagaacgaaaataaaatcccttaggtggtaaaactcattttgatttgggacatgaaattatgggaaaaaagttctttctttctcctcactctttgagaatgaatcttctgtaattctcagtatcttctgagcacagatatataattyttgtagatttaataactagtttaccactgtaaattttaaaacgccaactgccagtctcctgctcaaaagttgttgcctcacctccatcccatggtactttctggactacatatcataaatctatttgtataagtatttcaagttcatgcagattagagaaatgtgattgatatttatttttctagtacgtatttacataaaatattggacttccctcaaaggtgacaacagttaaaaaaaaaaaaaaaaaaaaagcctgacctgttgaactatacaacagaacacagaatactttgctttaccaaaacagagaagaaatgggatttagtctctaaacttcatgtgagtttttttccatttttattaaccccagtacacayagtgctaccacagcatgtagttaaatagtcccagtgccacagtcttgtaagcaatacttatgcaagatatattgcattgaaatgagtttgtattttccaaggaygttgacattacatcttttcaaagaatttaaacaattttttacttgatttggtgagtgaactacctaagtagacaggcagtaaattgtctttctatggagcagcagtgacctctagtgtctggttagactaaccacagctattcacacattttagctttttatcctgaatccttatgtaaacgtggtttacaacatgttttttgactagtaaatcagatttgaattttatttaattcatttccttgggaaatataattataatgtaatttttgaatgttatacttttcattttgacttttatagtaatgctggaacagaggccatagaattggtactgaaggctagaaataagtgtccaagatgaaaagcgagtaataacgcaataagaatagataagaaatattttagagtgcttatactcatcgatgctggctaagcattttgatatttttattaaaggggttaatatttttcatcagcaagatacatgtaatttaggtaggaaaaacaaattttaatattatatcaaaagagtcagcatcagtcatttactggtcagggatatgtcaaaggtgtcaaaggaggggggcctccccttccggctttagaactctccagtttgctgattgtgccagtgacctgtgctttgcctcagcgctttctccctccctcccccttttcagccagctgaacactggttctattaggctctctgacaatgatgttacagtctaagaggtgatgattcatggataatgaaattatgctctccttctggggaaggataatgcagagtcagattcatggatttggcaagaggttttaggatgctgtaggtgcatgaaatatctcttcttcccttgacatttaccaaaatgagaactcaaatcgtttatttaaagtgtggattagactgcatcagaaacaagcatcaggtcatgaagcctgagataaagtgagttccagacatggcaagtaagaatcgagccatgagaaataaaaaattcagaatctgtgttgcttcatctattcctttttgctctggattctcattagaatccagatctgtagctaacccacggagttttgctattgttgtattctcctagctacctacactaaaaatcagaggcagttgggggaaacaatgagcacaacagaatatataggtaaatttgaatgacacaagttttaagagaaataaaatggatggatgttaaatagtttgtatcaaatagctctaattaaaaatgaattaaagaaataataataatacataggtgaaagtcactgctttcctaatcataatagcctacagaattggacccaaattcttttagcctccaaaagttggtgatgattttggatacttaatactaccaataaaatctaaataacaataatttatgattcttttgcatttgagggaaatatcacagccaggcatggtagaataygggccttagaaattaagacctaaattcaagttcctttgacacttgctaatcaagtcatcacaggtacatttcctggcttttctgaatttgaagtttctcatatgtaacacagatgtgtactattgactgctcatggtaattgggaggacgaaatgtgaaaagtactttgtaaactctaaaatggcaactacctcttcttttcaaaaagcccttagtgagatactgagtggggtttgttgttctatgtttggcatgagccaaaaagaaatcagtaacctccatgttacagaaccccaagcccattttacatcattagaagtctagaacatcgtctttgactttctgttttcacataggcacagcttcttccacctcatgttatctaagtctatgatttttatactgattatcacaatgtacaacagacataaagacaccgaccagcgaacactaaaacaaataattatcaaacacattgaaaattctacttgtatttcagatcaggcaactatagcaagggctttcaatcaggacgtttacctgtccactccctttctagtatcattgtgttcaatccttgttgactttacactggatcaatataatgtttatatggcaacatgacatcattattgagcaaaaagtaattgcatataacatgttactgtaggattagcacgcattccaggtatcagtcacatgatatctgctctgatgtttctcccctggccactccagtggaagactgtgcccaagatctcctcttagtatagaaattactattgactttatcaattataattattgaaaaatcactggataaaaaggggtataaatgtacagggacttccttttatatgtcattgcttatgcaaaattacatcattaattcatcaaagaatgacaaaaggcttcctccgctggatgtagctgctcttaccaatatgaagtagcaggtgtattttcaaaatgtttgtcatttaagaagacacagactgttcctctttgacagctgagttcctatggcatatctaaagatcagagagaggatgatggtttttcaggtggggaagcagttgtgagttttctgacattttaacttcatagggtcatgaatggacgctcttgagttagggatcctgaacacgtgaggaaaattccaggaacacagagagaacaggaatatctgggacatgatataagaccaagcaagtacaatgtattttacaattatactttctaacaacagaacttctataagcaataataatccattttattgaaaaaaaagaaaaacagcttctatcttatcmtttccagcaaatgttgtaatgataattaataactttattaacaattctccatgttttctttttatttttaagggctctcacttctcccaatcaggattctcatttatcctttctctcactcttaaattgttctccttatttgaaagagtctgtaattcctatatcaccaaaaaatgtcttcctttataaaccaacacaattcagtcatttggctcaaaagagcagcattatctccaaaagaaaagttacacacttgcattaaatattaggacataaaacaaatttaaagctggctgacacttctctttcctctacaatctataaaacacctctacagtatattatgatttgcaattgaaaaaacaggatatatagttgaattacagtcttacaaagtattaaagcttactgttttcctccttaattagctaattcctagaaaacaaagtataggactttatgtataggggtactcaactatatttcaccaatcagaaacactctttccaacaatcagaattttgtcttctcaagggtaaaatatagtttttttggcctggcatataaaatagtaaggcaaatactacatttagcaaaggcaatttttgttgacatttcatcacatcaattacatctatgcagggtggaaaatacattttgtcagtaaggaggcaatgacttcaattaaatgtaaatccttagtcagcattcttggtgctaaagcttattaatgaagtgggagcagaatgaaaatgtcatcagacagtgaagctacagtatcatgaggctatgctaccttgagtggtgttcatagcttcaactgggtggccctcatgtagctaaaaaagtgctccttgtcattaatattgatctatgtactttctaaaagaaagaatatgcttaccaacagagccctcatattgactgtcttcctataagtttccctcattaatatttgatgcagtcaaccagaatctcacaagagctttaaaggaaacttgtagaatgcatcatgttgatattgaaaaagtagagtagcttttaaaattctgataaatgtgtgacaagattacaacagtgaaacctctctaaggtacaacagtgaaaatagttataacggtgaaaactctaggaagtttaccatagtgaaaactctccaagaagtttaaaattcagcgctttgagattagtgttggcatgtacttgtcaatttatgaaagggattttgcctaatgtattcaaaattttaatgtgaaaggtataaatacttggtttgtttactggcaccaatagagggttaggtaacatcactgaattatgattaaaatggaatatttaaagatctttctaatatggcagaggacatattacatacgtatttgtatttccaccaaggtacgtatgttgtacatgcctaaaaaaatatatatatattttcctattaggtgaatatttttcctataatgtgaagatattttggtataattgagtccttattatgtaccaggaatttgtatatattatctaatgatttgataaaaagtgttttatgcgtttcgtaaactcagatagttttccttaaaatataagaacagagccctttatattgagtctgtcttcctgtaagtttcactcattaatcctatacattttcacttctttataggactgctctaaaataatttataccccacccacaaaaggcttctcaaagccaaatcatgcatctccagatccctttaggaaataatttccgatgatttaccattagaacatccctctgctagttaaagtctaatctgccagtatagtgttccttccagcctgtggcacccactccagcctatctcatgtcattcattaaaaagcagtaagtgtttagtcttttggacttttacagggaggactaagtaataaaatgtaaaaatctacatatatttttatgggctttactctggtcacttttatggtctaacacacacagatgtgtggagtctttattagtttacactaaaatgcaagagcattaagctagatatagacgaaaagagaaagtcaaagtagatttcaaaatagccaaaagctcacattatacgtttcttaatgttaaaaaaaaaatcccaaatgatggagatcctgtaattcactttcttgaaagctaatttaccctcctctaagtttgccatcacattcttaaatttaagctgacattccttctattttcctatttctaataggttttcctggtgtttttttgtttgtttgttttttggttgttctgttttgtttctctgttgttttctgcctgcagatcttaattctttgagtgcactgccttgcctgtttttctagaattcccaatcaaatgttgatcctgtcagaaagtcacagggtcagtttcatggttggagtcatcggacagatggactagattgaactctacagcgcaatctagtcaactctgagatgtctgccttgtgtcttctcagcatcccatttccatgtattttctctatttggaagtagtatccatattgaaattcctccatccagtggtgcccagagctttcttggtttcttatgcgttatcaaatatctgctcccagagtgagagcaggattactgtcccttccaagggcactcacctttaaatagagatgaaagtcttcagctaaaggtaagaaagttatatattaagagcaggcatagccagcagggttggggaaagttcttcttaggcaaagacctttgtaaagcactctgaaatcatcctctatagattcctcagtatttttctcaaacatgagtttgggcctttccaaaggagccaaggcagggtaaataatccatgtttcattcaataaactatatttgagaatttttttttcagtgaatcgccattatacaaagtctttctccttaaatttttttcatggagagacaactttgtataccagaaagaacttggactatggatccagtttgaattctgtttctgggattttagtaactgtgaaaccttgagtctcaacatcgtcatcctaataaaaatgtgtaaaacaatgtagttatcatgggattgttgcaagaaggcaaagaatcagcatttgttaaatatttttcctggtacatttcatatataatctaatactcataaagatcctatgaagattcaatgagatgatgtagataaaatcatttaatacaaaggttggcacataatactttctccttcccttcattagttccaactgctaaaaatctcagtaccayaatgcgctttgaaagtcatattacactacctatttttattttgaataacagactcctggtggactttccggaaatagaatctaaatttccataagctcaagggcatctgggcacgtagttaatactgaagagtgatggtagtacataaaaccaatgtcctcagcctcccaacaaagcccagctacaaccacctttattgccctaccctttcccatgctctaccactggcaggttctcaaagtagcccatgcttcccaatctctgtgcttttgatcaagcaatttcctttgtgagaawtgcccttcctccctcccaagtcctccagtcaatttctgagcttttccagaatagatcaaattctgctcactccagatgtcttattaatcttttccttccctcttttctgttttttttccccctctcccagagactgcatcacagtctaccttatgttagagttattaaggggtttgtatcacgatttgaggaaatggataatctcttcttttccttcttcttccaatggtggctgatacagtcttttatgcatgatagatgttgttgaattgattttctggtcattattatgaagttattattgcaaacaatctacagtaaacatttcaactctatggaaacttaattgtatcaaccttatatttctttgtgtagtcataaaaactttttttagttttaatttaatatacactttttcactatgtacactcttctcatttaccatttaacgggcttcaaaaattatagctgaccactaaacaatgtgagggtcaagagaacaaaccctcccatacagtcaaaaatccatataatattttactcccccagaactactaatagcatattgttgaccagaagccttactgataatataaagagtcaacccatattttatatatgtatcttattctgtattttataataaagtaagctagaaaaatgaaaatattattaagaaaatcataaggaaaagaaaatatatttattattcattaagcgaaatggataatcctaaaggtcttcattcttggcatcttcatgttgagtaggctgaggaggagatagagaagcgatcggtcttgctgtctcagggtggcagagtcggaagataatccacgtgtgagtagactcatgcagctcaaacccatattgtccaaaggttaatcgtattcttaggaaaatacagttttaaaggatcatgttctgatttaaattgcttgtgtgttgtgaataatctaccaatcattttttcctgtgatagttaccaaagctatgaacatttggagggatatgttaaagggaataagagctacaaaaaattgagacaaagaaataatatttaagtctagctgcgaatacaccttcatttttgtagaggctaggtagtcaacgtttgtttaaaagccatacatttgtgatctctccccgtccacatcctcctgagaaaggtcctttgctctttagcttggatgtctccttatctcagccccagttctgcaaggattcagctttagatgcattctgaggcctctcctctcttacccacaccaagggaacaccctacgctatgacagaaactaggtcttggcctctgattttacgcgtttccaaagtaactactctactggaggcctccaacactcagaagctgacaagtagtaatgctcatcttttttacctcctaaaagctgatcatgcagaaggcatgttagatcatacagaactgaagcatcttcccttttctgagtctctcctttcctcccttctgttcattcctttattcctttgcactacatttctttttctctttctcatctccacttaaaatttctttcaatttttctttctatccaacttttaagtcaatccatacaacttggatatatgccttcaractgagttaaaaggaaaatactaatagttttatctctcatgaaagcaataattaaaatgacaccatctaataatttaatgtaaaaggagggaaaaattctatttgtattcaactcttttgtttgggcctataaatgaagaactataattttgtaaattatagtttaattttagaaataaaaatgacctcttccctaatatattttaagttgcattttaattacaatttgtaaggtagggcagacttacagaccatccatatcccttttcatgtgaagtatctgtcagcctctggaccacagtaaactttgtcattcacagagtggattcttttttggaacatacgtgataaacaaattgaaataaaacttcactttagttataaaaacttgtagttataaggacttttgagaaccttgcagtccattttttttaccttctatttgaaattccaaactaatttcattgtacttgtaacaatcttccaagaactgcaatcctcaagttctctctttgttatccacttcatggtttcactgtggtcactgcatcattttttacccctatacgcatcttgcttaagataaacccagtggttacttaattttttttttaattcttctttgttttcattctttttaaagaggaacagtaaaataagtagttaggttttgtgtttgtttttgctttcagtactggaatctgcttggtccaacttaggtagagaatcttgggctccagagcgcatagtttgaaaagatggaaaacgttgttctgaaatttgcattaatctactttagattcaaaaattccacataggctgggtgtggtaggtggctcatgcctataggcccagcactttgggaggccgaggcaaggaggatcacttgagctctcaagaccagtctggaaacatagcaaggcctcatctctacaaaaaatgaaaaaaaattacctgggtgtgatggcacatgcttggaagctgaagtgggaggactgcttaagcccagggaggatacagtgagcaacgattgcaccactgcactccagcctgagcaacagagcaagatcatgtctcttaaaaaatatatgtatattttgcatagagtgtctcatgatgactgaataaaagaagtccagtggttaactaatctataattaatcatagaagcaagaggtttctgacaaaatgtattcagcagctttaaatatgaaacccacaaattatatttccagaggtcaaatttgcatataactccttgaactatgactatctcctcacattcaactcagttttaagatccagcagtgtgttgtacaaagtaatcaatggctaaattattcccattttgttagctcagttcacagtagcccactgactggtttaaacaaaaaaaaaaacttatctgatcttcagtttgtatttcaactgtacccaagtgcagatgccatctctggtaatatgacaaaacagatttaggtttctaaatgtttctgtatgctccaataacagtatgcagcctgcagtaactatatcgtagctcaaagtgttgtaaaaaaatgcaactgagtttgctgaagaatcattttagagttaattaaaccttctccacctgtaatttaataaaaaaaagaaagcccaacatactcttaaagacgatgggggaaaggcagtttaagaaataaaagtcctctgtttatccagggaggtactttacaaggcagacagctwcaccacagtagagagacaatatttcctcagctgagtcggttaattaaaatgcacagttacaacagactttcttagagcctgcagctgaatgactgaagtctccattttactccagtgtcacacagaacatgaagaggcaaacatactgcctgaacacaatttgactcactaaaatccagcactataaacacaaaatacatttctcgagtgcattttaaaagacttattatcaagatttatgacataaggatagaaataatttgcaactaggcactgccaggagaatatcttaggttcctctcaaggtaattttaagtaaaatttacaaataaatcttaaggttagagtccactttgaacgcaggaatcttcacctctttcctttcaactgtatggaatttgaatctgacaaacaacctgtctgttgctagaatttataagtgatytgaaaaaaaatcaaaggccataaaagctatttgtcaaataaactgcagaacacgatatcagtctgcagggctcatttgcagaactcatgatgagcatgggaggaggggatgctaacagctgcagccttgaccgcactgcccgtgccagccagaattcaagccgcgtgagctgagtgtggctgaaagagggagcacacaaatgacatcttagaagacaaaagcaaaaaatgacaaaagaggttcttatatccaagtttttattatatcagtacatcagcatatacagaggatgacctaaaaaaaccactttaagatagatgggccggcagagttttaaaggttttcaaattaagtctgttcgtggaagacttactttgatttcatggtgtaggagggagatcgtagacttcgaatccactagacctgaagttaaataaacctgggstgcagttttggttagcctggtagcacggcatggtatcagtttcctcatctgtaaaatgggaacaatacttcatgtcccagcacaattttgaggataaattgagataacatatgtttgcaggcacagcaggtgtcagtaaaagttagttttctcctgtcgtttgctagatattttcacaatgcagcaagttgattcaagtggtgaagtggaaattctcacattaaacacataaattgccaagtctgcaatatataaaaaatgattaaatgtccttgacgcttaccaatcattattaaatcaaacctgaaaaggatctaccagcaatttgcaagcccgttattaatatcctttaatggacttgctctattaagtattcttctgtaacaatgttgttcagcaacacaacagaaaaattctgttgttagtattgtgtttcttctagtaattcaacatcatttccattttataaacattacttgagaaattagttccattatcctacaaatctctctttaaaacattgccataatgtctctctctctctctctctctctctctctgtgtgtgtgtatgtgtgtgtgtgtgtctgcgtgtgtgtgcatgtgtctctctctttcccttttttctccttcctcactttctcactctctctttcctttctctaccccaaacatggacatatcacaccttcccatactcagcactcaagagaacatgctattgttattacagtaaaccaaaatggtctgagaacttagtaactattacatttctagtgtgaaataatttaggcatttaaaggaagaaaacacaatatcaatatttatgtttttaaaaattccagtagagtctgtgaaatgatggctaaattaagcaaaagcaaattaatcaaagagttacaaaggaagaattccaatgggcacttaatgagcacctataatgtgcaggcacataggttgacttttctttcttcccagggcaaacaaaatagcttctcagggcaagggatatcagaaatttggagtcacattaataggaaaagcactgagttaattgactggctttggaaatttacttcacaaagcattggattttctcaagagacaaatttgatacatgtccttcactggagacatgaaaataattcgttctttttaaagactttgaaaagagcagagacgagaaaagctagaagagtttctaaatgacacaagatctgtgaaatgatagatatttagcataaacctcatagagctgttgtgtggattcattagttaattagttagttaatgactttgaagtgttaaatcttattagatttttttttacactttaacacatctgagagagaaattactcttaaattagaaactgactataccactcaaaaagaccatctttttatggtatatcttcaagatgctctttcctgttctgaatttttttcctgaaattctgggaagcctatctacatcctgatcccaaatccaattcccccacccttttttttttttcagtattagcattggcttccagttaacactaagcacagccttaagaaactctcacggcgaggtgttttgtataaaaatataaagatgttatgtggtaataatggcatcaagaattaaacatgctacttaaacatagttttgtacttttgtacagcaggggaaaacaaatacaggcatacctcagagatatttcaggtttggttccagaaccccaccataaagtgcatatcgcaataaaatgagtcacacaaattttttggtttcctagtgaatataaaagctatgtttatgctgtactgtagtctattaagtgtgcagtagcactatgtcaaagaaacaatgtgcttataatttaaaaatactttattgctaaaaagtgctcatgatcatctgatcctttagagaatcacaatctttttgctggtgtagggtctttccttgatgttgatggctgcagacagatcagggtggtggttgctaaaagttgaggtgactgtggcaatttctgaaaataagataacaaggatgtctgctgcattggttgactctttcatgaaagatttctctatagcatatggtgttgattgatagcattttattcacagtagaacttctttcaaaattgaagtcaatcctctcaaactctgccactgcttcatcaaataagtttataagtttatgaaatattctaaatyatttgttattatttcaacaatattcacaacatcttcaccaggagaagattttatctcaagagacaactttctctgttcatccataagcagcaactcctcatccattcaagtttgatcatgaggttgcagcaattccattccatcttcacactccatctctaattctagttccccgctatttccaccacatcttcagttacttcctccactgaagtcttgaacctctcaaagtcatccatgagggttggaatcaacttcttcctaactcctattaatgttgatgttttgacttcctctcatgaatcacgaatgttcttagcaacatttagaatggtgactcttaccttaaaggttttcaatttactttgcccagatccatcaaaggaattattatccaaggcagcatgagacttataaaaggtttccaatttactttgcccagatccatcaaaggaattatcatccaagacagcaagagacttataaaaggtatttcttaaataatactctttgaaagtcaaaattattccctgattcataggctgcagaatggatgctttgttagcaggcatgaaaacaacattaatctccatgtatatgtccatcagagctcttgggtgaccagatgcattatcagtgagcagtaatactttgaaaggaatctttttttagcactaggactcaacaggaggcttaaaatgtccagtaaaccatgctataaacacatgtgctatcatacaggctttgctgttccacttacacagcacaggcagagttgatttagcatcattcttaagggccccaggattttcagaatggtaaatgagcactggcttcaacttaaagtcagcagctgcactagcctctaacaagagactcagcttgtcctttggagctttgaggccaggcattgacttctcctctctagctatgggggtcctagatggcatctttttccactagaagattatttagtgtaagttaaagttctgttgtatagtgtaaccaccttcatcaattatcttagctagatcttctgaataacttgttgcagcttttacatcatcacttccacttcaagcgttgtgctgttttactttgcacttttatgttatgaagatggcttctttctgtaaacctcatgaaccaacctcttctaccttcaacctttccttctgcagcttcctcccttctttcagcctttgtagaattgaaaggatctagggctttactctggattaggctttgacttaaagggaatgttgtggatggtttgatcttctctccagaccactaaaattttctccatatcagcaataagtctgttttggtttcttatcattcatgtgttcactggagtagcacttttcattttcttcaagaacttttcctttgcactaacaacttggctagctatttggcaaaagaggcctagctttcaacctatttcagctttcaacatgccttcctcattaagctttatcatttttatcttttgatttcaagtgagataaatgtgactctcttttacttgaacacttagagaccactgtagggttattaatgggtgaaatttcaactttgatgtgtctcagggaatagggaggcccacagtaagggagggaaatagagaatggctggtcagtgaagcggtcaggacatatttattgattaagtttgtcagattctatggttgtagtttgaaggaccccaaaacaattacagtagtaacatcaaagatcatggatcacagatcaccataatagatataataatcatgaaaatgtttaaagatgtggcaataattaacaaaatgtaacacagagacatgaaatgagcacatgctgttgaaaaacagagctcatagacttgcttgaaacagggttgccacaaaacttcagtttgtaaaaatcataatatctgcaaagtgcaataaaatgcagtacaataaaatgaggtgtgcctgcactctgttggataattaattctgtgagaaaatagagagggagagaattggaatccaatgataattatcttattctttggaaatagtgatcacattttgacctgcatgctggaaagttgagaaaggatagcagcagcataattaagttagcaatattttaatatgtgagagacatttgtatagtttaaacaaaaactttttttgttggcatataatatacatagagaaaagtgcacatatggtcaatgtacagcttgatgaataactgagcacacacaagttctctgcacacagatcaagaaacagaacacatcagcagtgtttcaaagccccctctagttcttccaatcactattcccatacccaaggtaaccactactgttacctgtaacagcatagggtagctttatctgttttggtactttacataaacgcaatcataaagcatgtacttttgagtctcacttatttctcatttgacatcatgttttacaagattcatctatattcttgagtgtagttgtagaactacatatttctcatctctgtccctccccattttctctccccaccacacccaggcacacacatagaattaatccccctcttattcaaatgatggatctacgtatgtacttggaagttcttgataaacttcttttttcatgtattccacagcatgaatgactcaggaattgctaatgaaaattttcctacagtctcttttcttggcgctggtaaatcttaatcttagaatattttgcatttttaaaatctattcatgtacacaaccagctccaagaaggacactgaggtaatcatctttttaagttgcccttgttttcagccccaaatccctgacttttacttaatctctccagggcagccttctttctgtctctggccttcaacttagaaagccagccctactctaatgattgtattagaaaaaacttgcataaactactttacaccaaggtgttcatgcctaaatctttatctttccaaggtatggccccaggacagtgttgtaacttagaggaccaattactctctgattactctctaatggggtatcttgtacagatgcatttcttgagttgttctgaggtcccactatattaaaggacactaagaaacagagctatcacactcaatgctggttttactattagaacattattgaaattaccatttcactatatcacaaggtattttctttatgagggtccatggggaaaggggaatggttctgcttcttctacataactttattttaaaatgtgttgttatttaagcaactgagcctgccctctttgtttcccccaccctctctcactctgtctccctctcccctgctgaaaatataaaaaagcatcagagacaaacactaataaatttccagagactaataagtttctaggacttcataatttgtattttttccctacctttctcacccttggtttcacatactttttctttcattctgttttcaaatatttttttctttttttaatcttgataaatttagggaaaatacagattaactcaataaaatatactatttcttaaagaaaaaattttaatcactgacactaagttaggctggccaagagaggaaaatgcagtcatgtggcgcttagcgacaggaataggttctgagaaatgcatcattaggcaattttgtcattgtgcgaacatcacagagtgtacttacataaacctagatgacagtctactacacacctaggctatatggtataggctattgctgttaggctaggaacttacttgtatagcaagttactgtatagaatgctgtaggcatttgtaacacaatggtatttgtgtagctacgcatatctaaacatagaaaaggtaggataaaaacacaatatcataacttgtgggatcaccatcatayatgtagtccctcattggccacaacattgttattgtagtgcatcactgtatattttagggagagggctcttctcgaaattctcaaattatgcccacttggtgaactgtgatcagacagactgaaaaacctggtagttgaggcatcgtataacatagtaccatgtacaaagaaagttttaataaagcttttctgaatgcattgaccaaagatattttccaacaagcaaaatggacagaatggggagaatgtctaggaaatatctagatcaaggataggataaaagacaaatgcacttgcgtaacaacatggagatgcgtttttaagagagcagacctgttactacatgtgttatgtgacactttgtgacaactgaccgattcttattttcaatgctctcaattaaagatctactcgggaagattttattaatgtgttatttatctaagagtcattgatttatggagcttaaccataagatatagcatggctcattttcattataaaatttatatctacaggaagaataccacaaggacatggggtgttctatcctggactggtaaaccacatatgcaatcacaccaactgatgaaattgaacatattaaatgataacaatctgttatttgctcccttcattcctatgatcctattaaaatgaagtaaaaaaaatcccagaaactcaatgtgaatccataaatcataacataaagcagtccaatataatacttcagtgaaatgttcttttcagtaaaagagagggaggagaaggtgtcaagtgtgggtctcttaattaggctttgtattaattttgagaacaaagacataattccagatcagataaattataattgtgttatttttttctttgctgttaaagctatttgattaggagactctggaaaaagcatgtaatcttgcaaacaaatataacaaatttattgtcaaacattagcaaaaatttataatctgcattgataacattcctaaagtattcaatggagccattcagcaatatgaaagaatgcaggcaaatttctatgattagtatttattcaaatatatattttgccaaatcaataataaatttactgagaaactatcagttgtggaaatattatgataaacatcccctttaaaaatcactatggccagaccaggtgctgtgggctcatgcctgtaatcccagcactttgggaggccgaggcaggtggatcacctgaggtcgggagttggagaccagcctgaccaacatggagaaaccccgtctctactaaaaaaatacaaaattagcctggcgtgttggcatatgcctgtaatcccagctacttgggaggctgaggcaggagaattgcttgaacccaggaggcggaggttgcagtgagccaagatcgcgccattggactccatcctgggcaacaagagcaaaactccatctcaaaataaaaaaaaaaaaaagtcactatggccaatatgaaaattaggacctgttaggttgaaaacatccagtctgcagtgagtataggattaaacatgattggagtaccactacgtatgtttcaaatgcttatagtatgtgaaaattaaagtccattttcttatgcttggcaaataccagcagacttgctagacacaggcagcagcctccaatttcacagggcttgtgttcccaatgcacacctaaaaggatagctttctcacatgttttgtgattctaacaatgtgtgcagagaggaatggatactgtaactatgaaatggaaaagctctagatttctgagtggttcagaatcacgggcctaaagccagacattaaatagaaaacttgtcacttcacagctcagaaagttctaacatctccccatgacttaacacaatctgggctcaacctagtctttctgtttctctatgcaattactcttaataccaatatgctccaacaaaaccatgatttaccactctttgaacgtctccttcagggtctatctctaatttgctcaaattatttcttctgcctggaacattgctttttgacaaattatattttataaccaaatttaactcttacataaactattttctgatacaaccaaaagcatttttcttccccattcaactctaattgkatattattattattttacttctatagccattaaaattttctaacttgaaktatatttacttatatctataattatcttcctttcagggaaattttacagggaggaaaaaatcttacattttttttgtatcctaaacatgcttaaggcaggttttgagatatactatatgtttaataaatgtctgtttaaagaatcatatgtgaatacatgaatgtcacacttgtgagagtctcactgagactctagtatattaaacaaaagatccttatttccctatctttgtcaaaatatgtatgatatttgagatttagttcatatcataaaacattgcatttaatatattttatatatttttaataaatgtttaccattttcagttatgtgaatggctccatacagcaaaagaaccattagaaatataaaagcatcatcctatgaagtataaaattactcctgaattataagcaacctttgtagctacatgcaaaacatttattcagctgcaactatttaatccttacaaaaacaaaaaagcatgagttcatataagggccacactgtgtgaggggcatagagagagattttagaggcttygcacagtgcagggagtttggtcttaacccattttataggtaaagaaattgaggtgtaatcacatgagacagaatttgaattctgatctgtcggattcagcacctctcttgtcactgtgcagaaactccctttgaatgctagatttcctctgaatagatggtatgcttatttaaatacaagacaagtcattttgccttgctgcactgtatttatcacaaggctattgccagctttttctttaacattaaatacacacacacacacacacacacacacaactgtctttttttttttttaagacagagtcttgctctgtcacctggagtgctggagtggcgtgatcttggttcactgcaacctctgcctcctgggttcaagcgattctcctgcctcagcctcctgagtagctgggattataggcatgcaccaccacccctggccaatttttgtatttttagtagagatggggtttcaccatgttggccaggctggtctcaaactcctgacctcagatgatccatccgcctctgcctcccagagtgctgggattacaggcataagccaccatgcccagcccaacaccatatcttttaaatggcttactatgtttgaggcattgcaataatgtgtcccttaacgtatttaattcttacgacaaatctatgagataggtactgtttactcatattccggatagggaaactgggcatagaaattttaagtaatatattgaagatcacagagatagggcatgaaatggaatttgaacccaagtctttcttgctcctgaatccaaattcttaaccayactattggcttttgttcctctccattaatcctgaatgtgatttatttttttcccaaaaaggaaactggattacttgacctgctgtttgttcagaatatttattttagcatgtgaaacatttaatactacactgggaagggatctagaggacagaaagtggaggtaggggatgcatacagagataggctcatctcacctggcctgattaagttgtttacatttttcagaaagcccatctccaagtccagccctaaaataacagtgaaccttcatctttaatggacataagaccctgtctcagaactctttagataaacagagcacttttcagagagggagctagtgaccttgacaaattggctggctttcctctcattccagatccgtgacattcagcagctaagcctaatatgggaaacaagtcaatattttccagcatgctgggtccattttctccccccaatatttttaagcataagacaggtgcagaaatcacrtcaaccaccactggaggggtgtacagcagctgtcacacagccacacagtggcaaaagtctttgctaagatccaaaatgaaaagaatactcattgtaattgaaactatgcaggggacaragcttcccagatgcatacaaaagttctgaggctttgaaaagagacagatgtcacttttatactcaatctaagagctactacctttcaacagctcatcaggaggtaaaatcaaatcttcagagacaaaagacataagcaacrcatctgtagcagccagaaagtaaattttttaagctacgaagggccttggagacgattcagggtatgccgtcttgtttttcatttgatgacattaggatatcatacctaatggaaaaattaattgtgtgtgtatttatgtgtgtgtgtgtggakgcacgcacacatgcatgtgcatcatgatgatgtactacttaagcaataatgggccattatagaaggtaaatcaattaattctaagttgacattgtcatagtcaggtaaattgaggatctctctgaaaatccattttcctttataatctgacttgcaattattatcaatgtacccattatttacagccagggactcttctgcttggttagtgcttatgtcctactagttgttaaatattttgaaaattagccctgcttgtaatttattatataatttcaacaattttaagataagcctgatacaaaaacaggttcttccctggttagctaacctaagagtcaaaagccagcacagtagtgttacagccgttcagaatgcaaggtatcctttgaaatacttccacagaagacctccaagtagttttcaaaaacctggagctattaatatgattcccactatgttctttaccttccactgaagaaaacagagcctactgagaaacaactctagtgtacagagaaaccaaccagcaaaaccaagtggaagtttctattcaggtctgacctcggttatcttaatcataaacctgacccagttgagcctcgctgatgggctcataacttagttccctcaagatctttctgacttttgtgtaagcaacacacaaatcaatccagcatatcacttctgatatcacagaaaagtaattcttatgaagaaggaaatcattaattgtctttgaatgtgcacccaccaataattcaagttattaaagacaaaaatcttccctagtaaatgctcactgccggttgtctgaaatgagagagttgaaaatgaatacatgaatcaaggaggtttattttaagattttccatattttgatcaaatggtgatgattacattacattttttttctgtactttcccaacaaagaataagtcataccatcatgttcttccagaaagactctttgcttgaaacagtcttactggcacaccatagttagttatgactcatgggttttgtttttttctaagatagctataaacttcaaagatacattaccttataaaaataataaatattgcttagagaatttcatctattttctacataataattttatctttgaaacttaaaatagatatcatccagattgtgcttctgatatgttttatgacatgctgacactgtcctcctaagataatattagatgatataagttttatttttttaaaaattagcccaaggctttgtaggccaggttctagagacactggtcagttcaaatctcaaccagaagagctatgtgaccttggaaaaataacccacccattctgaaccttcatttcctctgctataaaatcaggataataataaaatctatctcaaaaggttgttaagactatcacagaagttttgaaatacaaaataattagaacaaagctggtgcatagtaagtgctcgcaaatactagctgttacttccattctggatatgtacatcataattcctaacttaaaatgctggtcaaaaataaaatttatgcctctactagtcagtaaatccagcctcttctaaacataaaatatttatttaaaataaagtttctagtatgaaatttgaaatatatagatttttcttaatacatttcagtatctgcttttataaattgaatgtaaccatatagtatttgacagacaaatgtgaatcatgttgtaaaccatatatttgaaacttatcttaaatttgttctgtgtctagttaaactaatttaaaaatcaaggttgctgcttcttgagctccttttgcagggctcctcagtgactgcagaggagaaataaaaacgcttaaaatagcgaaaataatgtgacaacattcaggcaaaggcaaggctactatgtacaggagagcatgttgtgcactacacggtcccgcaatggattacaatattaatgctgacctcttagggcaaactgtaggcactggtcatgccccatggatgaatatgaatacataaacttagcttcagttaaaattatgtcaaattgttaacagaaggaaaatgaggtttaaagtccattgaaaattatttttagataaatttggattaaaatccaatgtgctagcaggcctcaaaatgttaagtgatttcctgagaaactgtcacagcccaggtatacccttccttggcggaatcgactgctactttttcttttttaattgctgaattgttcaagtctttcccacaaaaggctgattattataggccttgggctacaagtagagaaattactggactagacctggagctgtggattctggcctaaacactgtcattggcttgtaatgtaattttgtgcagttttctcatatataaaayggaagtaataagctcagatctcaattaggaaaagtaccaagatactagacgtaaacatgctttggaaaacattggagcacattaacatatatagcattatcaaagtctttccaaatttcttatcatataatacatggtaaacaacaaaatagwaggaagacttcctctaacctctgaaaagtcagaaacttttcctaggtgcctttggtattttctaatcttactctgagtattgtttccctgaaaagatccattttattctgactcaggtacaatataagacaggaaaatggatgttatatacatagatcatcaatagagaataggaagaaaaagatamcgattattttgtggtatcattgtatcatgactctgaataatatctatcaattactgattactcactatgtaccaagcccagtaggcactatagaaatgtataatatcttattctcacaatcaccctatgatgtaggtgataaaatacattccaaatgacaatgccaattcagtaaaattaatcatcttgcatgacagtatgcatctaagaagtcgagggagacagaattcaggcacttatctgtttggctccaaagcctacattaattccagttttcctcattgcctctcataacagctggcacagagtagacactcaataaatgttggatgaatggatatatggatagacacacgactgcatgacttctgggaattagaatttataagagcaagactgaggccacctatctagactgtcacaaactggagatcagcctccattgttcttcctcttctgtaatttgaaaaccctaggttacaagagtttcttcattgatggtataaacattacccattctcctagtatttctgccttcacagatgagggatttcaaattcttggagcccattgtgtctcaccttcatcaccaagatctgactggggggtatctttctctagtgacgctacaacatggcatttggaaatttgcttaggcaaaatttagtcattctggtcatggagtagtgctctgccagaaaggggtgctcaaatctaacttgcagagcctttaagggaattctgcagaagctgacaaaaatattaagaccctagagctatggcatttggttttgttcttgtgcattttgcaaaggtacctgaccacccaaggaagaagaacctttttgcttgttagccttcatatttcctacatgtgggggctgcatctgcccaaagagttcctctttttctaattaacacaaaggtgatggataggccagtggctgtctygtgcaaatctaggatgcgtttcaataagccagacccagcaaatgattctcaagcttagtaaggtttgaaaaccactggtaagagttttgggagcagaggggattcttcccaagggaagtgggagtaaattgagccttaatgagtaggcattgcttgctatcttgttaatgtattgaccctgtaaaaccaactgatatccagagttaactggcttgcagagcttgggctgagaatctttgcaagttattgtcatccaggcaataaacaataattacattatttctactccttagcaaggaggaggcaagctttgcaggcagctagtaagagttgtcagttccctccagtgaaatgttctctgcaaaaagtcaatagtcaaaaggcayaatgctgtcatttcagagtgaaattaattcctcttattatttttacctgttgctctgttttcctgcagagtaaatctcagtattctgactgtgtttaaaagcatctgtatttttccaaagtggttgcttaactgatttcaactgaatttggcaaatcacactctaagaggagccagaaaactgatgcagtgacaggctcaacagtaaccaatattccgtttaatcctaacccttaggagatctggcaagggcctcatcctcctacgggacaaaaagagtttagaagctttttggggaaattatgtagtaagtgcacagcaaaaagaatgcctaatggctttgctttggggaaagaaaactagtggtaataaaaccatggaatgtagaagataattcaaaagggaaaagtggacaaacagccataatgctacctagctctgtctaaattgaattcatgacatgtatctatcacacatttcctgacaaaccatctcctgatgggaaatagagaataaacaggttatgtgaagtctttagtataatgttttctttcttggtcaataggaccaactttatcaaagatatctcccacagtctggcttcaccaagtaaatcaaaagaagtgagatgtaatcttttattatcattttttcctaaatttactatttgctcatttattaaattgaaagaatacatttattccacagtagaaatgagagacaagtaaaaaatactttagaagaaatatatccagaatatgtgtgtgtatatatatgcatatatatatatgcatatatatatatgcatatatatatatgcatatatatatatgcatatatatatgtttgatcctgaaggaagattacaaagttttcttgtactcttgggcatagtgggaaggacattagaatagggtaaagagtcctgggtcccagtcccagcactggtgcttaccagagctgtgccagtctggattctgtcaggaaacagatgatacactcaaaaggagtgactcaagaaagttaatccagcaaacctttgcaaaaatgtaggccgacttagggggagctggcaaggatggtgaaacatggggacagcatcagcaggatggcatcaccatcctaaggcagaagacaaggggaaaatttgctagaactgctgaaaagtgtgcttacaggagatggtcaccagcattgcagccactactaagctaggcctgaagggagccagagaaattagagttctcctttctctctccttctgccacctggacttacgcatatgaaccctacatatggccaaatgcaaccagaagcagtgagagggccctctgaagcatttcataaaggtgagcctctgtggcctggagcagggtacagaggaagggtacatagaactagaggggccaaaagcagttattgaacacacaaactatgcaattttgatcattcatccttgctggccttcagtaccagcttccagaacattaagaatctgagccagataatctcaggagtttattccatctctagtatcatttgtgaatattgaataaaagagaaaggaagaaaataaatattctaattggcccaactgatttatttgaaacaggaagatttagcaacttagcatttattggttaacaaaccacaggtcttttttycctccacctgctttcttgcaaaaaaaaaaaaaaaaaaaaaaaaaatgcctgtgcctgaaggttatttagaaaaactcttgaaagctattaatagaaagcagatttaaactcagtctctaaaaggcttaactttgtgtactatagttctgcctttgtagaaaaataaaaagcttttttttaaaaaaaaatagcatatagctcagattattagctatctctttgtcacaaatgtgcagctgggttcagaatttgcatgtttcccaggcaaaagaattcaataagtaagtaagcgaatcctgccattttattaaatacttacagaaaacaaaagcaaagcaagctttaactcagccggaaccagaacataatccccagagccaataacacatgttaaaattccagcaccagagccaaatttgacaaaggaacactcactatcctactactcctggggcaaactatcctaattttgattctcacactcttgcattttgagatcctccaaatatgactgctcaaagaagaaggaaaggaattaaaatggggagagctaaggtttgagatttaaaatgcactttcaagatacgtgataaatgggaggttcatgaaagttccctttataggtcagatatcatttaacttgtccaagtagttacgcttctattcagacatagggagagagagtgtaaatgaattatctcctccccacagcctttctacagacccttctctcttaattatacacatcccyattgcacaggtcctgccaagcgctggtatccacagggtagatgttgaaaaaagttataattactatcttcagtctgctgctattttacaccctcagactcacggcaaaagcttacagcagaagttggcttagtgtcctaatgcagcagattcaactttttgacaatcttttattctcttcaaaacctcttcctctctatagaatttcatgttcccaaatcttcagtgataatggtagcattctcagggaatgcctggattgatgatcagggaactctttgagctagaaaccaagacaggatttctatttttattcctgtttcaatcctcatgcccagtaaaaataatgagatgtttctttaaatcatttattttatgaagaggagtcaggattatcattctttccacttctgcggcaattgggccaagagaacaaaaatatgcaagggttcagaattcagtcccctgagttctaagggctctgcccctggttatttccatgagcttgggaaagagaattaacctctctgggaaatctggaaaatgaactggtgaaagtagatgatttctacaactactttcaggtctaacattccacaaccttatttgtgccaatgcccccattctactctcagtgcaactgaacttacttgtccctcattgcaatctctaatttcttaagctcgtcctaatttcttagcacacctttctttcttttcctagctttaattttctctctatccgaccagaaactcaggagtaagaaactttgctgacacaaactgctatctttcttttctctttcttagccccatcttcttctaccaaagccatttggcaaggtctccaatctcaagactccctccacatctatactcctatgtctaagtttctaagcatgagttggcaacacctcaaacaacagatcctgctacaaggctagtctgtactgagtttataattgtttcctttcagaagtctcttcaagccaggtatgtaagtttcccatgttgaccctcatagctatttgaaatttttttttctttgctagcagactccctaaaaatatttctttctctcctctttcctcaagctctctgccttctctctctgcagataactttatttttcataaagtgattataataaaaccattttcacaatgaaaatgtgtagaatttaaaatacagaagttcatttttagtttaattacattaacataaaaaatgatcacaaatctcctacaaaaatcatggagcatttttgcatttctatatcacttccaactcagcttcattttgatttataagcttgactacacatctagctgtcaaaccagatgttgtatggaaaataccagctaagtctgattgaatttttcaatttgcctcatttgaaaccctacagcaaaacagaagtagttaagaacttcaaaaagttttagagtagagaactaattactaattacaatgatcttttctcagataatatgtagcatgaaaatacaagttaattattcacaaatgactacaagagaaaagagagaaaaacagaagacatttgttaattgaatcaaatattgtgaacatattccatctttgacattctgaaagatattggaaggttcatttaaatttgcaagcatctcttcatagcataatattccaaattaaaattttaagggggaaatacagaacagaacagaatggcataggatctatggtggatagcaactttagttttaattccactttgtgactgcccttagaaaaggggggatggtagggttaggaatagtgacagtgttgataaagcataggagaaggaaaggmtctgtagaaatcttgagagtgaccctaaaatgggaatggttcttaagtttttttgctaaggactactagttaatcacaagggatcctttctgagaacaatgtttttaaatgcataaataaaaatataggactataaataacttcaattaacttgacatagttatcacaatattaaaaacacaaattagtgatacagtaatagatatgctaattcataaaatgttcaatagcaaggtcttctagcaagtctagaaactgccatcatttcaaaaaaagttacgaacataaacattatctttaaagctagctataatacctgtagtctattatgacaatattggtgatttctattgttttgtatagtctctgatctccagttcatctcattctctctcttactcactccaaaattttgctccacaattctaccaaaactgctcyccttaaggccatcaataaactccacattgctcagtctaaagtcagttctccatcctcctcttacttgaactgtcagcactatttgacacagttgatcacattctccttcttaacctaccatcttcattacattcaagcatgccactcactggtgattttcttccaacctcactgggactctcttgwgaagttctcttttccatttcatcttaccaacctcttaatgttggggtgtcccaggttagcccttggaccttctcttttgtgtgtaaatttactcctttagtgatttcatcaatactactgatatagacaaatcaagatgactccagatttatatccatagccttgatctctcccctgaattctagatttgtatatcctattatctatacaatatttgcatatattaagtttgaaatgtctattactccttgaggacatttcaaaggcttaatagacatttcaaacttaatacatgcaaagtgactatcctgatcttcacctccactccctccccactaaacctattcctcctctaatattctccagtccagttaatggcatatggaggccaaatgtttgaagtcattcttgatgtttttccttctctctcaaagccacttccaactcatcactaaattctatgattagaagactccacgctgtaaatgtaacttaagtctctcattttactaaccatattgccactactctggtttaagccaccgttattcctgtcttggtttattgaagtaaggcttccaccttcacctcatctcaaaatgtgggctagagtgatcatttaaaacataactcatagcagtcactttcctgttcaaaaccctctagtgacatcccccatttcctcatcatgaaaggcaaagtaattacaatgcctcaaggcctaacagaatttcatacaatatacattttctcactgaccttatcacccactagcctctctttggcttattacaggaagagaacttcctcatggtctccgtacttacamctccttctgcctataatactcttgccccaaatgtctgcctcctcaactcctctaagtttttttttgttttgttttttgtttttgtttttgttttttttttgagacagagtctcactctgtcgctaggctggagtgcagtggtgtgatctctgctcactgcaatctccatctcccgggttcaagcgattctcctgcctcagcctactgagtagctgggattacaggcacgtgccaccacacccagataattttttttctatttttagtagagatgggatttcaccatgttggccaggatgttctcgatctcctgatctcgtgatctgcctgccccagcctcccaaagtgctgggattacaggcgtgagccaccgtgcctggcccacctcctctaagtctttattcaaatgtcccttcaataaggccttcatgataccccctacttaaaatggcttttagaattgtttctccttattttactgttctccaaagcaattatcaccatataatatagtacttattttattcatttgtttatctgtcttgcccaacaatgcaccccataaaggctgagatttttgcctggtatgttcacagatctctccccagtgcctggcataaggcaagaattcaataagtagttgttgactgaatgaatgaatgaaggggttctttggaatcttatcttccaggaagtctagcacatttatccattgcagtaagactcacacatacttctacttgccaaaactatatcatactctgtaaattaaccaaaattattttaaatgtgatgcttgaaataaaacaaagctagtacttacagtatttgctatagaaatactgtaaaaactaactagtggctcacaaccacatgggacagtgcatccacaaggagatgcttcattatgccatggaagagcaagcactttgacacaaacagacttttagctttgaactccacctctgcaacttgtgagctgtgtagcactgggaaattatttacctctataagcctcagttatttgcttgtagtatggaaaatgtgattatatgattaatgcatcttaaatgaaattatatgcacaaagttcctgggcacttgaaaaagatgatcctttcatcattcctcttgacaacgattactttccaagtagatgtgagcaaataatagtgtacttaaaaatggtcaaatataagaacaggattggaaagactgtgatcagatgaactgatcacctgcagtggtagtttgggtagagaggtttactgggttcaccctaaccctgacagttcccacaaaaatgatatttagatcccttttcagggtaaggtatagagggcatgtcgaaaacaggttccaaaatagaaggagaccaagactctattcatgagaaagagcagggtgagacattatcatctgaaatggaaggtgacaaagccaagcagaatttgggctagaaagtggtgttgccccattctcaaggatttgttgttttatcagtgcatagacatcaattttttttttttttttaagatggagtcttgctctgttgccaggctggagtgcagtggcgcaatctcggttcactgmaacctccaactccctggttcaagcaagcaattctcctgtctcagcctcccgagtggctgggtttacaggcatgcaccaccatgcccagctaattttcgtatttttttttcagtagtgatgggttttcaccatgttggccaggatggtctcgatcttctgacctcgtgatctgcctgcctcagcctcccaaagtgctgggattacaggtgtgagccaccgcacccagccagacatcaatttctgtccacagtaacatcgtaggaaaaactttgtcacactgctttgggattcagcacaacattcttctctttccttagacatttaaagtatgaggattctacattgaagagcaggtcttttttttttttttccgcatttcaatctagatgtttacattggtgggggagatacacttagaagcagtgtgctttttcataaatcactctaccttgtttctctcatactttaaaattacatacatttttaaactggcacaaaagtactgtcttgggagaaggcaagaaaatagataaaatgttcatcagatgataacaattgyaaatattcataaattagggaccaggattcctatttcctaaggaatgtgctcagcctgggagaaacctcactttagaccagtggggctcttgggmactttcatcatgacatttaaacaataaatgtatctgtcaggtgatggtggattcacttcggaggaactgacacctttgatgaccatcacaggactgagtcaccaattatacctacagcctgcacttggttttcttctcttacagaatttcatgatccctccctaaaactgataaggcagcatggaagtaggagggaaaagggaggagataaagcagatgagaggcagactgcaaacccatccagctttgcaaggactgagcttcatcgctcacagaaaagtcaagttcaagtcacaactcaaaattaaaccctgactaatgtaaaaaacctgtgtttagaaacattttacacaaaagttacattttggaataatagaaaatttaaagctattaaaaagcaataaaataagatgaattctgcaataagattgccacgttccactcttgaattaaagcaaacaagcaaatatttccttcctaaaacttcctgcctttattctgctggcttccactctgtgagggccaactgtgggtcaagccctgttctttgtcccatgccaaaaagacagctgggagccacggtggaaggcagacaatgccctggatttaggtactagtctcctccaggttgtgtttaaaaagctgggtttttttggggtttttttgtttgtttgttttttggctcggcatggtggctcatgcctgtaatctcaacactttgggaggctaaggcaggtggatcatgaggtcaagagatccagacgatcttggccaacatggtgaaaccctgtctctactaaaaatacaaaaattasccgggtgtggtggcaggtgcctatagtcccagctactcaggaggctgaggcaggggaatcgcttgaactggggaggcagaggttgcagtgagccgagatcgcaccactgcactccagcctggcgacagagcaagactccgtctcaaaaaagaaagaaaagaaaaaaaaaaaagctgtttttttttttttgtaattaaaccaaactaaatatttcccaggagggcaagacagttcccaaaatgtctaacgaacttccacgtagagaaaacggttactgattgtcccaaagcaaaactgtagcaaagcctttccctgaatttttctctcttccttccatcttcttttatttctttgctcagtcaaaggccgcatatgtttcaaaggatacttgatataggagggtagaacagtactttcagcatgcagattttttttctatgttaagtgaaaataatgatttcatgaaatgtgccttcccatcattataaaacaattttgagagaaatccatcctccttggcaattccaaagcctgttgtttgctttgcaagcactatataagtctggagaggggcctgaaattaatatagctcagtaccataaaggcagtgtatagaactgtagtcaggacttaagatttgagtcttttgcttccttcactttgacatattacttgagaggcctgtacctcagtttcctaatttgtaaaattgggataacaatagttattattttatagtgccattttgaaaaatagtgaagcttctgacagaagacctcaataaatgttacatattttaaccatcagcattaataaacgaaaacaattttccctatttttggtcagaatttaggaaaaataagttccttttaaattatgtgtagacaattaaattaatcttttaagtaaaaaagtcttattctcatttttgatgtacagaattttagcatcatctaactaatcctaaaagactttgtataatgaaatgaaaaattaatttatttgatgtcattactttttaaaataaccaaatgtcatatatttatcattttaaagaattaatatgcagctgggttaactcggctatgtaatatatttttttttcaggatatacctttcagattattcaaagaaatagctaaaaatgagctatcagattcaaagaagctttttaacatagccaactgtaggtcagttttagtgttaaaaatttaatagatcatacacctaatttacggcgagggggaagcagtggctacatttaaccaaaataagatgttcttctacaaacattaacataagaataaaaaccacaagttttggggtgatcactgataggcaaaccatatttagaacttagcagggttctaaatctgtaagaagaaaataaatatggaaaaaaacaacatgaatcagtgtgctctcacatctccatatctctgtgttacccaacatagaactatagcttatttaagacatgtttagtagcttttcccatactttcctgaattcattccctgtttcaaattcaactaaatgggagaattagaagagaaattttttgtatttggatatcatggcctatcttacatttgatatatgctattgcaattttcttaaaatataagttcatagcgcaaaaagaaatattaagtataacatagaacctggtaccactataagcaggtgattattaacactccattaggaacgttgatggttctgctaatgaaacaatggttatagcaaaaaatagactatttttctggaaacgtgagatttttcttatgtgtacaagcacatacacgcatacattagccttgacataaaccatgaccttctatttgttaacaattaaaacattgtcttatataagcccaggtcatctgctagtggatagatatagatataggtatagatagatatagatatggatatagacatatatatatatagatagatagatagatatatgtagatatacatatatctacatatgtgtatatacatatatacacacatgcatatatatatacacatagcatgcatatgaattacaattaattaatcaataatggtcccatctggttaactgcattggaaaatgacatctttccctcagcaatacaagatttcaaccactacttgcatctgcaccctctatacctttaagcagtatgcaaatgatacaaccatatgaggcgggactatgtaaaacagtccattaaaataattttcccagatcaaataaaaactgacacattttctaacatttattaagaatttttaaaaatgaacgttctaaaaatgaagtcttaagaaaattctgaggtgtgaaacataaagataagagtgccagtgagaaaaataatctgtttagtagatttaaattatcattatatttcaccaaatcctgttaagaaagaatataccccctcgaaaggttcaattctacaacaatgagtagttaataggttcttagaagggaggaagtcattgtactactgaatagyaataaaatctatgattcagtgtgtttcaaacatttaggaatgctttttgatgaatgggttttttaacagctactgaattggatttgtcctctttatataaaagtctaagtctatactaaaagaaaagaaatttatactctgagcatgaagttaccacttggaagtagttctttgccccatgactgctgagcctgaaaaacccaatctgtttctagaaaaaacttgccaacaaaatccacagaatttattagatagaattactcaagagcaaaataccatctctaccatcatcaaataagagtatgttgctggctgtggattttggtatagttttaatttttaaaaacagtttccaaaacaataccaagaggcagtttgattctacagtatggcaagtaaggaatatcagacactattttagagtatatatctaaataaatattatatatatatataaaacacatcgaaaaaagatatacatacatattagtttgacattaagggaaagaaattaaaaaaaagagacaagatgaatttaaactagagaaaatacaattttagaaccacatttaggaaagacaaaatgaagaaactggatatgaagaaagttcatatctaaaaaaacgtggttagaagcgattggattcaggagtttctgcaaacaaaaaggttgtctcctcagtgcctaaaacagcacctaacagagaaaagacactcaatacatattcattaaaagaagaataaataagtggctatgaaactgggtatacagcaccatattgagtcttaaagttacatttttaataggttaaatttaaatacatatttttggccgggcatggtggctcacacctgtaatcccagcactttgggaggccaaggtgggcagattacttgaggtcaggagtttaagacgagcctggccaacatggtgaaaccctgtctctaccaaaamtacaaaaattagctgggtgtggtggcatgtgcctgtaatcctagctgctgggggcgctgaggcaggagaattgcttgaacccaggaagcggaggttccagtgagctgagaacacaccactgcactccagcctgggcaacagaatgagactccatctcaaaataaataaataaataaacwaatattatatgtaaatatatatatttactttatgagctatttcttttaaaataacatccattgctttattttctgactgcaaaagcaaatatactcattgcagaatatttttaaaaatcaaatattaataagaaaatgtaacataatattaatagacagataaaaccaccagcaaacattcatacatctatgcacaggcatttatatttacaaatgtgaaatgatactgtatatcaattttatgtcttatttttataacttatcattacattgtgaacatttccatgtcattaaaacttcttcaaaatcatgagttttaatggcctcatatcgttccataaaatgaatgtgcaataattgaattattatgctattgatgcacatttgaataatgtataatatcaaaaagttggggagaaaattttaagcagctttatccataaaactttaattgtatcttggattatttcctcgggatacatttttatatgccaaattgctgcatcaaaaggacagatttagcatttttgatccataacaccacactgttttcatgataatttgtattataactgctcccagtagttatgaaaatttttattccatgatacttcaaactagaaattttaagatctcttttacaatttgataggtcaaagctgatatacttcaaacttgattgctggtgagattgaattttttgtttgtttattaactatttgtayttcttttgtgtgagctgcctcacatttgaggagaaaagctgcctctcacaacattcataaggcttcctgaccctagagaccctctatatttccacaacatggagagtatctgtaactcctatcagaaacatcttagtgaaacagcatgaaagtttatgaacctcaggattactacatgaacatgagagtaacagtactgacctacctcagagatttctcccacatcattattacaaagtactataaggctagaattgacttggagtcaaggcgagttccataggtttaatgcgtggcacctatctcaacaactgcaaaatcactgtaacttgtaaaaaatcccagggccactcatggacagccacatctttaaacccacacaaaaatacagacactttgattacatgaaagttagaagctctaaactagagcaaggtcagttgtggtaagaaggtattagattcaagcatccacaaaagtttatagtctgtcagtcataaggatggctattgggatttctttacagttactctgttgtattttcactttggttttacagcactatctcttaggaagtcatccatatattacctgcatacacagtcagcttcttctcgatatacagcagatatgtaacaattattctttccttcccagacagtcatggtaatattacatttgagttcagtgaggtaactggtagccagaaatactccacaaaaggtctatattcttgggtgggggggggatacaattcttctattagggaaatttttatcacctacttatttttacataaattctaataatgccaagaaaatacatttcaaagaggaaggtatagaaatttagagatgactgtgacctcaaatatccatgaaatataaccagaaaatctgcatctacataatgacactattttcacatagccccaaaatgatatcttagaaagccaaaaatctttccttatctccaggcagaactatttcaaaagataacaaatgattgcccaagtgatatttgaattataccaaaaaagagacagtatatacatggtaacaccatcctctgtgtattatttcctcttggtagtccttctgtttttcaagataatacagatctcaagaattctcaatgttcaagcaagaaaattccctcaaccaagtgaaatagaaagaagttatctattaattgtgccaggatttcagttgttttctttcctttcttcttttcatgcaagtttatttgcctttctatgagtatttgcattatttgctctttttcccctttgaatcatcttaaaggaaaaaaaatgaaaatgtatctatttggactttaattacactgggcagcaatgaggcaggatagtgaagttaaaaaaaggctgggtgtggtggctcacgcctgtaatcccagcactttgggagaccgaggcaggcagatcacaaggtcaggagttcaagaccagcctgaccaacatagtgaaaccccgtctctactaaaaatacaaaaattagctgggcatggttgtgtgagcctgtaattccagctactcaggaggctgaggcagaagaatcgcttgaacccgggaggcggaggttgcagtgagccgagatcgtgccactgcactctaagcctgggcaacagagagagactccgtctcaaaaaaaaaatacatacatacatacataaacagtgttagaataagcataagactgtgcttaaatcccaattgtactctttataatttgtatggctttgtgccagttttcatcttctttaagcctataaaaccaggagtgtaattcactcctttactatgaggattactttatgtaatgcacctagtagagtgcccacttagagtaaacactcaataaatgacaaatgtcatcattataactgtgttggtaagaacaggtaagggtataaaccactcccacctcactgaatttgcaggcaattcctggcaatagtgcccaacaaagagaaaatataccataaacataatttattttaattacaagagaccctgtcatctctactattattataaattaacaataggttcttctctttaatatttctcatttctgagccaaaatcattttttttcaacaaggtcagagcatattcttttttttttaaacatgctaatgtacttcagtatattccattctgtaatatttgtttcaggaaatgaaaattaaattttctttaattaacccccatgactcttgaaaattttcctcattgtccttgaatctatggtctttaacagtctttataatatcttgaactctacactccactgagcttttaagctttgtttagtgttgccatagcacacctactccttatgatagaatatcgccttctcaaattaacaacatatagtcaatttattgtggttttccagtttcactggaatgaacaaagatttctttctctcacaggctaaagttttctccctccttcattattcggcttcagagttcaactcctttacccacatgacataatcagctcaaaatttattatactatatatagcatcaaagaatacatttttttagagatgaaatgaggtctatgttgcccaggcttgcctcaaactamtgggctcaagcagtcctcctgcctcagcctcctgagtagctggacctaaggcacgcaccactgtgccttgcagaatacattttattaacgtaaaaatcattattttcctcttacttctgcataaatggtatttttggtccatttgctctcggagaatagttaactttgtcattaacaggcccatccagattgttttattacttcagttgataaaaatttatttcataaagtgctttttctaagtaagacatgaacataagcaaacccataatattaaaagctttatatagatacaatttaaaggttctgtcaaatagattttttttttttttttttttttttttatgaaatggagtctggctctgtcacccaggctggagtgcaatggtgcaatctcggctcactgcaacctccacctcctgggttcaagtgattcttgtgcctcagccttctgagtagctggaattacaggcgcctgccaccacgcctggctaattgtctgtatttttagtagagatggggtttcaccatgttgacaagtttcatarattaaaaagtaggataaataaatacagtagagagaaataacatttcagaaatgtcagtattaaaaactaagtcaaccacaagcagttttacatcatgtttacaaaatatgctataatagtaatacacttgaggagggttaaaaatggttctytttttattgcttctcagccttttggctaagatcaaatgaacagttctttttctaattgttcaaattgatttcatagtcttgtaatctacatatttatgaaaaataattttaaatctcttataaatatcaaaaatgtcagtttccaattgaaataaaacagtattgagtaaagactataatgtatgagttttgaaaaagaaaattgacaattagaagaaaatttcataatattcattgtactaggactttccacatttttgatatgacgctaacatcaatattacaatgaattctcaataatttgtattaacaaatgacaagaacaatctgaactaaattgaacaataaagtatctgtaagcttagaagcattaatttcatagtaactaaacttttggtaaccaagcaattctatatagaagacttttaagtatgcccttctaagtttgttttagtaacattctcatttataattagcaatatataatttattttttaaagtgctaaattaaatacactctcaaataattttgttagactattaaattacttattttgtttcaagacggagtctcactgtcaccccagctggagtacagtggtgcgatctcggctcactgcaacctccatctcccaggttcmagtgattctcctgcttcagccttcccagtagctgggattacaggcacccaccaccatgcccagctaattttttgtatttttactgagatggggtttcaccatgttggccaggctggtcttgaactcctgacctcaagatttatccccctcggcctcccaaagtgctgggattacaggcgtgaaccaccgcgtccagccttatttatttttaatcaactttattgaaatataattttcataaaacaaaatgcataaagtatacggtttaataggttttaccaactgtatacaccagtgtaaccaccacacaaatcaagatataagaaaatttctatcaccaaaaaagttgccctgagtctctctgtagtcagtcttcttatgccctaccagatagccactgatctgtctctatcaccacagattaattttgcctaatttcgagcttgatacgaatgaaatcattcaatgtaggtttttgtttcttgctttcttttgctcattacaagtttaggcctacttctgattcacagcttctggtgacataggctggagaataagttattccttaagaagaaaggagtaatctaaaaaagtgcttcttagcagttcattcattttaattgctgagtaatactcccctgtgtattcctatacagcacactttacgcattcacctgttggtgttgatggacatttaggttgcctccagtttttgactattgtgaattaagctgctgtaaacatttatatacaagtcattcgccagcatatgtttttatttctcctgggtaaatatttagaattgtaattactggttcgtagtgtaagtgaatgcttacctttttaaagaatcttctaaactgttcttcaaagtggttattccatttcacattcccatcagtaatgtataagagtttcattggttcatatcatctactaatacaacacttaatatgtgactttttgtttttgttttgtcattttaatgagcaggaagttatattctcattgtggttttatttttaatttccctaatgactaatgacattgcacatcttttcatgtgcttaccaaccatttgtttttttttttctgaagtgtctgttgaagactttcatctatatttagttgagttgttttttcttcatattgaattctaagcattcttaataatacattttttttaaggagaaaaaagtattccagtccaggtcagcacaagctctgagtcaagaataggtctaaaatccacagatgcaattctgaaacaataggcctggaatcaaaggtagctcttgatgaagaggagatgagtaatctggtattttagactccattaagactcgccattttgtagctgaccaaaagggtcattctttagtcccatttaaaatcggcatttcatcatttcaaaaagcctgcttcaatctaagcaaattatcatgtgattctgcaattgatagctagctcaataactgatttatttgataagagggaacacttagaaaatatacagctctcatattttctaataaaggtattcacatataattaatagtaataagtactatctgtgagtagtatgcacaacatgcatgctgctgtcttttgcaaagtattaaagcagatgcctaagcattgtaggtaaggatgtacttgacttagttatgatttgattaaatgttccctgttcagattggcttctgaatcatcagctactggtgtaagtaaaaataagttggaaaggtttccctttcctgaggatttcaggaaaagcttcgcaactatttggctggatattgcaaatcagatcaagaattgggaagcggtctgtctttgacttatcttgcactatccaattctatgagtctatgattgtcatgtacagagcacttggcttagtggtttgtgtataacttttcaggattagtggtggcattgagctggttcatccacaagtttatctggttctccatcaagctaagttcgtcctatctgcagagcagacacagtatttctgctctttattcttggctgtttcctctatttagcactcctttctgtctgtttttctaagttaacacatgatattttggtattttaaactccattaagacttgtcattttctatctgaccaaaaatcttggtcttcttcaatcagtatatcaatacctccttataggaaaatatataaaagtcatttattctaaagcataaattatagaccaataactgcttaacatgctactgcagttaaaaaccagagttgattcttttctaccaactgccctctttaatttccctgtataaaaggcccaataataggtcagttagtccacaaaattttgttgaatacttactgttaggtgctagtagatttgtattaatgaaacaaacattgttcctgcctttgtaaaacatatgttcttgtgagaaggactttaaaaataatttaaagtaactcatgaaataattataagtatttctaatagtgcaggtgagaaacagtgttggagaacatagaaatggaatggcagcactaatatagggaatcagggacgatacccctgtaaaagggatatttcagctgagacctgaaattaaggaactggtaaggcagaaaaagtagagaagaacatttcagacaaagaaaaacatgtcaaacatcctctcgactctggaacccacatgacctttccatttttctcaccaccacttctattcttgccttcatctctttttctatagattactccaatagcctcattactagcctaccctacaaagtgttgaaagatgtcttcatataatataactgtaatgacatcatctcttcctaaaaatctacagtgacttccctaaagaaaaatggtcatattcccaagtttggcatttttggcccttttcaatactaatcaaacttacttttccaatcttattttcatgacttttctgccacactgatctatttactttcttcgtcaatacaattttattctctgaacttagtgctgttttctcattattcatttcatctagagtaagtctttaaatttcaygtaaatgattattttattggtaaaatgtataacaagtcacaggcctcttaggagatacccacgtttttgtttttgctcttgtttttgtctaaagacagtgattgctttccaaataactactttgatgtgcttatcatttggttactgaaatgaaccaaaatttaaatttctagtatgggcgagtttattgggcctttcaggtgaaaatcaatgtaattttatatctacaaatgcttccaggagaattagccaatggttgatagttccattgtctaaaataatgacctaatataaatcaatgggaaaatagattaaggcttgaaatggcaagatttgtttaaaggacctataatgggtagaatatataaaggttggccgggcacggtggcttacacctgtaatcctagcactttgggaggccgaggcaggtggatcacgaagtcaagagattgagaccatactggccaacatggtgaaaccccgtctctactaaaaacaaaaaattagctgggtgtggtggctggtacctgtagtcccagctactcaggaggctgaggcaggaggattgyttgaacctgggaagcagaggttgcagtgagccaagatcacgccactgcactccagcctggcgatagagtgaaactctgtctcaaaaaaaaaaaaaatgtataaagatcatatgatatgaccctcagcctaagcttagcaataaaactttagaaactacaagagtggcctctgttaagagctcacagaaggaacaattttctatgcttcactgtcacgtgtaaaatagaaagccagaggtacttcagcattcctatctaaagagcttccaaatgtgctctaaatttgtagatgtaagctgggccttgtatgttttaaaggttaaataaatcttcagatagctatctactattgttagataaaggagtcaactttttgccatagcaaagtaaaggaaacaggattctcttttctgagttgggtggatagtttttgtccataattctgtacttccaattgtcactaaagatatgtcatgctttatagcctcctatatgtctggatcacttgtgctttcatttggaaacaatacaaaatagtttataaatgtaagtatccttgtttaatacttatggaaccaaaacatattttaggaaaaatgacacttagtcaaacttttattcctaagtgtggaataatcaaggttgtatatagaaatccatactttagtataacatcatgagtgaaataaatttgcacacactatatatatatacacacacacacacacacacacacatgcgatgacgttcctgaaaatatgatcctagataattaagagaatggggagttgctattcaataggyataaaatttcagttatgcaagatgaataagttctagagatctgctgcacaacatagtgcctagagttaacaatattgtattgtgggccaagtgcactggctcacacctgtaatcccagcattttgggaggccaaggcaggtggattacttgaggtcaggagttcgagaccagcctggccaacatggcaaaaccctgtctctactaaaaatacaaaaaactagctgggcgtggtggtgggcgcctgtaatcccagctattcaggaggctgaggcaggagaatcactttaacctgggaggcggaggttgcagtgagtctagatcacaccactgcactccagcctggatgatagagtgagactccatctcaaaaaaaaaaaaaaaaaaaaaaaaaaatatatatatatatatatagtatggtgtacttaatatttttaagggagtagatcttatgttaagtgttcttaccacagtttttaaaaagagagaaaaaaacagagctgaaagaaactataaatagcaaataaaaattagcaattcataaagttccagtgaataaatacatttactaaacctgtcacattattttataaaggatttttatttaattaaataaaaagtagcatgaaagcaaggcctgacatatgcaacaaatgtggtcctaaattattgcttagcctgaattattattaactgtattttatgtaaatttcacaaagcctattatttgaaggaagccattactaaatcttgactagcgacaagtcccttgttaaatagccactcctcacatacttatttccttttttttttttttttttttttttgagacagtcttgctctgccacccaggctggagtgcaatggtgcaatcttggcttgctgcaacctctacctcctgggctcaagagattctcctgcctcagcctcctgagtagctgggattacaggcacccaccaccacacctggctaatttaatttttgtttttagtagagacagtgtttcaccatgttggccaggctggtctcagactcctgacctctagcgatctgcctgcctcggcctcccaaagtgctgggattacaggcatgagccaccatgcctggtcataactatttcttaagtaggacttttagaattggttcatcctaaagtgagataagcatacatgtatttgtgaaaatagtattcaattgagttttaatttgctcacagtattagaacacacctatggaagttttcctcatttttatgtatatttatattaaaagaaagaatgaaaaatttagtaatgtaagagtttctggcataaaattctgtatcacagaagctggaaaatttcggcccagggtgcagactcaggcactaacttgggggctttgataatgactctgccatacttctggccatgcgacctggaagaatttgttaaccattctatccctcaattgccacatcagtaaaatggggagyataaacagaacttagaacatagatgtttgtggggatgaataggattatataggtgagatacagagtactgttgtgcacacattgagtgcccaataaatgttagctataatctactttatcactatcataatagaactacagctttttcaaaatttcccaaaattttattctatggagaaaaggtcctttgaaagaactgacatttcctggatttgaaacactagactgaaaaacaaagtaaaacaaaatagaaaaagcctgtttttgtattttgttgtgttctgctttgctttactttcctcaagtaccgttggaacaccagggggttccatcaagtttttattcttttgtgttcaaaagaagaggaaggaaaacaaggttatgcattggcactggagacacttttttccctaaaatgtttagaggcctagaatgtacctaataacttgtaaagcaccaactgtatttcctggttactaatcaaatttgtttctatttcatttctgagccaggaaggcagacacaagttataggtaaatgtcaggtgctttaactgacctagggcagtcaataaccagtctttcctcccctgatgaagtcaattactaatttagagaccactgtgttccttgtctcttctcctaagccaagtataccacaagtcaacaaagataattctttcagcagccaaacactagggcgaggaaatgcttactgtctgcttgctctgttagcagcaaactatatagggaagccatcttctggctcacacagagaaaagagaaccctggcactgccacagctgtcactggccttttctgtttcccaagcaaaaatcagaattgaacaggaaccaaaactattgagaccttccttctgtttcccaagcaaaaatcagaattgaayrggaaccraaactattgagaccttcctacccacctgtgattaaatgagccaaatgagtagcaacgtggcagatggccctacagttaatgagattcttgcaagcccgcaattctgttgaaataaaattttgtcacttcagttttcagtacaaaattgtgccaactgaaccctccaacacttttctccaaaatgggaatcgtcaatctcacaagggtccattgtcagaggacaaccttcatgtacaagagtgttcaagataatcttgaattttgtaatggtctggaattgctatgactccctgtacaccagaactttcttctcacacattgatcacttcaagcatccacagtttttctttttctttcctttttatttatttatttttgagacagagtttcactcttgttgcccaggctggagtgcgatggtgtgatttcggctcaccccaacctccacctcccgggttcaagtgattctcttgcctcagcctccctagtagctggattacaggcatgctccaccatgcctggctaattttgtatttttactagagagggatttctccatgttggtcaggctggtctcgaactcctaacctcatgtgatccacctaccttggcctcccaaagtgctgggattacaggcgtgagccaccgcgcccagccacatccagtttttctagtagtttattcctaaatcaatatcctgactacagtyaagcatcctaaaaatgaatgattacatttatagctgttttctttacaccttcatctatatctctaaatattgttctgattagacctcctgctttaaaacttcatcagctcactcaggcataagtcaccctgcattctgcactcttctggattttgagtccctttgaattgccactgaccatatgacttacccatccccatttccatttccatttattttttttggcacttcaacctcagtatctttctcctcctcctcatttacagcatatctccattgcacttctggccaacttccatagcacattttcttccttctgtagctaaatctaaatctgcagctgttttaatatggcatctgtggttaatttttagtacaatattgcacatattgaatggcagtaatgcccaatgctactgcaatattatgcaagacatcaaatggatggaacctattaactcattgcaaactcatgcattatgaacatggcatagcacttacctgaaacatacagtacctgtatggagaaactacaggttccttcaacgacttaagaagtgaggacatcgagcacattgcatcatcttcctgctgctgcagtgttctataattttcccacttacttgctcccaaagttgcatcaaaagaacaaagagaaaatgaaatccacaggaagctcccaaaggctgcctatttggctcagctgtctgtcgatttttctaggttatgagattgctcttggtgacttttgacaatatgagaacacttccctcacctttaatgatgargcaaggggctccatacacataacattagatagaygagaattccacgaaaaaggataagccatccaatatgctagcatagaccaagatcttaaaataaatacatttgcattctggcagtttgaacagcagagttatttggaagaatggcactaaagagaatgagcccctttaagggcagccaagagctagattttgctagttaagcatttaatgtaaaacagaggccaaytggaataatcattttgtactggaaaaaagaaacacaggctttggagtcaaacagaattagtttcaaataccagccttgcccctcagtagtggggtgactcaggcaagttactaacttctctaaatctcagttttttcacctctaaccaaggataatgcattccttacacacttcttgagaagataatttgatgtaaagcacccaggacaatgtttggtgtatagcagttacttcaatttttgaaaggtggcatacaaacataattatagcaggctttggcaggaagaggtataaaatattatcttaagaataaaacagtaggtactgaaattagacaaagacaattgaaatagaaaaaaattgttmaccttgtgaggttatataaaatagaataaaagagatcaatgaatagataaggtcagatggcaaaagataagctaagtaataagacaaggaagaataaaaggtgagagaaaagaaaagtagcaaatagattaaaatgtcaaaatacaggtatgaatggagtcttgcctttccagtaagatattatgagaacattagggaccctaagagagaagctgaagtccttcagctgacctggtaggaaraaggggagaagcataagaccccagggacacaatgcaagctacatcttaagcagactgtctgcagagggcttgagccttccagctctgaaggcgccctcggctcaggcagcactaaaggaaatgcactaatgagcagaagggcaggttgctgagagcagcgactgccgaacttcctggtcaagcaggggttttttgatttcataaatcaattacaatgtgctatattgatttcacaaagtcagcaggacttaaaaactaatgagcaaatttttttattattatttttgaaaacactgcagtgtctacagctcagcacactcggcagaaagacaaatggaggctttggctgccacagatttcattccatcctagccccctcccagccatgttcctcatctcagcatcagcaaagaatcaggagctggcataagaccctggtgcattatgccaacaaatctctccctggtatctgaagcaggggcagccccaactaatgtgtctgtgtttaggcactagtgagttttgtacgggtgcccaggcatccccagatggagcaaacaaggaaaagaacaagaaacccacctaaccaaggatataaaatacagaaggactgcatttgtgattgtggttcttaataggtagccactgccattttcttcccaaccatggtaacatctaaactgsagtttttattgagctatttattttgtacaacatcaaacataacaaaattgataaggagattattctgccactcaacccctggcccaatgccaacagcttcagaaatgacctcaggtggagggaggcatagatagtttagtctttctccacagcaaaataaattatcccatgatacagtttttaggaaaaaatgcaaagtgggggataaatacattctgctaaaattttgctgttaaaatgtactacctgttaaaaatgtaccattctagggttgaaaaataattaatgttaaaaataatagctaatgttttagcacttgctaggtgataggctctatgctamgtcctttgcatgcactatgtcatttaattcttagaacaacggtaaatggtagatactattattatctcaattttatagttgatgataatcgaggcttaggtaggctaaatatctcctgagtgccatgtggtaagtgacattatgaagtctcatctgtttacactagagcctgtgttcattccatcagtaaatagttattgagcacctaacacatgccaggtactattctaggagtcatccgctaccaaaaaaaacactttttaagtcaagacaatgtatttaccagaaatgaaaatatttcaacgaatgatgacgttctttcagaatatgatttcatttattgtcaggattgagaaccagaaatccagaagatagttgataaactggctaaagggaaactaagagaataccaaacattattcttagtatgtgaatacaacaaattagagtgatgggggaacaagaaggaaggttaaaagtctaagaagttaattttttcttgcatagaggaagcagataaaattgaccaaatgtaaatatgagagaaagagtaattactagaagtaacactaaggaaataaaatctgtgtttcttaggaagtcattttgtctcacaaacacaacaaagccatgaggatagattaaaaaataaactgctacataaacttgatcttcaaaatacttctcaatgcgttcatgattccttttaatattattagrgtaaatagtaaatatagcctgcagaagttttaccctcttaattttcattcctttatgctttttttcttgtatgtacttgatgactaaagtcacacttaaatgacttaagaaaatgtgctacaaagaaaggaaaacgaaaatttaaataatttatttttggtaattttcctttcactttcacaaaactcacaaataaacagaattaggtaaagacatgccccacaaaatactgccttttactgacacacattttttgctctgttttggtgctttttttttgtttaagtacaataagaacattaattcaaggtaggcacctgcctagatcccaccctcatttcctacaatcctctctcttcttcactactgttgagccaaaatatttcagttctacaaacatacagagctcatccctgcctttgtttctttgtctcagatttttccgttgtctagaatgttccttcctagatattttccttatggctgccttctgcaagactaacattatctaatacttcaccacaaaggtatttcctaccacctttatcagtcatgggtgagtaaaaaacaaatcaggtactcatatagtttatttagtaaaggggtgatttatagtaatatagtgattatttattgttataaagtttaacaatatgatagcacatataatgcagaattctgtactacaagagccagggaggagtggttaccaagggtgagagaataaaggaagaaacagttcctacagctcagaacatgaaaatataggggaagggtgcccaacaggaacctggccttaggtaaagaaaaacactgccaatcagtggggagctggcagggaggatccaggggaaagtatacccagccctcctcctcccctagttctcaaatcttctgcagatggttcccattggtcaaacacaaccagaggccagaagtaaggcagaccaacgacagagtccataaagtttggtcttctggagtggaaagcagaatggagaagggcaaagagaccaggaagggcaggtggaaatgatcatcaagaacccaatcccattgcccctagtcacttcctaccacattctttctgtttgtttatttgtttgtttgtttgttttttgagacagagtctcactctatcaccatgctggrgtgcagtaccatgatctcaggtcactgcaatcttcacctcctgggttcaagcgattctcatgcctcagcctcccaagtaactgggattacaggtgctcgccaccacacccagctaatttttgtatttttagtagagacagggtttcaccatgttggccaggatggtctcgatctcctgacctcatgatcctctggccttggcctccaaaagtgctgggattayaggcgtgagccaccatgcctggcctcacattccttcttttaattatttgcattgtacttacaattttgatattttctttttagtttgtgcatctgtttaactaactataaattccagatttgcctgtctggttaatcagtatgtcccagagattaaaccagtgcctgtatactttagatataattacttgccagattaattaaaatagcaagactgctgggcatggtggctcgtacctgtaatcccaaggctttgagaggccgaggcaggcagttcacttgaggccacgagttccagacagcctgggcaacatggtgaaaccccatctctactaaaaatacaaaaattagccaggcatggtggcacatgcctatagtcccagctactctggaggctgagacaggagaatcgcttgaacccagtaggcagaggttgcaataagccaagatttcaccactgcactccagcctcagcgacagagcaagactccatctyrctraactaaactaaaataaaataaagtagcaagacctctgtgattaaaaacaatacattgaaaaaactaatcattcatgaggaaatactctgtagtttataggagaatgatacaaaatgatacctcattttacctgacaagaattttagaatgaatcaactatagtcaactataccttgtaagtcaacttttacaactccatggctatcaggctaatcaggttgatttatcatatctagcaaaacagagatcatactacctatctgcagttaacatggcagttaaataacacatatgatagtcaatcatttctccatcaattaatctattaatttaacagatgtttattgaacacctactatgggattacactagacactgtgaatacagaagtgcaccaaatagccaaaaatcactgtcttcatgaagtttatatttgaataaggagtcaaggtcacatcgtcagaatgggcctcactaataagctgatacatgagccaagatctgaaagaagcaagaagaagaaaccaagcagatatacaagattttctggagagaaagaatagcaagtgcaaaagtcccgacgtgaagtccttttagcattttagaggacagcaagcaggcaaagttgtctagagccacgtgcgtaggttttgaaacacggacacagggcaggactaagggagagggaagcagaatatgttgtaaggacttaactttttctctgaatgaaacrggtggccacaaagtggcacatgacatgacctgattgacattgtaacaggggagcaaggcagaattagagagacagttataagagtatcacattgattcagatgagagatggaagaagtgatcatagtctgtggacttatatttgaaggtagaggtgaaatgatttcttgatgatagaatgtagggctgaagaatcagaaaggagtcaaaaaatgctgaggcttggggtcttagcaatccgagatgcccagaaagactttgttatttgtttgtttaatttattttccagttaactctgaaaaagagaggctcatccagttgttatttacctcattgccatgaaaattcatccagttactactgtctcattcccaagaatcattgaggaaatgtcttgtccttaagctttgtatagttaactttggaacaccatttttccattcaaagacttaccattacactttaaacatagaatataaacataaggtaagatgctggcaaaataaaaattatgaactacttcatttctgtgaatttagctcatgataactaaatttggataaattttgcaaagatggattttgatccagatttaagatttaatcagtggctttacaatttaagttagtttacaatgaattaaaggaactcctttttatgcagagggttttaaaaaatcaggttttcaatttttcaaatggtcttttaaaaacatttctatcataacaaatgtgggttaccaaattataaggaattagaatataatcatatgctttagtatcaaaactttatttaatataatttagtctttttgtcaataatttattattctttaggatggcagagactgtatagtatcatgaaggaacacaggctttgaagacagaaactaagctcaaatttccaattcctttgtaacttgctggcatcataaacttggatcaggtttcctaatcttcaaactcaagtatcttcattgatttaaaaatgatccccaaaataatactacctcacaggatcattgaggtaggattatattcacaggattatattcaagttttctgtttgtttgaatttagctcatttggaatttactaatttaacagagattatgattttggtagaaattcatcaaagcaacatttaagccaatacaatgattttctagctattacacaaatactcatctaaagttaaagtatacatcttttactgacattccacaaactcagtcattcttactgagtggaaaagctccaacttctgtgtattgtgtgtttttatttggcagtcactttgacaattttattctgaatttaaatctatttttagacctgcatgcattattttatatagtattgtgaagaagctgatatttttgtttgatacactatgttatgtcagtgcttctgattgccaaaaccaacagttcatgtttaaaacctttcagaacattctgcagtctgattaggtcacctctsaatactaggaactaaaatgagaccacagctaagaagaaaggagacaggtgcaatttttttcctacttattctcatttcctaataataatataatcaatagatcattataaacctctttcctgaaactctgccctcctccctgtttctctccaccctacacacacacacttaaatacaccgggttcccctatttgctccactactcactgaaggatcatcttcctcttcatttccttacacatccgggtgcttcctgggctttggtcctcgatgtttcctctcacttaaaaaaaaaaaatcccttttctacctctcttttatcagtctcgttacctctcatagcaagaaaaagtgtttttttatttcctgtatttcctggaaattgtatctgttttactttgatggctcttgtctagcagcaagaaatgaagaatccgacttggagtaaaatctttttgaaggtaatgccaagcccttattcctcttctttctccaattgactgtagcagagggccctcctaggggtcaatatttaactctttaattaatcaactgttattttagaatacagcataaagttctcacatatttaatatatgtcaacttattccctaaaagtccacagaaacaagcattgtggcagaggaaaatttattgaaaaatattgttccaaaatcttgcttcttgattatatttgtaggtataacagaattagactactttaatagctgaattcatttttatttcattgtggaataaaatgagtgctgcagatgccacactatggtttgattgttatatatgtttggtcatgtgggattagcctgatacatgtatgaactcaaatatccatgttagctaacaaacaaaaggagtgggtaaagagatgtgtatatatatacatactgaaagaactttttctatatatgagtgaatagcttacctaacgtaacagtctttayataataagactacttatttaaattttaaaagaatttacctctagatgggtttttgagtgaatttcctcagaaaattcattttcatggcacagaggattatcatacttggctgctggtctgagctcatccaggaaacagacttgagtgcttttattatccactagagtagatctcaaagaacagaagttactctatgattatttagcggcaataggacttaccacagttcctggcatttagtgttcaagaaatatttgttgaacttcattaaaaaattaagatagccacctcaatatcttagtttatacacacattttcaggcacatatatattatacgaagagaaatgcaataataatccttgcataaaacagatgagaagctcatctcactatgagatgggttggagaagtcttcattttctttaagagtttatactcaagcttgtcagtagacawcattaagctgttatgagattccttctcttgctcagttgaatctgcttcatgaaccaagtcaggttctcttccatggcaaaagtaatgaggtggggccaatgtgtcccattgtctcccaatatccacagcagccactcaacactgtagtgctgtggccaggtgaagggactctgaaactgtagtactatcctttgaagctaccacagttcttctcctctatgctgaattaaccacatccttgtttccatttaaataagaaagatgcacagaggttcaacccacccattattgaacatattttgcatatggaatttctaatcaccatattattccagggatgtttgcagacggaacctatttagatttttttgtacatggatgcctagagaattatggaaaaaactagaaatcatctagttctagtctaatacccacatttagcattcaaggtaactgagaaataaagaggtcaaatgttgctcaagatgactcagcaagttaggagccagtgtggaccagatmagtgtccttttctctacaccatgtggataatggatgtttatagcaaagttaacattgaacctgttgagattcatgtagataatctggaattttatgtctcactacttgataatgttcataaattgaattatgtaaccaaaatctgtcctttaccaatacagatatcctattcaaggaagtaaaatttcactagtatcatgggcatctttagcatgtcaatttcagtagaccaagtagaactctagttaatttgttttgaatggtgaggcaaacaaagcatcattattcctatgaacatttaacagtttttgagtaatcatgatggcatgtattgaacattttrgtgaaacaaatatctgctaatgatggaaatgtatttgctagtggtacaagtcttacaagacacgctgcagaagaaccttcagaaaataacctctgaccttgaagaacagatgttctaaaagcacacaacataggggttttgtaaatgagcagcactttggagtttttccaacttttcaaacattcagggaagtaaaaatgtcactatgccaggttttctaaattttcatatttcaaattagtataatttgagggaagttatttaaatgatctgcacattacttatcaagacatatatttctaagtgccaatgtccaggaattagtttgcttttctgaaataatatttaagataatcctttttaaaattaaaggatattttatcaacataaatagcctactcagaaaattatatcaacactaaatcacaggtaacaccatcatgttttatctctatttattttgatttttgaagtaatttaaaagggtatatttaaacattataaagtacactaacaaataaaacattttgtagactcagtgaaaacaaatttatttatttatttagtttttgagatggagtttcgctcttgttgcccaggctggagtgcaatggcgtgatcttggctcactgcaaccttcgcctcctgggttcaagtgattctcccgcctcagcctcctgagtagctgggattagaggcatgcaccagaaaacaaaatattttattcatcattagtaacatttgccagaactctgtgctgtttaaacttcataaagtatatcacatgtakgatattttctagttttctagtctcttctgtatatatgccagaataatatcaaatactttcatttaatcagttatgattattttataccaaagaaatctcattctagaaaagaaggccatctattcaccactcctgttggccattaaccttcatacctcccctttcagtgttctgtcttgggtcttctttcaccgtataaatcccagggttgatttgatccagtcactctgcagcaaacatccttgtatgtctctttgtgaacgtcaacaattaggatatggacttcctcagccttatcagatgttgccaaattgctctccaaagaactaatatcaatttacattccagccagcagtgaatgaaagttycagtttctctacctcccagacatatgtattgtcatgctttaatttttatcatctaatggctgtgagatgcaattttattattgatttaatttttatttccctaatcactggtgaagctaaacatctttttacatgtttatttgtcctttggttttgcacttctgtaaatcaactgtttatatcctttgcctatttgttgtttctttgagcttctccctccttctccttttcctattattcttcctcctcctcctcctccactcctctttctccttcttcttgttcctaggagttcttagtattatctgaataaaaaattctttgtcagttctagttttatgcattacaaatatgttcttccagtttgtggcttgtcctttactttttttttaatggcaacagaaatttaaattctaatgaataaatgtatcagtcttttcatttaacacttaatgccttggatgaaaatgttttatcccagggttatagaactattttcttaaatgttcttatcacagttttaacattttgttgatcacatttaagtctttaatcaatctgttgtttgtattttttcataatgtgaagcaagaatctaattttaatttttccttatggatacttctcatttattaattaatccactagttcttccttcttctcaattttaatgcctttttagtgatacaacaaggcttttatgagtgaggactgctttgaggctttgtatcctcttcaatttgaccatttttgtatcccggtactattattatactgttttaattgttatagctttataagttttttggattggtgtttcagttatttattgctgcaaaacaaaacagtggaggttttctaaaaaatcattattttccatgattttgtgggcagccacaaaattccgtttcccatggtatcagcccaggcactggacratcatgaggtccaaaatagcctcattcgcatggttgactaccacagtgctagctgacaaatgggagctcagctggggttttcaactaaagcctttgtttttctccatgtgggtatctctatgtggctatttgagctttggaaagcatgataggtgggatccaagaagaaatattacaaaaagcaaaggcagaaattgcagatgtcttaaagtctagcctcagacatcactcaaagccacctctgccttattctattcctacaagttgattaaaagaaggtaaagtagactgcacctcttgatgggggagtggcaatgtcactttgctaaaaagtacctgggaaggaaaatagtgttgtgatcatctttggaaataacaatctattgcattctggcaggacaagccttatcatctcattaggcttcttcaacaccattttggacccttttccttccaactatgaatctataaattttagaattaacttgtctggttccatccaaattttataatgtgatttttgagtgaactttcagataacattcttcaacaaatgtttattgagtacctactatgctcttgcactaatgatacataaatgaaaaaaaaaaaaaaacagataaaacctccatctttcattgagcctgtatttcggattatgtggagaaaattaaaatatttatgacctttgttattctaataaatatattttgttttgcaaatttggttaggtcttcttttatgtccttcgtctaagctttataatttcttcttatccgatttattcttagacaaatttttgtcttgtttctcccaacatttagactaagctctttgggcaaatgttttaactttttgtcttctgatagcaccaagtacactgccagatatagcaggacaatgtaacttggtgaacagactgaataaaaactgaagtaaaagatttaattttccatttgtaaatattaatcatgccaggtcaaactatcttaaccaagttaagctcctagaaataagtagcattcatgtagtaagtgagttgccatcactatattcttatagaaggtccctcgtataaaaaccagtaagtaatgtaaaggagcaactacccaggtactccagtggttaaaaggaaaagatgaaaagaaagaaggaagaaaggaaaatgctctccaagctttatacggacatttaacgtagttaaaaatgggtttgcctggcctttgctaatcacacctttagctaataacttcgaaatttgcttctacattaggtacagtgtggaacaaattagctcacttaataaatggaatgaagctcagtgtgagtctctttaaaagcacaagaacattcctatttcatccctcaattaccaaatatctgcaattcctagttttgcatcatgctgaacttctaaagtaggaaaaaagcagttgaagtaatattacaatagcaaatgatacaaaaatagcattaagtaccaaggatacctaaagttcattatttcaattctttactctcaacaagggcagatctgacactgtgaaaattgctgacaaaatcatgacttaccaccaaacagaattttcaacatttcaagttatgattaagataaggaatagcttgatgactatttcactacattcaatactatttatagaatacagctgcagggctttgtatatctaataattattgtgaagaagttttacaaaacatcagtcctttgagaatttcyatacattgtacaagttatttaaaatctgccaaatgttacaatatgaaatgtaaaactaggaaayccaaatgcaacaagtggaaaacatgggctcagctaataccacaacacactgccaagatggaactctccacaaggtctatcttcctgctacttctgtcctggtatttcccagagttcatgccttctcattccaagtatatgctaaatactcctaaatctagatctctagcccaagatgtgtcasttgagcaacagacccatgtttccaattcctctgaggtgtcattgcttgaatgtcacagaaataatgcacaytccataatctcaaacataacccatgatttccatactctcctccttttgtatttctctctccgtgaatagaaccaccatccacccaggcctctatgacagaaccttgggtgtcactgaagacactttttcctctctgttacttctcatatcaaattggttaccaagtcctgggaattacacaggatctcatctttttccttttcttcatacccactgccatagccttggttcaagtcctcatcatctcttacatggcccatggtagcagtsagctagcaggaccccctgcttctagatgtacctcttttaatccattctccaaacattcaccaagtgatctttttaaaacacgaagcagataaagttacccatacctacctgtttaatacctttcaaaggttaccaatattcttgcaggataaattacaaatccttaacattattccctggctcttgtctacatctctatatttttttattaagttcaggttctttcctcatctgctacctatccatgccagacaactaagactcagactcagtctcactaatttgtagctttgcttacactgctccttctgcttaaaagatcttcaaatcttctcccctacttgcctttaacctgatgaatttctactcattcttaaggtctaatacaagcattactgcctctacaaaccttcctgaaatccacagaggaaattatacacttccatctttgtttcataaatctaataagaactaatatttatggagtactgatattgcattagacattgtattcagtggtttattacattattgtatcctataaacataaattattttcacattaccttactattatatcctacacaatcacttgtaaattattttagtacgctttattttacctacttatttacatattttgtaatattatcctactaaactgaaaactacttaggactgaactgtggttcatcttactctctattgcctaagctacttcattgcacaagtaggtctcaaagctctgttgataaatgaagtttaatggtttcaaggagactgatattatataattagagatgttaacaaatgcattaaaaattttaacgcatcttgaatcaaagcaattatctatctaacttagtagctgtgcaacaaagtaaaaagagcaagagtgccattaatatatctcaaagataagcttgtttaataatgcatgtttgggctgggtgcaatggctcacgcctgtaatcctagcactttgggaggccgagacgggcagattgcctgggctcaggagtttgagaccaggctgggcaatatggtgaaaccctgtttctactaaaatacacaagaaactagccgggcgtggtggcgcgtgcctgtagtcccagctactcaggaggctgaggcaggagaattgcttgaacccagcaggtagaggttgcagtgggtcaagatcgcaccactgcattcagcctgggtgagagagtgagactccgtctctacaaaaaaaaaaaaaaaaaaaaaaagcatgtttgtgtcaatcacttatgtgtttatttgagttaattagcgcctatgcagttttctgcttgctcaacttattggaaaaaaaatttctaagggtatgtgcaaaaatattatctaaagtagcatttgaaattttgctctacaattacactgttaaacacagtaattctaaacaattccatgtgaactaacatctgtaaatgttcagcaattatccacctgttgacagtctgtaattcagctttgtgagtactactggtttgtgacattaaatcaagaggtttaatattttatcttggattaaatgcaaaagataatcaagaataagacagacatttagctgcctggatagcagttatagatctgtttatattaatactaacagagagtcaaacagttcccaaaacttttagatgtgatggcaagaataagagcagaagatgatctgcacatcaaacagctttttcgtctttgcttagtgtcaagcrtttggcaaaacaaccctttgtattatttcagcatttcagaggcctaattttccatagttgtgactcacatatcctattcataggcagaggtcttataaaaatgaatgtgactgatacaatctcttataaaaatgaatgtgactgatacaatctgagcaggaaatacttattaccaaatgaccacaaattctttcttgtttgtaaaaattaatttacctgtgttaaattgttttaatcagatttcattttaaaactagcactttaagcatgatttaatctaacaactgataaaacaataacatttcaaaggcatatctagaacagtttaaaccaaattcttgtctgttcataagctctggtaaaacttttagatccctgctatttagtaaatctcttaatatgtattcatgtaactaaatactcctatacactgttttcctaaattcagggttctggatgttcttcccctcattattaggacaccatctctctgttctatcacatttcttcccaagcaagtttgtcatctaaatacctcattaaataatcttataccttattccgtcataacaatctataagagaattgttccccaggcagaggaagtcctcaaatttgttgctatttcctattctcttcttaattagtggctcaactatccacaaaatcacccaagccagaagcctacagtcatccattccactccatccccacactcctaattggtgattaagacctattgactcttcctcctgaatatattgcaaatctatttgttcctcttcaagttcactaccactgcttcatcattcatcacttggattattgcagtgatttttctaactggcctccctgcccaccaggctcagtttcatcccctcatttctcccccattccagctcattcttctacaacaattgtaattatatttctaaaatgagatggctgatgccattcccctacataaataagatgcaaaccaaattcctaacacggcrttttagcacagcctttgcatatctcaccagatttatgtctcatctaccttcccatatactccagtgctacaattctttttctataagcagaaataagtgcctccttactctatgtttacttagcatacactgttgttttagtactagttgcaggaataaaattcaaaatagaagatagaacaatattttttaaagcacaagaagcatagttaatgtaaaagcatagcacaaaataaaatgtagacataaatcaaaatatatcaataacccaataaatacaaagggactaaatttgcaagtaaaggacagatattgcaaattatatttttatgctttttgcaagacacacaaataaaatacaatgacacagaaaagttgaaaataaaaagatgaagaatgacaatgaacagaagaaagtgagacacttgtagagaggcaaaaaaggcacattggaaataaagaagtttctayggaacaataaagaaggaatcagcaaaaaatatagtaattccaaactcatatgtgagwaataacattgtccagaatatacaaagtaaaattgagattagaaagagcaattgtcacagatcaacaataatgggagatttcaatgcacttttcttataactgatacatcaggcagcagaaggcattagtggattgtaggagatacaaataaygcaactaagaagtttgttccaatggctatatgtaaaaccatggaccctacaattagagaacacacattcacttaaatayataataagctttaaaactgaacatatacataaagcaaatctcaatcaacaccaaaaattcagtatcactcagaacttctgtgcatataagacaattaaattagaaatgtatttattactattttagttataaagaaaacggaagacagggcaaaagttaataaaattggaacacyatagaaacacagaaaaccctcatatttcaaaattaaagatatttgtactacttttatttatcattttcaattgayggtttgcactcaaatatttcattaagacttcagttatttcaagaatttaaacatgattttatgcattaaaaggtatcagttaaaagacctgtgactgaataaaaatgtaaatcaattaattaaaaataggcattgctaaatcgacactggaatctgaaattatcatgggccttctgcctaacattttcaagaaaaaacttgggattcctgaaaaaaatatataatcaaggataggtaagcatctaataattaaattaagatcatcaatttgtattacacagaaaactgggctgttgtcatcttgtatggatcagaacatgattatgccataaaatccattcttctagcttcaatcactattgtctctcttttctaactatagaggtgatcagacagcatgcatcccttttaggtcacaaaagaaatcctattaaatgccaacctataaatggtgcttccggaaacataaactagatcagggttagtttgggatgaaataggccttaacttagatagaaagtagaaatgaataatgtacatttcataagtctttaagcaaaaaacaattggcaattttactgtattttatcaatttatcttagttgaattttatatcactgacagattacttgaccatcaatttttctgatttgtatactaattctagtcttattttcctaaaatgttttcctaataacagcaatgtattcagaaattgtaattaaaagtcattgaaggtcatctgatttgttgtgttggctttagatcagtgactagattttcccagtcactgctctgtcagctttaatacaatgcatccatttgtcttactaacacttcaatttatgggatagctgtttttcacaattaaaactactgaarctttagtatacatggaaatgatcatgatagcattttctccatatttctaacaactctggaaggctctattgtaaaaatatagggccttccagatgactagatctggtttcctgaagacagcttttaagattgctatatgagctcaagagaaacatttacaagaatctttagataaattactaagtgctgcagaagtaaaaccatttggaatagatttctaaactcctcttacataaataattggtgagtgattgaggtaagaaaaggctgcccttactcttgctgacccaatagacaagacagctgatgacgaaagttgatggcgaattggcacaagaaggttaaatgcaggagaaatgaaaccgatctacttattgtgatgatgttgactgctacctagttagttctatgagagacaacacctacttacacaaggtcttccacttaattgggcttaaggccagttcagtaatcacaaaattacaacaagctaaaaattacaccaatcacctcctccaacctctgtatctataaagaaaccatgaacttatataatttacccaggaaacaggagtcagatctgctgcctcctattacaggagtctttacattcaattaaactgaattagatatatgaattcaatagaagaaatcttgatgtaaagtcaattagtataaatacaagtcctccctcaccccacacctgacaattacaataaaattctatggggagcgcattatgaagagtagagaagaatgccagtgcaattctgtaaaagctaaggcaatctgagaatttaattttggtatgtctagccaaagtcaattactcatgaacaacaggctggaaagtgaccaagggctgactcagcagctttcaaactcttctgttgagtttaaaaaataaaatgtgaaagtagagagagaaaataggaaggaatagtccaagaaaggacgataaaaattaaataggccaggtgcagtggctcatgcctgtaatcccagcactttgggaggccgaggtgggtggatcatgaggtcaggagatcgagaccatcctggccaacatgatgaaaccctgtctctactaaaaatacaaaaattagctaggggtggtggtgtgtgcctgtaatcccagctactcgggagggtgaggcaggagaatcgcttgaaccagggactcggaggttgcagtgagccgagatggagccactgcactccagcctgacgacagagtgagactctgtctaaaaaaaaaaaaaagaaaaaaaaagaraaaaaaattaaataaactaataataaaatcataaaatctgggctgtgagttcacttctagaatgctaggtactcatggaaatttacctaaaaccaaaaaggtgaagtaggagctgaagacaggggtgggggacagaaggatggggaaatgggaatggggggcacagacaggtggaaaatttagaggaatatagaatttttcaccagcttgaagtaaaactttctaattattttaaaaaaccttataatatatcattactatgtagaattaccaacagataaatttagtctttaatactcaaaaagaataattttataaagaaagttaccacaagacaactttagtggatcctaattgtattcataatgcaatttacaaaactgtgatttacatacatcttgtcaggcacacatcaaggacacaaaaggcacactcacactatctcaaagcatgtaataaaaaagggtgctataggaaaagaaacccaccagtttctactgactgtatctcttccttttctttctgtttagccttgtcatcattaccaaggagcttgctcattcctaaaacacatttgctacaaccaggcatttctctttcagtcagggcttcaccatggctgggaaatagacattgaggaagcagagagtgcagaaatgggtatgagtcttagagtccgaagacctaggttccgaggaggtcaccgtctggttgactgaccatactcaagctttattaacttttaggagctcagtttcttcacctaaaaaaatgagatcgttggattcaatgatctctaagctctctgacttgaaatggattcaattcactaatttcccctttttgaattttcctcatattctcttaaacagagtcgaatgggaagctttttcaaaacaataagtaattatttcttatctataatattctacttatatatcaaactgccctcgcctttgccaaagccctcagtggacaaataacttcaaataactactawttctcagagcagtgcaagtcatctaggatcattgtttacattctatacatattgaaaggctttctgtaaaagtgagaaatgttttaatttttaatgataggaaaagtaatgctttctacaaggttgaatctaaatccaagccatagataagagctactttaatttaactggtatttatggttgaggagcagaaaacaaaaagaaaaaaaattcctttgaaaatgtttatttatgacagtctaaattactcctttgacacaatgaacacaggtaaattatctcagagctgtgtttaatggctctaatggctagctgggtactgggccatgtatttcaggatgcctacttgtttataaaacttgtttccaaaaatcaggctaatatagtactaagttaccaagcagaattttttttttaattccagagtcactggccatatttcatatataattgctgggttaaataaacacaattaggttttatttagcatgtatttgattatgaatgtcttcatataaataaaaaacaattttttaataaactagactaggaaaggataaaaacttagtatcattattattctaaacataccaaggctcaagttttcattacctaaaatatactcttcgtaagacttgtggctgccgaataaaatacattmatcagatgcagtattgctttcacggtaattatgatactatttataatgccatggttatgttcataggccactaacaaacatatgcagtcttttagctacaacactcaaacataattacaatgcccctttccattgaaataatctatgcatcccgccacagtgacttcattccytaccaggatgcctgctgaatcagactgccccaattattcaggcacagtgcctatgcttatgactaataatattggggaataaacgaaattaatgtccatgacttcctgaccattttggccaatctcctttctttggtgtcttctgctttaaccctaatactgagtaatcttgaactattcctggcataaaaagagcttcacatactgtacaaagtcttcaagccctacaccaatatttcccatagtatgttccaagtatttcagtcttaggggatattgctcaaaaaaatcagagtgcggagaggttccaagatcgaatacttttgggaaactttgcatactatattcccaatccttaggattctcctaatctattcatatactgaaggctcttataagtcctgaagtaaagaaatattttatctacatttaactcacgcaattgcaaaacttacttaaccatgaaacctatttcatattactttttcaagtgagtcttattaacataaaactagtggcaaatatttgggtgtccctgtcttcatgcagaatttgactgcccaggtcctattcctctagagactagttagattctggccagttaactggagaaatcaatacaaattgagaggttaattttgttaatagattcatgtgttgtctctagcagagggtggttgattttaacatacatttgcaatgcatcagccaaagtgcagcataaaacggaagagaataaactgtgagactataccttgcacatgtttcttattgcatgagtaagttctatatcaggtctggaatttctgtactcaaaggacttatattctgaagcaacaattacaaatattgagtggaggtaatatttgtggacattgaatcaaaccagttttctcacctaacataaataacttacctgcattttgatgttaaaaaaaaaaagccacctgccaagatctggctgtggagccatggctgtgtatcagccatgtatttgagtagtgacaaatacttaattaacagggtcattgaattgagaagaaggcctgaattttgatttctacaaaaaagtttcagagaaagatttttgctttaaaagtctgactctttataaaatttcttcctgtctttaaagaaagtcaaaacatggacaaaagccacaagccacctatcaatattcatgtgaatcaaaaaattaaatggtaatgatgaggatgagaaaaggagagaaatgtatcttgcttccctgttaaaatgatgacacatgtaaggacagccccatggcatggtgtctgatacttcatctctgttagctttttcttcccataatgcttcttccctcaaaaaatgctgatcacagaaattttgaaacacaagatatttgtggctttttttttcagtggaaaccatcattattgcctgtaaccttgatccgttctaatagaggactacagaactaatcctacaataagtcaagataactgatggcattggcaagtagttgaaatccttagtctaacaaatactgctttcaaaagactagtatactcactgataaatgcctttttaacttatatcatgtcaattatttgctattcattatctttataaaatatttcctggtttggggaactctgcaagtttcttgtttctgatgctttgtttaaacatatacaactatgtatgttcagtctgacaaagccaccacttcctccagccaaaagggaaataactctagtagaacgcagtattttaagaacagattttgttgttaggctgtattacccccaaagaaaaggacaaaattagtaagactgaatttgttactatttactcgccaaaccctcaaggtagtttcatagagataatcacaaaaacaggaaatagtacacaatgtgggattggtgtttttcctacaagctccttttcctatggattattttttttccaatggagagaaatgcttttttacctggataataaattaaaaagtggtttcttgacattttactgcttttatttattccatttaaagaaaatgatttccaaagccagacaatggtgctgttcaatagaaaatgatgacctttaattaaaactctgccccttactaattttcacatctttaccaacctcctcatcaatgtggaagaggcataattgaagggagaaaacacctgatctaaatacactttatctaaatcacttcccccaagcagacattctctatctcaattcctagttcatttccttcattgtatttcctaattcaaaattatttctttcttcacctgttcattgtgcctgtgatcacataggccataggttttatatgggagggagctttgtagactagtgacttcccagtgttattgctgaagaaaggaatagataagggaagaggaggcaaaggtgaatatatctgatgaatcggaaaaaaaggtatgtggtctcaaatcgcaattaatctctaaatgtaacaagcaaaagcaaaagtaatgcttttgtttattttactccatcttttttttttttttttttttttttttttttttttgagacggagtcttgagctgttgcccaagctggagtgcaatggtatgattttgactcactgcaacctccgcctcccaggttcaagtgattctcctgcctcagcctcccgagtaactgggattacaggtgcatgccactatgcctggctaatttttctatttttagtagaggcagggtatcaccatgttggctaggctggtctcaaactcctgttctcaggtgaccygcctgccttggcctcccaaaatgctgggattacaagcgtgagccatcgcacccaacctactccatgatttttttgattatttattttgaaattattcagcatcttatctcattattccattattacagtaattatctaccacctgttgaacagtacagtgccaggtactttacaaacaactttgcaactatcttgcaaggtaagaactcctgtgcctgtttcttgcagggaagctgagttgcataaagtgaagccacaaagtcacagagacaggaagtggcagagtcaggatttaagtttacttctgcctgattccaaagctgtactctcttctctacatcacaccacttaactattaagtggtgtgataaagaggtatgcttaagcctcttaaagtatctgtcttaccaaattgctaataaactttgcaaaagtcgaagctagaatctatccccctccaccccttctctttctccctctttctgtgctatgtatatactactctacatcttgaaaagagtaattttatcttcatttgctttgtagtttattcaacttctatttccaaaaacttagctttttcctgggacaaatcccccagatgttttctattctcttataacttcaacctctacctgctaaagtagaagtctcaattatttaagagattcagaattatgtattataaagtttacaaattatgtaataaaaatttaaattcatttaaaacttgagtaattatgatgccatcagcacactataagatgtaaacattttaatggtgaaatatttaaaataaatatctttgaatgttcaaattctgtttgatayatttgttctctttatttcctcaaaattacagtcttaaattttttttttcttttgagatggagtctcgctctgttgcccaggctggagtgcagtggcaaaatctcagctcactgacacctctacttcccgggttcaaggcatcctcctacctctgcctcccaagtagctgggattacagtcatgtgccaccacgtccagctaatttttttgtgtttttagtacagatggggtttcaccatgttggccaggctgttcttgaactcctgacctcaaatgatccaccctgctcagcctcccaaagtgctgggattacaggcgtgagccaccacactcagcttacagtcttaaaaattatgtattgcttattggttcttcactgtaggttcaagagcattgtcaattatgcctctgtgactcctaaaccagattttaccttcaaattcttgggtgtcagttcctgtttagcatcaacacattgaactgaaattagactgtgactcaccatgtatttccaaggaattaacaaattggctctttttcctctcccactatttggatattgaaattaaagtagctaactttaaaataatttcttgatttttaaattacccttgaccaactttttattggcttcaatctgactttttttttttaacataaaatagcccttaaatgtatacttatcatgatttttttcatttctaaaataagagataaaatatttgacaagcaggactttcacactgtaggcagttcaactgccactgaaactttaattaggtcaaacttggaatctaaaatcttaaaatgatatccagtaaaagggaaaacctgaaaacataaggtaaaggcttttttctgaaacccttgccagtgtttccctgtaaatgttacagccttcaaagaccactcaacattwcccaccattttaaaatccataatttattacaaataagtatagtagaaaggttctattccatactgaatatattaataaaaatagtatttttaaaaaaaaagttcaaaaaattgtcaagtaactcaaaagttacacataacataaaaaccattcacctcaaaatagccattatttcagatattttgataaaaatatatacaaaggaagctacagaggaagaaaggccaacaggtaatgtggataggaactgaagatcagttttgttaaaatggactcaagctacccacactatattaaatatatgtaccatattaaatatagctatacttgaattaatcacagtataagaactttaaatgaaattaatgaatttactaaaaaatgagatgtttcttttttcttgtttttttttaatgcccatctttatcctgcagtagagataaatgtttcttaacactccaaaatgtattgtgtaataaaatattgatgagttcaggaaaaacttatgctttaaaaagttgggaccattacttgctataaaagctgaagaaatgaacgtattaatgttttatcctaacttccatcaatttgatattatatttttcattgttcattcatagtttctattttattcaataaccatagtgctcatggtttttaattttcgttctgaatttacattgattaaagatttatattcagttttttagttggaatccctccatacctgaattgtttgtcttgattcacctcttagtaggctgaaattcactacagcttttttgtttgttttgttttgtttttacagggtggctattcaatttttttttacttataagaacaataatgtatttgttcataattgtgtgagttagcaaggcaattctcatcggggctggyctggctcatctctgaagtcatctgccagttttgaaggggattgatggtctaggatagccccattcatttgtctggctcttacaagcttgttggatttagaagccccagctaggatagcacatctctgctccatgtagtctttcatcctccagtaggctagctcaggcatattcacaagtggtagcctcaggattcaaaacagcaaaataagacagaaggccccagtgcataagaatctttttaagtctttgtttaccttattgtttttcagtgttttcttgttttaattttccttaatgagggtttatactatcttgtgtaacttcttatgggcttgaaaatgtttgtgcatttgaatttatatttaaaagataacttgggtgggtataaaaccttggtatatactttcttgtactcagaatttttacacataattctataggattttggtatttaataaacctgtgggaaaactaacctcatttttctctcttccatgtgacttgatattcatgctgaataaacacatacatgtattcattatttttaatatttattaaccttaccgtgatacagaatgccattaaaatcatatgtaagtctttatttcaggaatttatcttctactattttaatattcaagaatacaaattatatttatattggatcccttttttttcttttccacatctttcatcttcccataataaatgttgtgtttttgtgcatttgaactaaatwttatgggatttttttcaaagcttttctccatatttctaacttggttttcagtcacatttattccacttgttgttattgcttctaatatttttgtctatgaaagctttcgtgtttctctcccatttctctcctgatatacataacctctttcatctgtttttcattgaacctctactttgattctcatagatattttttcaggctttttgtttgtttgtttgtttgcttgtccgtatcatatctagtataatttccctgagcgaatgggtaatttttatcctaatcttccaatgttttttgggaaatttctcttgtgatttttttatacagctctttgttgtgttattatctctttagtctcctttctatttgatggttgtagattgagagaaaaaacaggagcagtttgcagtctcttgtttctcttgctagacttttttactccattcctctgtcaccaaatctcttatttcyttttcccaggtcacacctctccatctggagtgagtggctaaaaacawatccttttgcatcagagactttctatgttatggtttgtacrtactgtctcttcttccttcttcactcctcttcatctctggcattctctggttctgaaacttggatctaagcaagaaccctgtcattctagtatagattcttcttcagctacctgtcctggaggctttagggattcaaacttgtccttccattactatatatctcttccttctgagtcagggctctttagaaccttcaagattgtgactcttgcttttggagaattatttatcatactctaactagtactatggcattacaagaaaaataaacacacacgcatatgcactaaagcagaagattacacatatcatttataaatacatattgttctttagaaaagttattattatagttatagcaactaacatgtctcataattgtatgtaggcaaatatacctccttcccacattagttagaataatctttggatacagtaacagaaaatccaacaatgttttaaaattgttttaaaatatgttttaaaatataaaagggtttatcatttacctttgaaaataaaaagtcaggaagtagtgtcacctaatgttggattgctgacttaatgatgcctaatatctctccaattatttttggcttatcacctcatagtccccagatggctgctatcctgtaggtattagatctgtgctcaaggcaagaagaagagtggggggagcactagctacaatcatcctcttttaataagaaaacagaagcatctttaccaccgccaccaccactatcacttccagcaagtttctgctcacatatcagtagctgctaggaattttccaatgcttttgtatagccakgcaagaaagaagagtgttagcaagagctttcgactcagccaaccaacaatgtttgccataccccaaatgctgaactcctccacagaaaggatttgagcatatccatatttgtatgcccagttctcagcagagtttgacatatttgtagatactaattaaatatttgtcaaattatactcctttatggttaacattatttcttctaaacctaacaattgaattgacattttcaaaaacacatttaccatgaatcttagacaactataatataatagagaatctacaatataaatctataaaatctcatattattaaactgaaattaagattatttgtcaactatgtcaatataggccaggcgcggtggctcacgcctgtaatcccagcactttgggaggccaaggcagacggatcacgaagtcaaggggtcaagaccatcctggctaacacggtgaaaccccgtctctactaaaaatacaaaaaataaataaataaattagccgggtgtggtggtatgtgactgtagtcccagctactcgggaggctgaggcaggagaattgcttgaacccagcagacggaggttgcagtgagccaagatcgtgccactgcactccagcctggggcagagcaaaagtctgtctcaaaaaaaaaaaaaaaaaagctagcctgttctgtttttaataataaactattcagaaggttacaaattcagtagaatacacaattgctagtgaaaaaaacagaaatttacccatagagtgcaattaggaagccagaaagtgctttacagtgctgcattgtctttctggagttaaacttaaaactttactgtcaatatttatggaaactttcattctattccataacatgtacatgttggtgataatataaatgagtattttttccctaaaatttttagtagaatttcaccctaggctatgtgyaactttaataatgatgatgataatgatgacgatagcaaatatatagagtgcttacatgtaccaggtacttttctaagcactttatatgtatgaactaatttaatcctcataataaccctaggaggtaggtattatcatcaaccatacatacagaagagaaaatggaagcagaacttgaggaagtaatttgcccaaggacctacagrttgcatgtggcagaggtggaattcagtcccagatcatcaggccccagaacctggcttcataaacacctgcccttgaaacccactatggagccccaggagtacccatccatggttttgaccaacattacctcctctgtcatttcaagaactctataggcattatctttaggtttaatatatgaggaaacagaaacttaaagaaattatggtaacttgccaaaaatcacaagctccgtagatacaagtcaaacacaactctctctggctctggagtctacattcttatccactgtgcagtgcactgtactgacagaaggggaaaaccctacagtgtgtgatgcacttcctatgtcacagagtatgaagaatgtcacaaggtcacggaatttcagagctgaaagggatcatctagtccaacccattcatttcatgggtagagaactgaaacccagagaaaatagaaatgccaccacctcggtgccagatctcctagatgcccacctacaggtcagtcctctctatagtatcttctccccttttccctttaggttgatttttcatttaaaaattatttgatataatataaattgttatagctcacaattgtgaggaaattataaatatttgcctttatgattttagaatgatgaaaacctttgttattctgcagactttctccaaagctttatttcaaaaagcatcattgttctttttcatcttagaaaacataaaacctacttgcttgtcttcaggaaccctacgaagataaaaattatcacaatttatacccaacatacctaaagaaccctgtccattgtgccctcattggttgtcctcttaacttggacaaatgtaatcacgtctttgaygtatttccagcttcacggtggttttggatatacacttctgtaaaatgatcaagatttttgttggaattcacgagtgtttgttaaagttttattaaaagcgatcctagaaaatataactagagcttactataatatgttctgcaggtgggaaaaatgttacagctccatgaacataaagcaatcattaattagcagcaaagacacgycattttcaatcttatcttttcatgattttaaaaaaaccaacacttttcccttatattttccaggtaaggcatcttaccagttcttatgcactgcaatggccactaggtaatattctttaagcaatactgttatacatattattatattacagcaatcctaaaygagataggaaagacatcatctttcattttctacatggagaaattaaggctcagagaagttaggtgaaaagactaaagtcaaaaatgctaatgggtgtaagaacctgactcaaattcagatctgtcaaatgcatctggtgtctgtccttaatactctattaagttgcctctcttcatttaataaaattctctaccattcaaaattaaagttgtatatctataatgtttgctgtttatttcagtgagtagttatttcagtttttaatagatatgttttcctttattaggatttgttaaaactaaaaaaattaataataacttcaaacaatcattgttatcatttccaataagcaaagcagacaatttaaagagacagaattctcagacatgcaatgctatttcaaagtccattcacgtgctgtgcaaaaagtcacattaaaacactttatactgaactataccatgacctcggcaaacacagtactcctaaaagcacagttatacttgttgatggctatgagtacagattacttccttttcttgatacaaaagtattaaaagtattaataccatacagttaaatctgaggaataattaatttgaaggaaggtaataggcaggtaaagcagctcagtataatcaaaattttcctttaaagaggttgacagttactctgatgtaatatcctggaagtttttttccaaatgtgcacttctgatttgcatgaattttaaagtcattactggtgaatacagaaaagatacaggcccactctcacaaggatgtagattgatctctgatatctagccttcccagtgtgccatttggggtgtgaaaaggtaccccagagccccaaggtctaaaaacccactaaatcagggtttcccaggactgctgttttataaacactccagagaatttgtctctaaaaacaagtgatgaaggacagagacaaaagggggagtgtaaaaaataaccttttttccccttaaagcaaagaatcaacattagtttgtattttggttcattgtagaagtcgatcactattgtgcactaatcatttcactagaaaaagtatttcttttcctaccattcttcaccatgcatgctttagtgcttcacaggtgtacaagtgattttcttaaatttataaccacagtagacttacatagatcccttataaaattgatgcagcagtggtaataggtttacacaaaaattgtaatttatgtcattctgttttgttgaagggaatcttggcttctatttacagctttaattaactactgtatacttcctaattgtataacctgtgagattatggactatataacttaagaaatatctttatctgggaatcccaggtggtgcctgtttgtaacatatgcattcttgaaatatattcttctagacaaaattagtttttagattaaaatattggagaagatactgttcctatgatctcttttattttgtacttcaattccaaaatttataatgtatttgccaaagactttctttagtagctaatggaaaawaattctaaagaagagatggtggtaaggctgtaattttttaaaagaatgactattctttcattgagatgatatatgtcctatataaaaacttcaagtaataaagagaagtttcagaaagtttcactttaagtcatccaaattccatttatcagaaaaaaaacagccatctctaccaccaagtaaacatcattccaaacatagctaaatgtttaccaaggtagaaaaatggtcagagagatgtatacatacataagccttaattttgaaaaaaatgaaatcaaattatatatgcattttaatatttaaatgttatattttcttttcctttaatttgactaaagaaaatttgaactaaaaactgaaattcaggtaaacgtttcttaaacccaaaacatgttttcttttctacaagggcactccaaagttgaggtaaaaaatggaaaaactttaggaggttagaatcatctgtctatttcaacattaggtagtagctattaaccccatgctatgtagttagggaaattaactgatacctcttccaatattaccttgtcacatattaatcattttcattaacatgctttcattatcatagtttataccatttatatgctattctctaatttctraagctgttattttttatccatagatagatttgatgctaaccatcttaaatcagagttcctccattcttgagctactgatgttgactcatcatgtatgtgcatgcacatgagtttaaagaagagctccagggttctatattgtctaagttttgtttcagaatgtctttctcttgatactatatttgactgaaaataaaacttgagtcatacttcccctccttcagaattgtgtagtaattgcttctctgggttctcatattacgtggaaattgaaagccaacctttattctccttacatgtagctggtatcttttccataaatgttcatctggttgaatatttatccttggagttcaggaaacagtttaaagtatctctcagtattcattgttctatctaaaattgtcctagaacagagtatgaacttcaatttgaagattcaaatctttgtaacaattttcttctttttattttttatttttattgattcatttttttctgttccctattcttaggatcaccaattacgtacatgttgtctctcttttccctgtcttccgtatctttcttcattataaaaacttcacactgttcatacacatttcattttgtcagatttttttccaacctagtatctatgcttgtgactttgttttcaatcaagtttattctatttgtgttgcttccagtgtctattttatttctgtcatttttttcatttccattttcattttttactgaactcttgttctgttttcactgcttttattgctgtatactctcttctttgaattcatctgtctcctttctgaaccctatttttagaatacgtatttgttgtgatatacacttgtgtcatttatttgcttgttttcctctccatgtgtgaaacagaaaatggtagttttatgcatgagtttatccactgttccctttctgatcgctactcctctttgaatgagatagcaactgaccaagtagtacaatggggaggggaagaggaaggggatagctggaaatgtactgaggaagttggcagccactatttcagcttacgaactcaaacatcttctttccaaatattttattttcttaacattgaaagtagttcttccctcgtttctttttgtttgtttgttttatttaaggagtttgcatggatcacagcaagtttccctacagcagtgtaccacctacttcttccaccttctttgacagactgcctgggctgaaagacaaagtggtagagaatagaacgaggttgttggcagaaagtccctctgaggcttcccttccctaccattctagagtctcaggcgggatttctacatggttattctctacttttcttatgtatcacgcagaaactaagctctctttaatcaaaaactaccaaatatttttgggggaaaggcacctattgataatgtctgagtcaacatctcttagtgggtttgattatctatttcaatatttaatatatggacttcgtaatttgtatcattgcagttgtgaggcttccttgctttcttggagatgacaatattttccctcttttttgacttctttgatatttttagtagactttgagaaagtaagaaaaacacctctataacaatatctaaaactggaatgatacgaatattttatatcctatcaaaataagttttaccatcaaaatgtctggttcaaaataggggatttctaattagttcacataaattgtatctactgaataccttctatatacgagaagaacctagacacttggctaggtgcaggtgtctgtacaaaaattaatgagccaagatctggaatctcatggagctcacagatttatagctaatcattgtataataaaatagatgtaacaataactgagcaaacaatatattcacagtatgaaaatatgggatttaatattttgtgatttccaaagtgttttcaggtccatttaactaatattcattgagggctatgttagatctaaaaacattactgaaattgccaacttcaaataaactaggccaaggttaggttagttcccaagaacacagtgaggttaggttagttaccaagaacacactgacatagagaaaggctgtttctgattagaatctaggattctttctaccacatcctgttgctctggaaagaagaacagagttgattatgtggaataaaaagaaatctactctgtgagccacgattagtcctccacataccatgctggcatccacaatctatcttttgtgtaccacactgggaaccacaatccatcctctatggttcggcctttaagaaatatactgtgattcaccctcttgcagtaacagaaactcatatggctctacctacaacaccagccatagttctaatgtttggaagtggaggtatttgaaaatatttctttcttacaggacagttagtaggttaatcaaaaaagttgacaaaatgtgatgtcacaaaaatcatctgtgtgtgtgtgtgtgtgtgtgtgtgtgcgcgcgtacaattttatgtgtacaattttattttgagatggagtctcactctgtcacccaggctggaatatagtggcccaatctcggctcactgcaacctccgcctccagggttcaagcgattctcctgcctcagcctcccaagtagccrggactacaggggtgtgccaccacgcccagctaatttttgtattttttaagttgagatggggtttcaccatgttggcaaggctggtctcaaactcctgacctcaagtgatctgcccaccttggcctcccaatgtgctgggattacaggtgtgagccaccatgcctggcctgtggatatatattaaacatatattttaacttaaaatatataaatgttaattcacttttcaagtgtttacagtagggccaagactttgtattttggtagtgattcactcactataaatatgtacttttctgtattttccactttcatttatttttacttaaaatgagagcataaaggcatatgaggccaactacagtaaatgtctatgttttatgaggtagtttactcttcgctttcacccatttctgatttgattcctgattcctgattttcttcacccaactttttaaaggcaacaccccttaagtcttatcagcatattcaaattggttataaatgtccaaaaccacatttgtattttgcatttctagtatgttacatgatatttgattaaattacataaaaaatctagtacaactgttataaacatgtttgggaacaaatacagatgacctttaaataaggtttcaattcaactggtgagagcagtaatagacagacctgctagtgttgttacctagtgattaagtctgtgggctctggagccagaatgcctgggtgtgaatcctgatccattacctactagcctttttaaccgtggacaagccacttaacctctctgtgcctcagtttcctcatatgcaaaatgagaatgacattaattaaggttttgttgtgaagattaaaggagttaatttgagcaacgcacttaaaacagttcatggaaggtgttaagtgttgtgtataaatattagatattattactacccaggcattcagtgtataagagacgccagtcaatgtgttttgcagatgaaatggaaaacactagctaatctggcaagtgggttaaagggaaactattaagacaaactctgattttcagtatcagtttgttaactagtgacccttattagatcataagtatcttgagagcaggaattagatcttctgttccattcactattacatatctaatgaatacagtgcctgcacttactaaatattttctgagttaattaatgaatcaagttcaaatatggtaggatgataaggtttttacaacaggatatcaatactacctcataaatatgggttacttcacatttgaaaccattcttgccacttttctttttttaattttattttattattattttgttttgagacgtagtctcgctctgttgcccaggctggagtgtaatggcgttatcttggctcaccacaacctctgccttccgggtccaagcgcttctcctgcctcaccctcccaagtagctgggattacaggcatgtgccaccacgccaggctaattttgtgtttttagtagagacagggtttctccacattggtcaagctggtcacaaactcccgacctcaggtgatccccctgcctcggcctcccaaagtgctaggattacaggcatgagccaccgtacctggtttcttgcctcttttctaattgattcttgcaagaactttatcgtatataaaattatgtacactttataaataagaaatatggagtacaaagaggttgagtaatttgttccaggttacacagtgtgagtcattgatatagctggggctcaaagtcaggactcctggaggtctccctatgtaatgtcatcccttccatataaatagtcttaaaataacctcagttaatcctttgtctccatgaataccatctaccctgtttgtcctatttgacttttgatgctccttactcactttaagttcaaattctaagcgtccgtttatgaacaaatctgttcctcttccgttcttgcctaattttctccattgctgtaattctaccataaaaacagccaagcatgagattaaatgcatttatgaaataagaacgtcacttgtttaatttgctttaaatacctcacctgtgatgcatttaacaacataattgtgttaataccaatatcactgctttccctcactgtgtcaagaagtacagtagtttagattctaccaaggtcaccttctcttgcagcacagtcccaaatcgccttacaataaaaaacatgttgtcaaaatcaatgaatggacagaattatagtattttttataatcatagcttaatgaaattaaatgggtgagccacctcaatctaagccaatctttaaaatatcatcctaacaaatgaagcaaataagtaaagaactattatgtgggaggggaagcaaggggttgacaagcgctcaaatatacagcctcatgttaaattatattattaagagcacaagggcttctttatattcataaccattcttaataatatgtcccttctgagcttttattatcttctcttatgaatggatggcagcagggatattgtaacttatctcaattgtaagttaagctatgtaggattcatctctgttcacttacagagtctaacaatttatcccctctataagtttcacaatagtcttaagtttattgaactcaaaccattcaacaaatatttactaaattttgttatgtcttatccactgtattgggcactgtagagaatcaaagattgcttaaggacagccccttacttcaacgaacttaaaatggaatggaaaattcagatttggacatcaaaagttatttaaggggagaataagcactaaaacctgggttttaaaaaggcataatgaaaatacaaactagattaattctaatggaatgaccatgtaagtttcagaaaggtgtagtatttgatggtttcctaattagtagggttggaacagaggggcttcagatgaagagatgagagtgactaatgcatggaagaggaaaataaggggcctcaggaataagagtatgacattgtggctaacacttacactacccggaagatagtgtgagaaaaggctagaaggctagttaaaccttgactatggaaagtctgagataccaactgaagagtttgcccttacttgacagttaacaggtattaaaacttctctttgtttcatttttgcagtgggttgattatatacattttgtaactattactctgacaggaggagataaaatgtgatggaagaggaaggccagtcaggctattgaaagtaatttaggcaaaagtatcaagatcagaaaagaagttcaattatccaacacaatactgggaaaaaaaagctcaactttgtcaattattaagcaaagatatatacagaatatagtaccatttcacacctttaaaattagccaaaaatttaaacaataattgtgaagttaaaatgtaagaagcacttgtatacaatcagtgaataaatcagtaaataatacttttggaaagaaatttgatattttaaaagtcatatgaaacatatatattttactgaaaatataaaattttaaataccgttcatacaaagagtcactgtcatgttatttgtgacagtaaaaacattaaaaaatcctagatgtctaacaaaaattacaataaaaaatttgatgggttgctatgtagctatcaaaattataatcatgaaagttatgtagtgatatgagaaacatgtaaaaatggaataaaattgtatctatactattattgcaactaaaatgtaaatatatattccgaaaaaaatggcaaaagtacatataaaattaaaagttgagatactaaaaaatttcctcttaagatttctggacttcttaaaatgtgcacaataagtaatttaaagcattaatgtgatgctgaattaggacaatggcaatccaaatgaaaggaagtactataaagggaaacatggtagaaataaacaggagtgaagtactaggagtttgaagggatgaatgaaaagaaggatgcagacttagaggctgagagcctggtagaatagtcagagaattaaaagtaaactaaaaaggtttattcatgccagttaaagcaaacaagttctgctctaattgttaagtcgcaatagacctttcctacgcatttggaagtacgaagtgtatttctgaagaaatatcagtgctaagacaggaacttggaccttccctgaagtagcttgtatttgaagccaaaggagtgggaaaaaaatatatatcaaatttaaggatgtagaacaagaagagaagacaactttggaaagaacatggagcaacacttccaatataaaagataggaaattcaaaaaagctacagaagcactctggaaatgaatagtcagtgttagagatccatgttagcatactgccatggcaactgagaaaaagctttttgtacacacatgcctctgtgtgtgtgtgtgtctgtgtgtgtgtgttctatgaaggaacaagttatccacatattatagagaagtagaaaaggaaaattgggaaaacagatcatagaagttggctactccaagatgaccctagaaaagtagttttcacagactaataaaaataaaattttcagagatgacaaaggaaatggcaggaaggtcatgaattttaactatgccttcaaaaaagtgaatttagtaaggttgcagtgtacaaagtcaatatacaaaggtaagtatactattttttaccaaccacaaatgatgaaaaattttaaatatacactgaaggccgggcacggtggytcatgcctttaatcccagcattttgggaggccgaggcgggcagatcatgaggtcaggagatcgagaccatcctgactaacacagtgaaaccctgtctctrctaaaaatacaaaaaaattagccgggcgtggtggtgcacgcctataatcccagctactcaggaggctgaggcaggagaatagcttgaacccgggtggcggaggttgcagtgagccgagatcatgccattgcactccagcctgggcaagagagtaagactgtgtctcaaaaaataaataaataaataaataaactgaaaacaaaattttctgagtgaaatttaaaaagactgaaataaatggagaggtataatatggtcagtgattggcatactcaatattttctaatgtcacttttccccagttgagctatgtatctaattcaatgccaatcaaaatccaggtagactttttgtagaaattgacaagtagattctaatatttatgtggaaatacaaagaaccagaacagtcaaataaaggaaaagatggtatggtaaacttaagatagtatcaagatcaattctctaggtaatctacagtgaataggccacagaagatagagacccagggaatgtgaaactgctgaaaaggttctatgtagagtagaataagacattcctccatgaaaagtttcctcatggcttttcatgcttcctgaagtcaagaacttcaggaaagaagcatcaaacttcagcaataattccaacccctgacaatccaccaggcttatccatggatcttctatagagaacgatgactaaaatctacccctagagctgattatttaatagaatagctctaacttaagggatctatgataatacatgattcttccacttctcatacccaagcaaagtctaatgctgtcagacaaggtgatgatcctcagcttggaaagacctaaagtgggaatgctaattcctgtctctatactgtcattagaatctatggagaaaaattgagtcaatatgtatcgatctatttcagaactactaatcttcttacaaagacatcaaggaaaaattacatagaatataaattgctgaaacatgaattggattttacttaacataatatacaagaaagcatgtaagactgcaaggttaggatacaggagttttacaattttgctacagattatgtaacttcaggtagaatgacactcaatacttggatggtgttactatgaaattcatgggtaagaagttgggctagataatttctaggattattttgggttattactcaatttctaatcctcagagtctatattaatttcctcttgctgctataacatattaccacaaatttagtggtttaaaacaacacaagtttattatcttccggaggacagaagtccaaaatcagcctcactgagctaaagtcaagtcagcaggactgtgttccctccagaggtctaggggaaaatatgtttccttgcctctctagcttctaaagactactacactccttggctcctggatccttcctccatcttcaaagccagcaatgtggcatcttcaaatttttctcctctctagctgcttcagtcatctcattgtgttctcgtagagtctgactttactgcttctgtctttatattttttctctcttaccatgaccttcctgcctccctcttacaaagacctttgcaggtacatcagtgagcccacctggataatccagtatcatttccctatctcaaaatccttaattgttctgcaaaatctcttttgctgtgaaaggtaacatagttgcaggttctggtgattaggaagtaaacatctttggtgggtggagggcattatttggcctaccataagaccacgttaatatatgcttcaaagtcattatgttttggagttatgctataaaatcattttcctaactttgaaagaaacaacaaaatgagccatatatgcaaatgggtgtaaccagcaaaagttaccttagaaaaatagataattggttcattgatcttgttaatgctcagatattggtaaattatttatttggaaggaccttcagagcctactaaacattctttggcatgtcattgatgttsctttaaatattttaacttgctcaaaagttatttataaccaatattaatgaattttaaaagaaaccacaagaggccgggtggggtgactcacgcctgtaaatcctagcactttagggggccaaggcgggcggatcacctgaggtccggagtttgagaccagcctgaccaacaagaagacaccctgtctctactaaaaatacaaaattagccaggtgtggtggcgcatgcctgtaatctcagctactcgggaggctgaggcaggagaatcacttgaacccaggagcggaggttgcggtgagccgagatcatgccattgcacactccagcctgagcaacaagagcaaaactctgtcaaaaaaaaaaaaaaaaagaaagaaaggaaggaaggaaggaaggaaagaaagaaaagaaaccacaagaaatatttttcagtatcacccaccaattggcactgaaagtaattaccaaagactcattcagttaactaaattctggtatatttgcatttttaagttgtttgattagctcataagcctattttgtaagcccatgcaaaaaaaaaaactcctctccccaaactaaaaacatggttttgtaaaggccacatatccaactttttacctcccctatataattttttgatatacttgttctctcctaagtacaatgcttgggaaaataagatcatagattaccaatcactcagaaattccagacttcctatataataataaaagcaagtttattaaaagggtgaaaatgtattttgcatcttgttatttgcaatgttactgagaatagctcggtttctgacttttttctttaacccctggaggaagaatatttttaaaatctatatagcaagttgaaatcctctctaaagtactatataagtactatatcattacacaacaacaacaagtattgttcttagttacattttgaaaatccagacaagttataatgcccattaacatatgttcttaatttttactcaaatactgatgaycgctataaagacacatgcacacgtatgattattgcggcactattcacaatagcaaagacttggaaccaacccaaatgtccaacaatgatagactggattaagaaaatgtggcacataatacaccatggaatactatgcagccataaaaaatgatgagttcatgtcctttgtagggacatggatgaaattggaaatcatcattctcagtaaactatcgcaaggacaaaaaaccaaacaccgcatgttctcattcatagatgggaattgaacaatgagaacacatggacacaggaaggggaacatcacactctggggactgttgtggggtgaggggaggggggagggatagcattaggagatatacctaatgctaaatgacgagttaatgggtgcagcacaccagcatggcacatgtatacatatgtaactaacttgcacattgtgcacatgtaccctaaaacttaaagtataataataattaagaaaaaaaagagagaaaaaaatacttatgaccatctggcaatccagattcaagtagagttttaagaagatgaattaatatttttggaacattttgtaaatatacattttgtaaatatttttatatttgtaaatataaaaatagaactaatgaattgtattaaatactatttaaaataaaaacaaaataatataacaaaacaaaagaaataaagcagtgttatataagtaatatggaaaagttttaaatcttcataaagctaagagggaagacattcaagaggaacatgccttcaaatagctccttatatattagtcaaaattatctctcaagaaagaacagtcttctgaacattcatattgaaggaaaaggagcttaaaccctgggaggaaaccaatttcttcataaagcatctctttcagtttgagcaaccagtgacgaaaaagtatattaacgttcatttaaaacctcttctgtctggttcttagttgttcaaagagttgattgacataaggagagatttatgaaaaatgaaacaaactcttctcatgtgttaattaaaagagttcagaaacctaaaatctacaaagcttattttcctcatatatctccttaactctgagaggttgtaatttaagatcacattaaaatagaaaccatttagaagagggatcatgccttctttattctgtataagacacagttaattctgggttctcagaaaataaatgatgataaaacatctccttttaccaattcacaaataatttcaaaggactcagccaaatctgaaaactctctgagagcgtagatttttgccttctacttcttttatatcccttatagcatctctagaattctgctgatagagtgagtgcccaataaggtgagaagacagaagagggaaaggagcgtaggaagtaaaggaagaaaacaaaaggaggagagatgaggaaaggaaggatgagaggaggaaaaggaagatagagctgaatgagtcacctagatctttttaattcccctcgtggaactcactgaaagttttacatctgacattcaactgacattcttctaaaattggtattcctggattactttaatgactcagaaaatattaaatacctatatttctgtcaatgataatgacttgccttttttttctttcatgactttttttttttttttttgatacacagtctcgctctgtcacccaggctggagtgcagtggtgtgatctcggctcactgcaacctctgcttcctgggttcaagtgattctcctgcctcagccttccgagtagctgagactaaacatgtgcgccaccatgcccagctaacttttttgtatttttagtagagacagggtttcaccatgttggccaggatggtctcaatctcttgaccttgtcatccactggcctcccaaagtgctgggattacaggcatgagccaccgtgcccggctgacattttcatataattgtccataggtatttctgagattgcctaggacatataatatgtccaccagagtacctacaaagagtatattcgttttttccttttaaaactttaaaatttacactgatagatatttgctgtttgcttctgaatgataagctcttaatgtcataatgatgatgatatcactttatatttgtatagtacttttttgtttataaaatctccatctgttttctcacttgaccctcataacaaccctgtgaagcaagtaaggtagctggtattaactgtatttcatatgtgaaaaagaccagctgaagttcagagggaactatccaaggtcacactgctatattcgtttattcttctgatcctgagacattttgcttttctctactgatgagtgtatgctgcactgcrttggacaactttatatggagcccaaccttttcttttcactggagtttcccatccactcttatttcttcagttttgtggtttgtcattgtttgtttgttgttgttgttattttgttttgttatttaatgtaatggcacaggcagataaattaaattttgtctttatggcaacaattttatggattgactcagaagctacagaatagatttggagagtacctatcatccacagcttgcatgacttccagtatttaacatttctcaaccaaaaaatttagggtttgacaatcagtctttattaaaaaaaaaaatctagaaggtagtacttgagagtggatggcatctggcaaactaggaagtaaagactttaggcaaatagtcaatgaaatcgagcagacattttgaaaatagaatgtagttatgtcaaacagcatgtgcaatgagaattttccaggccragaaggaagtcagagataactgatacaacaagctagttctacttaaaaaaaaaaaaaaaaagttcttggagtttattttcccttaatatttagcaaactatttagaacatttaaaatctaaaacgattaaggtcttctaggaaaaatggaagcaggctagtgaagtcattttagcatttttgaggtttcctcccaagcattctacaagtaattacattaggaagataggaaatccctgagtagactattagtagtttagtattaaaatatcaaaattaatgagtcattttaacattttggtgcaagcataaggcaaaactcaactttttattgtaccacatacttagaaattagagtgcctcaaaaatcaacagcaatcatatcgcaactccccactaagtgttttctctgtgctttccattaataacatcagactagcccaggagtatatgtggatgtaagagcacactacggtgagttcaaaaggtgtgctttgctgatctttctttatgtctctctactgttcagcataatcacctcttttattagctgatgacttctatccaggccattactccataagctaaatattagcagctatttgaaaaggttcactaatgtaccaaatattcttaaataaaacatgaatttacagttgaaataagaagtttcaactaaacaattaaaacaaatcccaaatccatttggaggatattaagcaaatttgtaagcaaatagggtcatggatattttggagctggttcagagcaggttgattgataaatggggaagacctataaagagaggttaaagcagttggcatttgggcatggttgagggttggtttagttactgtcttaggaaaagcatgataaccggtgggtactcatctacttgagtcaagtatacacaaacacaaacattatttaagctatagcacttaagattttgaatgtcacaagtgagttttaacattgtattatttaaaacttacgtaggttacaaaagagaggtttgggatggctttttctcattgcctttaaaaataaattttaattttcccaaaagacttaagtgtggctctactaaagcgtaaaacaaaagatatttttacaaattaacttttaactctgtgattctatatcaaaaaccaatcaatacctgtgatgtccaatagggtagccactaacctcatgtacctatttaactttaattaaaattaaaagcacggttcctcaatgacactaaaaaccattctaaatagacacgtgtggctactggacactgcactggacaatccagatatagaacagccccatggctggccaaagttctgtcagacaacactgacctatccaaacatattccaaatccttcataaatgcattaagatatttgtgccctgtatttcaaacactttgataggtaaataaaattaatttttttctaaaaaacaatcttgtaataatcatatagaaggtgtattttaatcatcaaaataatctgttttcaaagtttagctaaattaataacaaataagcttgtgctaaagcaccagttggatggtttacaagggaagtcagacattcatttattgcatttttacacttagcagcttcactttaaagcattctgctctacataatggtgctctgttaaacaatgtttaaagttaagaaacatttgaagtcgagttctaaagcaatctgcatatgctatcatttaatttataaacttttgaagcacttttaaaaaccctcttaattataaaattaatgaaatatttaaatagctcaccagttaaaaatttaggccctgttgtgaattaaggaattaatcttgaactatatttatacattatgtgtatataatatattcacacccacacaaaaaatatataaatacataaattaatactgaagtgccccaaaggagtgattttacatattgtatataataattttatatatttttatgaagataaatatctgattttgcatattttcatgaagatattatgtagatcaatatatttgtttatcaccattattatttctccatagagataatgaagctgaggtagaagagataatttaatccagaatatcagaaaagtaccggtcagatgcggtggctcacgcctgtgatcccagcactttgggaggccgaggtgggcagatcacgaggtcaggagtttgagatcatccttaccaacatggtgaaaccccgtctctactaaaaatacaaaaattagccaggtgtggtggcgggagtctgtaatcccagctactcaggtggttgaggaaggagaattgcttgaacccgagaggtggaggttgcagtgagccgagattgcatcgctgcactccagcctgggcaacaakagcgaaactccgtctcaaaaaaataaataaataaataaataacttagctgtgtcacacacagcctctgaacacacattttaccccgtcatacttgacttctgttttcacatgtttgtaaagagtttaaactagatgacttcaaaagtaacctttacttaataaagttgtattattccaggtataaataaaaccctctgatttatataaattgatatatatgtctatatataacaatacatttgtctaggtcctttcctagtaaaactgttcaacatcaaatgaggtagaaattcacaggttttaaatttttcagtaacagagaagggaaaaaatgcaagaagtcaagtggtttgcagatgatagaaaaaatcagtgtcagatctaagaatatcattcttcgtcttcacttctggctacattatccctttctactatacattgtgcttatcactaatgtattgaattaacatgagctcacttcaaagattttcaagaaaatttatcattttcctgataattaaaaaggaatactgccaagtaatgtcactaaaagactgacagggactacttaggacctttaagaggacataatgtaacagcacttttgcagaagtcaggttattagaacttaagtgttggaggtttgaaatacgcccatcaacctggtaacaaaactgtcagaattaacaaattgaaatacgcactttgagtagactaggaccttagtttccgctcaaagataatgtaattcttgtgttaaagatctaagaaatgagtgtgaattactctgttcttagagttctgcaatgtcacaagatcataaaatcctgaatcaagaaggacagatcagaggtcattttgagcagcctcttttattgggmcacaaaacatgcttatccccatgcaataatggcattctaattccagtctttatcaatagtaacaataactttagcaattactttttaatctcagaattctagaaatctgagttctaacaaaaacacggtgtatataaaatggtttatggccatgcataatttgtctgccttcttttccagtaaaatgaggtaggtcatgtacatttcatattttagctcatgaaatcttcaccattttcccacaaggtttgtttccactttatatgtgagaacctgaggcctagaaaaaatatacaacttgcccatggacacacaactagcaactggttatcagccaagatttaagtcctctactttgactccagaactgacattttttatattgtgcttcattgctttttttttgtttgtttccagaacaagggttacctatgcagaggtaactgacatatgaaaactatccttagaaagaaatcaagtaaagtaaatttgcctactttcctcaatagcccatttcgcctccaataaaatcatatttaacgggttgatttccaaagtatgagtttgttttacaaaatttaagaggaggaaaaaaagaatatgggtgggatttgtggaggtmctgctatagttaatgagaagatatcacaaatcaggtaaaaatactctctacagatttcttttatgtttgcctcacatactgccaggtattaagcatcagacagatgttattgatgtaatttctacagttacaatttttcacttgaaattcaaaggtagttaacagaacattattcaaattgaatctgtatcatgtttaaggcttctagcttcattatataatatcctgtgtaaaagaagccaaataataaaatgtctttgatgtcaacaaaagcaattttcctttttttatgtgttctcagttcaattagctcccctatcagaccacactgaatccttggctctcagttactaacatacaagcttttcagctgtatattaaaacaactaaggttttggtactgcataatgacattttctatttaattttcagcacaccatggaatctgaagtgattcagaatggctggcttttgaaattcctttgaactaaataaagcaccttcatttttacttgaattattttacagtacttttaccaatgcctaaaggaacaaagataacagctatttttttccaggaggattttggaaactcgaaattcttaaaagaactattttaacaaaaataaattgaaggaaaccgactgattttaattttagagatyattgctttcaaatatatgatcttcaagtcctcttgaattttgagctattttgaaatcaagttctatttgtataaggctttctctctgaggcaaagtgttatgtgagggtgctttccagcattcaaaagcattatatctcaggtcttaaccatatttccacatgtgcacatcttccatcaaactgtggctcatagcacagttatgcaacacaaatctcgatgcttctctcccatcaatttttgaggaaatttttgaagagttccccaaatcagattattatctatgtatcaatacttggtcagaaaaaattcacctgaaaaccattactgtatactgtaccaatacacgatgtaaataaaagttgagtgcagtagacatagttcacttctactacttataacacacatagtgcctaatatgtgccgagcactgttctaactacatattgtaactcatttaatcctcacaacaaccctatgaagttagtactattattttccccattttaaagagaagaatactgaggtacagacagatcctaaatggtggaactcagattcaaacccaagtagcccacttctagaatctgcataagtaacttttactgtatagtgtttctttttgttttttttggacgaagtctcactctgtcgcccaggctggagtgcagtggtgcgatctcagctcaccgcaacctctgcctcccgggttcaagcaattctgcctcactcagcctccctaatagctgggattacaggcttgcgctaccacacctagctaatttttgtatttttaatagagaccaggtttccccatgttggccagsctggtctcaaatgccttacctcaagagatccgcctgcctcggccttccaacgtgctgagactacaggcgtgagccaccgcgcccggcctatactgcttcttaaaaggaaaaataagctgacacattgttagaactgcagccaaaccagtgcttttaattacctaactagtgccaatggactagtttcctatcctttaccatcctgtactatcctttgcctggttgccagggcaaccgggatcactttctttaaccacactggagcttattctgtgtaatcatttgccaagcaatcatttgccaagcaatmatttattcagtcattcaacaagcacaaatcaagtgccttttatgtgcctcacacttgtaagtgatgaggatacaatgcccaataaaatgttctggttgccctcaagaagctgatattccttcttgcaatacttctatgttggtttatgatctatcacatcttctagtgtccagtgcctatactctctagtgtcttaggctctccctttctggttcctgggtattgtcatcatttcaatctcctaccctccattaacacatttatattatcctttccactccttcaatgccatcatccaaattcaggtctttactaataacctacaaataaattacaagaatggccgtgtgttctgttctccttacacctaatctttctcaaacgaacttatttaaccacatcaccaccctcctactcagatgcaaaaactgactctctagtggctgtataataagtaaatctctttcatgtaatattaaatactgtttacaatttgacccccaacctaccatatcagtcttgcctcctaccatttgcttcagatgcactccagtctaataaaatatatctatttgcagttccctgcttaccatttgatcatgttgacatatctcttggcaatgctatttcttctggccttcttactgcctgaaatatgcccacctatgtctatactaggaactcttggaaggccccgttcagaagtcacttatttcaagaagcccttattgaggtcaccagttagaagtgctcactgtattttatgaatactgatagctccgcatagcccaatctaatattcacctgtattgaattatctgtgcatattacctctgctagactgtcctattccttgctgataccaagtacaagttccttacccatatgaatatatagatatgtatagcatagtgctctgcatatagagtatctatatatatagtcaaattaagtaaaactatgatttaaaaatatgctgcaagtcactagatttcttaagaattgcatataacatcatcatatttactgttgtcaaaatataatgttgagaatgattcagaagggaccaaaactgaagctaaggagtttggaatgactttatatttatatgcgttatttaaagttaagttcctttgaagttgttgctcttgtagatgttggtatttttttttaattttgaagttggggatcagggagaaagtaaagaatataggagaaagtttacttgttttttaatgtgaatcagtaaattctaactcggagaactttttgacacacaattccaaaaaccctatcagaagctttgacaagagaagcagaaatataaggaaaatttaaaaagcccaagaaatgctatcagttcacctccctcagtactcaaaattcaatctttcaatcaaattaggcaatagacctgaaccacatcagctgagtacatcacagaaatgctttcactgtattgagctttaatgttattcttatagcttttatcaacatttgctttaaaaaaaatccrtagctgaagcatgcgtctgcattttacaaagaaactgtccagtacattattctatattccctatttagtagccaacattagaattttaattcaagttatgctttcactttctcctttctgaaaactagaactagacaacttttcttgcttttcttttttgacaaaaacaatgctttaataaaacatggatacagaattagagcaattatgttaacagtatggctactgaatttgcatcttctaacctctttaggcatgaccttatttctattagagatattagaccttagtagagatagtctcaattataattgttttacataatttggggatttattttattttattttatcttattttgagacagagtatctctctattactcaggctggagtacagtggcatgaccatggctcactgcaacctcaacctcctgggctcaagagatcctccaccacacccagctttttttttttgagacagagttttgctcttgttgcccaggctggagtgcagtggcgcgatctcggctcactgcaatctctcccttcagtttcaagcaattctcctgcctcagactcccaagtagcgacacctgtaaccccagcactttggaaggctgaggcgggcaaatcatgaggtcaggagtttgagatcagcctggccaacatggtgaaaccccgtctctactaaaaatacaaaacttagccgggcgtggtggcagctttttaaaaaaatttttggtagagacaaggtctccatgttgcccaggctagtatcaaaatcttaagctcaagtgatcatttcaccctggactcccaaagtactgggagccactgcacctggccaggggttttatttttaagagtatactttttaaaggataaatatcgaggctgtgcccattcatttgtttatttatgcaataaatattatcttttttcaattctagagatacaacagtgagcagagacaaaagtttcttccctcamaacacatataattctaactctgggaaatgaatattaaagtaggataaaagcaaaatatataaaacattggataaaaattgtgaaaaaaaataataatgcataaaagaggaaggaaagggtagttgttttaaataggaggaaatgatacttggttgacaacccaaagggagtgactcattcatctatttgagatgcaggcgatctagtcattaagtacagagaccttgggtgttccggggctacctggagaccaaatggttggagtgaagtgagcaaggaagagaggcatttgactgggtgaggatcttggagtttattataaggactttacatttgactcattaaacaagtagagagatgttcacacatctcaactaatagtaataggtaatttttaaatgatgtttacttgtaagtaatgtgtcagtaagcatcagcaaaaaatgttactttagagatatttaatcatttagtttaatgccatcctttctcttctttcatgtactcagcaaaatcatattcagcagttactatgtggcaacactatgtggcaacaatggaaatctaaaaaaaaaaaagaaaaaagaaaaaaaaaacataattccaaacctcaaagaaatgtctctcaagtggcagagataagtattaattattaaaatttcttttctttagcttttaggtaagggaaactatataagatgtttaggtagaggagtgatcatcatatctgcatttcaggtagattcacatgtagaagagatttgaatgaagtatgactggatgcaaggagatgaattagaaagctgtgaaaaatgatgaaaacctgaactaagacactaacagagggtgaggaactaagtagaaagttacaatccatttttagaatggagtattgacaggactttatgactaaataggtgtaggtggtgtgagaggaggaggaatcaagaataactcccaatttttaacttgaacaaatacatggatggtagttacagtcagtgagttcagcttaggacaatttgagatgtattggtaaattatgattagctgacagttgatattatggaaacccagagaggttgatagatttaaaagaaggtccaggacagaaacccaggaataccaacattcaaacaggaggcagagaaataattgttcattaaggggattaacatgaataaacagaaaaaaattcatgtaagccataggagacgagagattttacatctaataatattgttgactgtgtccacctgtagtggcaaacttgatgtgattatttatttcgatttaatagtactgtttatatgagtattgtagagcaagcatttcagagcaagttattatatttataaagattatctgaaattcagttggataatcctcctgaatwtaaaatatattgtattattttattgttgttgttgattagccattctaaaaaaatctgtcctcctaaaataaaaatgcattgtaaaattatttccttcagtccttcaaatgtagtcacttcaatgtgcttttaatattttagtttacttaagtcactatatgtcaattaatatcatttatgaggaaagaaatagcagtgctacaaagaaacaaaaatacgtactataagaagatgaaaatatatgtccattaattagaaaatcctaggctactgtgtgagctcaggaaaaggacaactcatttatgaaaatgaggttgatatatattctgatatcatggaaatttcaatggattataaaatcagtggaagctcaatgctttgaagaatacattaaatgtgcataatagcagctagtatatttttgttatctggtctttcaaccaagtacttgtcaaccaagaattgcttacaaaattttcctatcaattcctaaggtgaaacaattaacagggttaacwgtccaaaatcattagtcaggtcattggcagaaccaggagttcaatatgagatattttttaaatgtctctctttatattgtctgatacttaaaatctttaaaagtaaatgcataaaatgaaaacatcaatatgtctttatatattatgttataataatacatacaaatttagtagaaaggaacaaattaactataaaatccagataacttgtagcatatrtaaaaaatagtcttttgagaagattcatgatagatattaatttttcaggcataatcaagaattggaatccaaacagtagaaaattcgtgttagaaaggacttgaggttgctatatcagcagatatgttctcctttatttttacagtttctacctgtcatttgctctataataatacatgaacaaatgcctcacactgagattactatgaaaccataagctatactgttaccatacttaacattataaccaaaattacaacttcacaaactgtaactcgaggaaaattacaggttataccaagtgtagcagatgtatagaactgtagcagctgttagaaatcctgaatattataccttatgaaattatatttccagttaacataaatgctaaaataagttatttattctaagaagttttttctggagacaaacatttccctgtgcagcagaaaaagcctagtattagaaaagcctgctcttacaagtacattcgaatgttcagaaattcaaatgaagcatatgttgtcaattaatccaagtatataataatttttaaattatgcctctatttacctatgggtgatgcataataatttattaggagagttgttgatactttttttgtttaaaaaataattattagataactagctcagcatcatagagaactaatatctagaggttagaggtgaaaattagtaaagggaccagaaaaattaaaaatcatgacagaacaccagcattatgtaaacagttaagtaaatcaggattaagaaccatcccaaaaatgcacctgcaaaatcgaaacaagcaagtagattgtttagatctacttgcttagtccactgcttcagaaatcagcactgctttgtttaaaagataattattgattgctatgttatataataatcttccaagacmgttacagattaatctgaatacctatgacctcaatctgaatttctatgtcttagaagttttggagatagccaacccaccaatctgtcataaagcatattagctgtctgggggttaccagttcctcaggaatgtcaccctgtcctgtcctctccatgtgctgatcatgaggagggttagtgacactccacacccattcatctctctcttttttttggtagtgtaatgagtacagcaatcattctagcagtatttgctatgacaacatcattcagccccaacttatgccaaaaatgtgcatgttaagtgaagggaaacaagctctaatggtgccctttaatgttctgaagacacaggtgttctctgtgaacttgacatttgctcggtctacatstgatcctaagggttccagataagatgaattactgtgtgaaagtcctcaggcattttctcacagataaatagcatgaaattttgtgatggagagagaacaacctcagtagtaactaggtaaagattgtactggttccccagttgataatgggagccactgcacaaaggtcaaacaatttggatgcaaagtatccaatttgtcatcacaaattggatttgagagtgccatgaaaatgatgagccagcacactgcttctaccccatggtgacatttactctctcttacccactctcccttagttcttatggattcttctgaaaatataagatggaatttttttctagatggattagagaaaatatgtgtctatattttttaaacagtatacaatggtgacattattaagatgatgacactgatggtgatgcaaattaaaacccctgagaatcttcactagatgcagtaataaaaaggttaaccaagatgtcaggaaaaaatgcatcctgaaatatcagcgtaaaagcagaatccattctctgtggtatttttaaaattataccacatgatgttaaattataagcacacatcagttcaacctagcaaactttcattgaacaactatgacatacaccaaagagacaaagataaaaaagaccttgactgacccttcaaggagcttgcaatcctttttaagtggcaaacatttatgccactaataaggtgatataagcattttatacttttttttagatttagaaatattacagtaggagaaaaagcagatctttttacacacacaaagaaaacacttagaattgtactgataataagattagtgttatttggtccatagagatgccaaggtatgtcagttgtctcactgagaactagggaattcagccaaaaatggttcctgatcatgttctkccagagcaaatagtactgaagaaaatcaaacttgtcagaatagattttctgagatgtgatgagctagtgttagaatgtgaaccaactagtgcttgaatgttgaactatgcttccagccttatggagagttaaggctccccaagctgcccaaggggccttcgtgatacctgttttgttactataaataatagaggttacttagtgaatgccaaaagtgatctaaacattcattagtattaactgtatacctatgttgcaaatatcaccagaaaagatattggaaaggtaatcaccatcaattcttatattcctaaagctttcttccagtcctctttttctcctttcatgaaatagttttcagacgcagtttggaaaacaagtatagtaattgactggctcataaaagcaatggaaattaaattccagctgtattgtcattttcaaactcatgtttttggctacctcatacctctaaagcattaaaattggcatgtgtctattaatacattcatcaattctttcattcaactcaataaaattgagttcttaccatgagctaggccttgatgactcatagataaataagataatattctatcctccagttttgcttagaattcagtaaggaaagaatgacaataaagtgctgtagctgatatattgtattcaggttaagataggaaataaggctgtaatgattcattctccccctgtgggattgggatcacattcataaaagcaattgtactggggtatcaaaaagtttgtgaggttgaaacagaaggacacattgggcatatatagtagtttgataaaattgaagtaaccttaaagtacgtgtgaagggataggagacgtgagcagagctgaggctgagagacaaaaaaaggcctatgtggtaaattcagaatttagactttttaataaacaggagaaaactatgaaagaagaggatttttggacagaaattctaaaatgtgttttatgtatacattaaaaagaacaaacctggatgttagagggctaatttgagggtaatttcaatagtgcaggggatgagcaatggaagcctgaacccaaatgggcatctctgtgatagagaatcatagaggaatgacatttgagaggcaggacagacagagctgactatcagttggatgtgagacatgaataaaaaacatgatttgactcccaagtttctggtttggataagcagttgaataattatatcattgggaaataacaagagtatcacattatttgagttttccatgtcttctaagcatgtagatttttagatctggagctcaggagagagatttggagtcatatatgtataagacatagagtgtggcagtggatcaaatagtgtgggcaagaacatataaggtaagaaaagggcttgatgaaaacacagtactgtcagaagctaggaggagaaaggaagtcatggaagagaaggaacggaggaaaagtcaagtagggtgaggaaaggtaagagtggggaaactattagaggaaaaaaaagaggtggtcagcaagtttgattgtcatagaaaaagaaggaagagtaggactgaaaatgtttgctggattcagaacaaagaagtccatggtgtcagttgtcaatgattagatagtcaacgagagttaatttagttccaatggaaatgtgaggaataggaggtagttaaagggcaatagaccagagggtttaactatatttcctgtaacaaatttgaatatattcgaacgctataaaagaggagccaaataagtgaaaactgagcagctaggtctccatacctgaggaatcagcaaccggtggaatagtacaaaagcaaagtggaagaagtagtgttaaataggaggaagcaagtcaggaaatacagatataaattacctgcaggtgtgagggctagctcttgggagatttcatgcctcaaggctcactttctttctttttttttttttttttctgtgcaataagatctgggtccayttccaacttttctccctatagctcacatacttgaagtgtgccaagaacaccagatatggcaacatcccacagatgatgaatggtatgaaaatggcctgagggttctacatcattcatatattctctgatcactagagatttattctcctatgttctctagcaaaatgattacagaaccacagcaataatagtggtctgctcaattagccaaaacatgctactgaaaccctttatttgttccacagaaagaaatgatctaaaaaaatattttctgagggagtaggttttcctcctaagctgcatgtcatttagctcttccaatttcttctagtatagggtttatttcaatgatttctctgcctaatgtgatgctgtaacactctgaatctcacatctttcctcagtcattgatgtgctgatcgttcagtctgccagatcattaacaatgatttttttttaaagaacagttaacaccaattcttgcagtaatgcctaccctttaatctcccactgctcctaaaaaggaatcatccatctttatatgtcttttcatctatcattggtatttgtgctttgttctttgacagtttcagtcaatctgattaggttttatgcacagcaactcaatagcacaggataattatgatacagtgaggactacttttttttctgtttacttctatatgcccaacattctgttctgtaggcaatctgacaattggagaattttaatgcaaaaataatctctttaaaaaaactttcaaaaatttcaacctctattttagattcagggggtacatggacaggtttgttacattgatacactgtgtgatgctgaggtttggggacacaaatgatcccatcacccaggtagtaaacatagtaccaaataggtagtttttcagcccttccctcctccctctttccccccaactagtcgccagtgtctattgttcccatttttatgttcacatgtaccccatggctagctctcacttataagtgagaacatgtaatattaaagaaaaaatatggctgcaacatagtaggcaaaattcattttcaaggagatcagaaatccaattgattatagcctaatccaaataatttattatttaacaatttaacgagggggaaggggatatttccaaaacgtttaaagtttatttctcataggattttaaaattacctggcactataatatggaaatagagagtagcattaacttgtcaaaaattaataaaaacttgcttttaagaagaggacaaagggagtcaaaatggattgtctaaaatttaaatgcaatgttagaaagatcacttttgatgctatctggaaagtttcccagattccccattgagctaatctctgtgagtgctcattataagaagtgatagctatccctctgtctcagagacaggatttgtcttattctgattgacacagctcatgttatattaagtttgtgaaatgaayacaaaagctaagataacttttgtttttaatgacttgcacctttttttaaaagaactcttagggatgttataaggataaagtaacataatagatattttgctcagcaaaaagcatgattcagcctagcacagtggaaagatcatggtctttggagccaagaaaaaactgaatccaaatctaagtaacctcagctctgccactttctagctttatgacctcagataagtttcttaccttcttagcgcctctatttccccctgggaaaaacggggataaccagaagctgtgaaaagtaaataagatttgatatttaaaaccttgcctaatgctgaccacatctaggagacgctcaataaatgttaatccccccaggttcccaatagcatagcttttgaacaagtttatagatgccaaatatgaaagaaataaatacatattaaagactaccagatacgtgatgctacctagttaatgcttacatacagtaaatgctgaagcatacaacaaaatacaaaatgttttgtatttctttcccagacttgtagtggtattcttagttcttgagattactctaccaacatttattaaatacctgttttgtgacagtagagtataaacacagataagaaaccatctttgttcccaaggagtccatgatatactttaaagaaccacaggagattgaaattggcagaaaccctggaggtcaccaaatacctccattttttaaaaaaaatttattcattttatttttgttggtttttttgttgttgttgtttgttgttgttgttgttgttttacaaacccttgtgttgcgagggctgactttcaatagatcgcggcgagggaactgttctgctacgtaggaaaccccgacccagaagcagatagtctacgaatggtttagcgccaggttccccacgaacttccattgcgtgacgggcaagggggcagctgcctttgcggccagaccccgtttcccaggactaggggcactccgcactggaccctagtcctggcgcgggatggggcggcccccaggcggggatagcgggggaccgacatccgagaccagccaaggcccccctctgttttttttaaagaggagaaaccgaactggagaaagtttcaatgaattactctataccacattgctagttagtggcagctccagtgaagccttcctgactcctaacacagtgacttttcctttaacctggtcccccaaataataagctgtaaaaagatttactggaagaaaaatgcacaagaacttctcgagtaggtcagatttctttttttctctcttaagtataaccacatcatgtttgatccattgaatttctgtaatggtagtgtatcattacataaaataaaagtgaaaaagaaatacaacaaatttcagactgccttatgaaatacaatagctaagcttaaatattcacagggctaatcccagaaaaggcagtctggactcggttatccacataactacctctattatccatttcatattagaatgtagaattataacatagttaatggggtttcaatttaaagaccccgtgtcatcttattagcctatcatctgccctattttctccttaatttaccttatgtttatacaattcttatctcagggccacgttgctaccataaatcaaatatgccaggtttcaagtttcagcatatgagcacagatgtgagcraacagcttttgatcactcagttatctctaccagagtaactgaaacagggattctcaacacatagaacttctaatccaggctgacctcaattaactgcaagctaacagacattgccacgatatcttcctagaagaacaagaggattcctggaaagaaaaggaatctatccgtctttcatcccactggtcaatacctttttctcagaatcaattattgacattttataatctatgatcttcaccaccgtaataagacttcaggaaaaaaaaatgtaatttcagcagaaaagattggaagcatggtactagggatactatacattggcacaggagaagataaatgtattgactcagcattttgttaccattatccttctctctaaaatctagttctgaataaataaaagcagggactcagagcctggcaggatatcttgccctgaatgcatggcccataatcgaagctttcaacaggactttttgggtgagtagataggaattaagggtccaaagaaaayttgggcactgccttccttttacattgatgacttaaagaagaagaggtacattagtaggtaaagaagaaataattaccaatttagaaagagggtacagagggtagaaaagraatagtctaatgtttgcaatatgtttggaacatatattcagggtccaggagcactgcctgtatctgattccttgcttctgcttatccagagatgagtttagacagaggacaatgaagacagtactcagacagtacacttatcttctcccatcccaatatatagaatctctagtacaatgcttcaatccttcctgctgaaattgttttaacattttttctggagccttatgggagtggtggagtctctagatgtgtaaaatgccaataaagaatgcttactgggaaaggtattgactagtgagattaaagacaaatatgctcctcttctttccagaaattccctgtgcccctaggaggagactgtgtctgttaaataatgttaactccagaaggaaagatcaaaaacaagagagaacaatgaaaggatagtgctaagtgtgaaagaaaaacattaaggaaaggagtcggagggaaagtaagagtgttactkcattatatttaaaccagcctgtcacaaggagaaaagaggcagaaacatgtgtgcttcttgtctgaccacttatctaccaaatccagttcttctacctttaccttcatcgtttcaggctctcgtataggcaataaatggtgtcaaagattcagcaagttgctactatatatttatgaaataaattcacatatatttatgaaataaatacccatcagctttcacatactaaaataattagtgtaaaagctattacattaaattaaattaaattaagatttcattttctagcattaacaggtggctttccccttattccttattccatggtaacatacccttctaaaaataaaagtttcaaccagttttcctgctcttagttcaatgtcatcctaaaaacaaaaaaacaaaacaaaagtggccctaacacctactgggtgttaaaagataatcttggattagcagataagctttctgaagtgggaaagtgagattgagcaaggggaatattaaattgtcaagaacagtaccatgtgttctttctaagaatgaaaaacttagaaatttgctatcagaagtgaccacctctctaaatagtctagaacaaaaaataaaataatttattttgtaaaaagaaacatcttcccttcacggtcttcctccctttcctacctctgttcatcccctgccatgttcatgaggtacaaacaaaaataacagtaggattaacctggaagaccctactcatgaaaaatcatttatataaacgaggaagaaaattctgcccactttctagcatatcaaggaatattgttaaacgtatttaaaagccagtctgtgattttgcatggctttattaataatgttcttgagaaaacaaagccagtacatagataaattccttacatgatgatcaacaccaaggaaacctcttactgttctcagacctaacataaagaatgatgattttcattcactgtsaggtacaaaagcaataatatatgcaaaataggaatacaggaaatattgcacagctcactaatatactgcaagttactaatgggaaaaatatcaaaataccttaaggactattatatacattatcacaacactcaaagaatgaaaatcacttattcctttgaaaattgggatactttttattttgagagctgcagaaaaccctatgacgcactacatagctctcacagtaaatttccaggatcaaagttcaaaaacaggtacatgataaaatgagcaaagtgaggtagacaacagaaaatgccaaaatgacaataactgaaaatattaatttccaagtattatatctcataacataatagtaacatgatgtctcaccgttcccagctcatcacatgttctaaagctgttctcctcctttttataaaactttattatcctgctgaagtttcactcatacaactagtcattccttaattttatacttagttattccttagttattcttagttattccttaattttattttcttttaacatagttattttatagcaaaaatttatgatgataactggttttttttttttgtactcttcttatcttaaaaacaccagttagaaaaaaatgacatttataacttgtggtctatggaacaagatcagtaattattccatgcaggataatgttagtatactaagtgagacagcatcatttagaggaaaagaggacaagaaaagatgatgatggtagaaacaggaggcagggtcagttatttccatattgatcatgtagaccgtgcctgataaggtaagaggtctattattaatcaaccaattcaaccaatgatgaaggctcaacagaaccccaatgtcagggaaaaagcattaaatttcaaatcccattatccaataagcagttatttatgaactacatacaaaatgtaaactgaatttctaagccacatacaactatcagtataattattctataatctaaatatatccttgactctaagaatatacatatttcctactacaaaaatttactcacccagtttactgataattaattccaccaaggttgagatgataaaacttcaagggtttatttcacaaggttgctttgtgtttaacttgaacaaaaaagggaaaataaacaacaaaactaaaacaaccattgaaccaacacacctgaattttcaggggtagaattttaggaagaaaacagtccctgacaagtacaaattctctacatagaaaactgcctattcggcctcagtctatacacaaaaattactactgcacagattctgtgtagtagcacaaatagaacaaaggtcaaagattaaatgtaggtatgtgcatgtgttttatatatattacaaatatagtaatatatacacacacattttgtattagcctatgttattctaagcattagtcttagcatatgctgtgtttcacatttagaaatccctaaatgtgttcagaactgagggatgtattattcataacttatctttaaatktattatttaatgcagtatccatttgtaagttagtagatgctgatctcaccaattcattgactgtggctaggcatgcacaaatttcacataaagatataaagctaatatacatttccttcctctgatttccattgcccggatttcttgcactaaacttttmtgctgtgttgcacatagtgcatgcagaatgcatgtagaacatgccctgaagaatctgcaatgcagataagaggaaagcattattccyaatttgcatatcacaccacacacagtaactgatttgtcaaatatcaaacaatttacatattctaggcctcctgctctccctttcttgagcgttcggtctactttttctttttgcaactgaattttatagagaggaaaatatatctttagctaaggtgatgtaatttgaaaatataagtattagatttctccaaatgacttaagaatattagaaaagaaaaaaaaagtacccattcagcttagattgcagaacagacagggagcttaaacagcaggctctgactgaaaattaaatttaagcttccagttactgcagcaaaacctaagaccaccttccctctgtagctcgagtgggagacattgttctgctgtctctctaggctctttggtacgctgaggstgatgtgattgcccagactcgtgtcctgcatggaatttaaactacttttgtaacagcaaaaggaatttactgacttcctctcagattgaaagcagaaatgaccactcgcatcaaattatttacttcgatttgtagcttatttaaaatgaggtaggttgtgattgatgttgatttttattcaatggctcatctattctgatatttcagtttcttaaaatatttatgcaaagttttgtttggattacttacatacgtagcacaaatkattctttatttgccatggtgacagcacaaatcacattatttgcagaggttggggagtcccacaaatcagcccccacaacaacaaatatttatttattgaactcttggaacagttacaaagaaatataagacacagtttctgttttcaagaaccttacaatatgggaagataaaatatttacagatacaaattaaccaataaaataaagacagagatacaagcaatgccacaaagccaaaatcatagtggagattctgccctggcaggaatgagatctcattacctgggtgatttattattcctctagttctcagtctgtctctgaaaaatgaagacgtgaactaaattttctcccaattcaacagccttaaaatttaatatgaattctcttacacctaaccttaaatgtcttcacaattgtactctatgtcttatctatggaaagggaagttagtagccaccaaaagatatttcaattgatctattttcccttggacattttaacagctaataagccaagaaatgctatctaatttccttacacatcttttttcttttttcttttttcttttttttttttggkgacggagtctcaccctgtcaccgaggctggagtgcagtggtgcaatctcggctcactgcaacctccgccttccaggttcaagcgattctcctgcctcratcaggagatggtctcgatcttttgacctcatgacctgagatggtcttgatcttttgacctcatgatctgtccacctcagcctcccaaagtgtwgggattacaggcgtgagccactgcactcrgcccacacatctttatacaagaggagtgaagttatacacattgtagtctatcctacaatttttttttttttgagatggagtctcactctctctcccaggctggagtgcagtggcaccatctcrgctcactgcaacctctgcctcaggggttcaagtgattctcctgcctcagccacccaaatagctgggactacaggcatgccccactacagccagctaatttttgtagttttagtagagatgcagtttcaccatgttggccaggctggtctcaaactcctgacctcaggtgacccgcccacctcagcctcccaaagtgctgggattacaggcgtgagccaccacgcctggcctaacctacaaatttttaaatgggattttgtttggaggggtcgttgagagtctatttttcagataaagaaaccaccttacctagttacaagcattgagttttctttccctgctaggtcctctaccttatctgtggtaccagccaaaaagtcaattatttttaactccgagaaaattctgactgcaaagcactgcctcttcctactcagtacagatgatcaaggtgggataacacagaagaatcttcacacccactcatcactctctctctctctctctctctctctctctctctytctctcattaaaagcactaagcggccaatgccttactgtctattccatgggcttcactaggctgtcccttcttaggcctagaacgaaatgggcttcacaaatagaaattattctaatccaaataatatttccccaagtctcacagtgcaaaacaccacagcagagagcacatggtgatcaakaaagacagcattatcataaatatttgtatttcttatgctaacagatcccattcttccagtctgtggcattgtcccaaactgccccatcaaaggttctaaaatatgcttagggcatctctattaagaggatgaggagaaaggaggagggggaagatgctaacaactaaatggtaagtttttacataatggtacatcctgccagccaacaagttttactacaaaaacaaacaaacaaagaaacaaacaaagtttacaaatcctttctcttttttttaagttttattgattctgctgaatgaaaacaaaaaacaaaaaataaatgtttatattagtcctaaatgtaagtttcgtaaattctaaatgtaatacagctgaagcaataatagtactcatttggctcacctaaagtgccaaaccatttacctcaaagtatgttcattgtacttacactgactatgtgtttcagttgtaaagaaaaataacattaaagagcaggtatagaaatttagtctataacacatacaaaagctagagctataccatcccctaaaacatgaagaactttgtaatactgctttgtaatggtaatataattactttatcatagtattctgttttctgggaaccaatcatcttttagaatattaaggtttggtcaaccttcacacaattaactttagtacaagcatgagaaaataaggctacctacacactaggatgcagtgttttccaaatacgctaatcttagaacactatacaaatacaaatacaaatttgcaggacattactggaaaaatmtgattccattgatctgaggtgagatagaagaagttggaatttttttaagagtatctctagtaattcttattttctggcagacttgaagaacatttttataatgtactcaaaaccaaatactaagaattttagattatatttgccaggctgcccatcagtcagtatctatatgcatatcatttgaagaagcttgaaatagagttagcattaaaaatagttcctccattatctatcacacaaacagcataaattcttttgttttcatctgaagcactttttgctctttgaggatccttttctaaactgtaaatttcctggaaatgctaccagtcaatatctttgaggaactaaataatagtccttgaagagcaaaaacaaatgaaaaaataaatggtggtaagcaatggagaaaaggagtatgaaacgaattctgctaaaggaattgcaagatggaattgactcattttcccattgagattaatcttttgaagccaaaacaaaatccgaggaccacagatgtaaatgagcatgacttgtatatctatgacttgtgctagaaagggctatattgtcatgattacctcccaaatggtcaatgagactctggctaaccttccctaatgaccttatgtcatccatatatcttaggaaaagtaactccctcccctacacgatatctctaaaagagcccactgaccagtttccttaattctgtccatctttgcagattacagacacttagtatttaccgtttcaaaagtaagcagcttagtatccatcgctcctttataattccacatattcacgtaagaaggcaatgataattcaggaggtacttcaagatcagtcagtgcctcctggttattaaaaaaaaaactttataaataaaaaggctgtaccccaataatataaatttgtcaacaatgtggagatataaaaatttaccccagaacatcaggaagaaacatgtagaataaaagtactgaaatgtaacaaaagcagagatgtgacctataggttcctttaagggtaagcttttgtgtcacacaaagctaagtgaccaatgaggacagcaggatcacaccattgatccaccaagtcaatctgagcttcttcaatctctggcctaatgcttcattatagcatgaagttcccccaaaatacactaatatgggttcaacaatggcgactttttaaagtaaatgcttggctattaatgccttattggttccctaatagaaaagggcaatgctcatatgattcctttcttaccactcttccttccaggttcaatatgatgcagtatttccaatggcgggagacagaaacaatgtcacaaagtgggagaggcactaagaatgagatctggcaccacttactcttgtttctatacaatcgaagtacaacacttctcaattttctaggygtctttggggagagatcttatctctcttaatggtaccaactcagtaacccaaactgttcaccaatacttcttttaagtagttgtgaggtagggagtccaacacttcccaagagatcctgttagtacattatagcaactacagggaatgttttacaaatgactgtcattataatgttaaatctaacatatatgccaacccccttagtttatacaataactttcctccaaaaatcttaattaaaaataaaatatagctgacttcgttataaagagactcattaaccaggacattgcagtttttattttatcaaatagaaatagtgaaaatgaaagatgacatattttagagtcagcacatcctgggtccaaattccacctctcctgcttcctacctacgcatctttgagacagctgcataggctctttgcatctcaactttccacataaaatgtggcaccccacatggaacataagtttgttttttatcccttccataggtgtcaccattagtacaagtattaaaacttctcataatttcccattgagttttcatattattggaacaaactcattaagcaaagattttatgaggctagagtaaaaagagagcagtcaaactatagacacagaaagcagtcatggacagagattcacaacagaactttacacagttcctgtccaaagggataattaacaaagcaaataggtaggtgttgttttaaccaaacagactaagataatgaaaaaggaaaactgcagctctggaaaggagacaatgccatttgcaggctagaaagttatggaaaattttctaagcaataaaaacttaacatgacccaaaatataatcaacacaatattttgaaggcagacaatgcttcagaaaagatgaataggatatcacttaccatgggctttgttctttgtaagaatttcctggtatttttgtgggagtaaggcttgggaatttcagacctcagagctaacagtgggcagaggatgaaagatgtacctcaaaggttcttaaaagcmataakgatatcaggggtgtcttaaatttccccaacaacctccatatccctaatgataagttgccactgtaaatggctgttgtrtaatccatcatgaatatagatttagttattgactgggaattctggtcaaggaggaatattttcaggttttatttacactgatgataatgtgtttcctcatgagcataatactgtactcttgcctcacctcttatgttcttttgccacatgtaatatatgtatattatattgttgaggtggagatgaagaatgcttgtaaagtattggaaagaacaatgtcacgtttttatgtcctctgagaaaataaaagggtagtctacctacagcctgaaatacatactgtcgcccattcatggaatttatatcacataagagttgattaactgagctttaataaaatatggttggtatacaagttctaattcaagaactggagtgcctgtggacccactaggatgtgtttaaggaaaatatgtttgggaattcctttggtttgggtgaggcaatatttctctggcttgcagttacttctatgcataattggtcattgttagtcttcccaatgtaggactggattacaggaatgctcgtactacccatttttgcatctaattttatgttcacaattttgcattatttttcttcatgagggtctctcaaattgtataagcttcaggcttgtgaaaccaagatccactcctgatctgtatctgtaaacactgtacttcttaagcatcaaaggacaggtttgaataccatcaaaggacactcacaaactttctaaaatatccacattcctaaggataacaataagggcattccaaattaagtggcgacagaaaaataaacacaaacccaacagtcctccacccacaaaattacattatacagtaactttcaatcactatgatctcaagagctataattaaaatagcaagttcaagtactttatatgacaactatgatatgaataaatctgctagagcaggatgaaacaaaagacaaagtgtgtcatttacttgtataacctgcatcacctcaggaaggtgcatatgaggttacatcaatatcaagtgagagagcaaggattatgtggtggcctgagtgaatytgctcatgctcctgggtgcaaaagagtgggaactgactgagactgattatctttattccttcttgacagcttaattaagttctctaattagtcacagtcattaagcactacatcagcaattctgcctcctcttggattggcttcttctctagtctaattggttagaaaagttagctgatctaaaacattgtctttcaattttgggaaatcttctttttcacttttattgagatataattgacaaatagaaagagtttatattcaaggcatacaatgtgatgttttgatatacatataaattgtgaaatgattgccacaatcaattaatatatctattatgtcacatactgtgtgtgtgtgctgagaatacttaggttccactttcttagcatatgtcaagtatactctaagttattattaactatagtcaccatgctgtgcatggtcttcagagcttattcataactactagtttgtaccccttgaccaacatctctccatttctctcactctgggacccctgctacctacccttctactctctgcttctgtgtattcaatttcttagattgcacatataagtgggaccatgcagtagttctctttctgtgtctggcttatttcacttagtataatgtcttctaggtttatccatgttgtctcaaatgacaggatatacttcttttttaagactgagaatactgacccagcaacacgaggttggtttacttcaagaagcaccctcaggaaagttgtaagtttgctgaactgggtcctcagccctgtcctgatcaccattttaccaccaccaccacgatgagcttcttcttcactctctctcccactctcactattctctcagctattcatcctttcacactgtctcagtctcttttgccatcccttgaggaaaacaccaccaaagattgaagccaaaatatgagagttcatactctaccccacaaatcagttcttacaaagaagacttcaaagaaggtaatgctctcaaggatatcactttgcagaagtgatttcctataattccagaatgataggcaatcagcaggaaagataagtgattgcgcaaagttccccacatcatagacacacctagaaaagtacagtgtccccaagacctgtcatgtctttcaactaatcttttcttgcatgctggtgtctcttcactattatatccaatgcagtaatatatttaatacctcgaattacagttcctataatcttaggaaattattttgtgatcacatttctaatcacagcatctcatgaaacacccccaaccactacactgcaacaacttacaaaagtattctgggattatgcagataccatatttggtcttagtctatcacatcattcttactagagaactttgttctaggcttttgtcagataacatattgttttatgtattacattggtttcaagagaaattttataattcttattcttttttaaagtccaccacaggtacaatttctggctgtaaatcactactttaaaacaacagcagtaaattagcagtaaacaacatttgaagtaaattacagcattttgaaagaaatatctttggccctttctccactatattcagaactgagtgactggcccatgaactatatccctcctcacaaggtatcattcacatcctccattgccctgcaaggccccttttttttctgtgcgcagaagcccagagagcactttctacaagtttagggaacatgctgatgtagaaacatgaaggataaccacagtatacaagtagtgcaagctatttctctttttgcaagggttacctgttgtgtatctaaggaatcgtgactagacttgtaatgtctgcatcacagagcatctacaaaccagaaaatctgagttctaggctgttttctaatgattcttagacacatatcaatttctaagatcataaaatgaagatacttagtaygactacacctgcctatcttctaggcaggcgtcaaggacattgtaagccataaatcaccaaaaaaaggcaagaaattatttttatcatgactaaaaattttgttttccctcctttagtctttaaattctgctaatgcagccttctaagaaggacatttctcacaaaggattgataaatatctgcacacacaaatgagtccacttagtcttgagaatctaatcctttagtcataattatcttggtctccatgcagtctaatttcagagttctagtaacaaggtaacataacatccactttctaaatgccctcaagttggtcacattataagattaatgagccagatcaccattttccaaaaataaatacatagaaccttgatttgaattagctaaatgaattgacatcatgttagtgatgtcaaaaatggtagagacttctatttcagcagagaaaaagcaaaataatattttaagaccaatgaggtttaagaaaatgaggagtaaataaagaattgaaaacaattaattgcaaaaattggaggggtatttgggcacagacagattgtaagagacactcgatggcaagaatgaatttaggtcgaaggtaatatgaaatttagccatagaaaatttttaataaggatgatatgtcgtcaaagtatatttggtgccatttggaaaatgactgagtcttaaaggatttttaaatgatttcctttttttaaagttgtcatagtcagtttgttctgatcttgagaaagtaaatctgtcttctgatggtcaagtgatggtttccctgaacatccaaacttggtcttcatgaataaggaatcagaatggagaaaaatctgaaaatgcataatgaacttttcagtttagctatgttaatctgtctcaaaattaggagtccatgacttttatttatactaatgtatatttgcatatataatagcatgtatgtctttattttgctattaagtcattttgcaatgaagatatgtaaatattttaggtgccatagggacaccaaaaaatagaagacactgtttctgtttctaagattctacaaatatgttgagggagataaaattagcactaataagaatggcttttttaggtgaggcacgatgataaaaatgtcttttttaggccagacacaatgactcacacctgtaatcccagcactttgggatgccagggcgggtggatcacttgagcctaggatttcgagaccagcctgggcaacatggcgaaaccccatctccacaaaaaaatacataaaattagctgggtgtgatgacatgcgcctgtagtctcagctacttgggaggctgagatgggaggattaattgggcctgggaggtagaggctgcagtgagccgagattgtgccactatactccagcctggtgacagagaccttgtctcaaagaaaagtctttttaaaaaaattctgtaaatgtatacaattaattgccaagtgactaaacagaagacaagcgtatatgaaagtatgttctagtattgaagcactttcatgaaattttaatttatactcaagtacataaaagtaaatgtttccaattgtggcagaaatagccatgctcatcaaatattccagttagttttctaaatatcccagtaactttgcagttaggcagcaccagataacacattctagttcatgggcactagtggaaaggatttgtgtcacttctgggttaaggtagcaaaaatctcatgtgctgttggcagtttctctttctttaccatgggttcctgtctctctctctctctcttcttctaccayggccagtgaggagtctaggcatcattccagatgatgtagctagaaaactgtggtgcctctgtcagcctaggttcctgagtgactatggtccttaaaactaggtgtgtctcccagtacaaatggttgtgtacatatatgacakgaaaaagaaatacatttttgttttaagctatgactttaactagtttttttaaattgtttttgacagtgcagcatagactagcctatsttgactggtagaacaaactaaagctgtgtgaatgaagaaaaaggcatccagaagtgacctgtcaaaataacctcaaagagtcatgggaaccttccttagtgactcaatgaaattttattttaatacacttgaaataaaaattcattaattctattcaatcaataaaaaaaactaaggctaaaaattaacgrtttggggaayagcagaatagtgaaaaataacagagctttgagagagttatcaccttgcttcctctatgatacctggcatattaataactaccaagactcagagaagctgaactgaatgaaagcattttacctttattctccccaactattagcttattgtccttcctttgcctccctaagaagttacatcaggtgcatattgctacaccaatatgtgaactacatgatgacagcactatttacaaaatagaaacgtttggttcatcagcaaagtaatttttagatgtgrtatcagagttcctttattgttaactccccctgtcctgggtttttatttttctctctcctgcttctctccataccatttggctcttcttatctctgttctgcatctttagctggagtggaggctgcacttcccttgtcccttaacakgcatatcaaaaaatgaatataagggccaataggaaggctacctgtgaattgtagcaatgttttagcagaagagaaaggatgttccacagaagtgattccttttacctgtcctcacatctggtcaacataaaagggatgatgaaagagaaacgatatttcagcagttgtgtgcatattctaatatgtatctttgtttctaaatagttgatgcattctagcttaatccttaataagaaaggacagcttcattacaaaacaaattccycattggcagataagcagatgagagggagaatatttaacattactgataaagaatcaagttatgttctagattcatgcagagttttatagaattggtgcaaagtattagaaaatttataagaaagcttatttactgtaaaaaaaacaatcttaggaaatagccacccacacatttttcaacctacttccccaaaaccatagtataacccttagaaagaacattgaagaacagataggaaggggaggtaataatatctttaagaactcactaatatgaaccactttatatatatatacattatctcttaggatcatataacaaagtttgaggcaggtggatgatatttgtatccccattttatagataagaacgttaaaacccacrgagtaaattgtttaaagtcactcaagtactaaaccttactcagtgtgatcaaaagcccatattctttattgtaacttatagcatataagctcctataaggaaaatcacttactaaaaatgtcttctcttctgtacatgccagcagtgctattcctcaaagcaataatctgcatagktttaaaattagtggtgctaaatgtcagcgatgactcatgctttagcattatctcttaagtatgcaggtgataaactttaaaaattaagtacattcattgtatttcaatatttctctagccattctttttggttgaaagtgtgtgtgtgtctgtgtgtctgcgtgtagatatggggcattamggcaggcaaacttagaacacaaaatataaaaattgggtggggaaacatctggatgacctcaatatttacctaacattcttctttgcaaatgttctgaattgtctcatcaattctgcatcatctctgcccccttatacacttttccctgcattgcctggaagctacactcccagaatttcttaccagcatggttccaaatttgattctgctaatgaggtacacttgcaaaagatttggaaggcagatgagaaagaaaaattaattttcctccaacaacagctggaaggcaggtgtcagacctgaagtttgtgtgggcttctgaaaatcaccaacttcagtgcccaggtagccaagatcagcagcaatttcctgcagtttttttagctctctcatatgctgagagttaatcgttttgtttttttttctgatcgttgtcttttaggctttccagtgctatgtaagcacctaatttcctaaagttaattacttctgacttgaaatattaagtgtgatttctattttcctaaccaaaccctgaccgatgcagtatgtccaataagaactcattatcagactaccaggaaaacatattttaacacaggcttacaagaaaaacagttaccaagtatggatgctcaagacagccttaaagcaatgcctagtaagaagtgctttataataactctgatgcaagatcacatgtccaatttttaaaagatgtattagttcacatttgttgcattaaatgattttggggaacaacatagcctgagataggacaaaactgagaatcaaactagataaagctgaatgtgataaaaatatatgcctttaaaaagttaggggtctcaatcaggagttaaattcattaaagaaaaggttatgagtactccaagttccaacagtgaggcagggtcaagagttcactccagctggcacgaacaggcaggtaatagaggacctaccaggtttaaatggggaggttatcactgtcagatatgaagtggctccaatgaaaggttgggaccagtgaatatctgccttagttttagataatgcatatgacatggctttacccactgaccagtgctctttcgagaataaatacttagacacctaatacgtatgaagtcacacagataattggcatgagccaaatgagggttacttgtactctatataaactcttacrtactctcttatcagtagaaatttctattgagaggtggcttggagaagatctctaagttgctgaatcccacaaagactttaaaaaggtagaaaattctaaaaggatgatgctagcaatcaatcaaatactctggcctcctctagaaggaaactgatttgatatgtttatgggtgcatttaccttctgcacacacactcgtcagctaatcaacacaacaaaagtaacacagtcagttggatggaattttagagtcatctccctctatgcacgtgtgctttggcaaaatcaggtacaatatacctgacgcttcagcttttcacttaatagtgcacttatttctagttagcccttgagtcatcttcccagatgtgttagcctatcaacttgtttttttcatgaatatgataactacttatctttcatcttacatcattagaacatttgaattgttaaaattccacatatttcaatatgatggtgtcctgtaatctctgaagtcttgggttactgagtctgctgtgtgtctgaagctacactatgtattagcattcttgttaggtttaatttcattttctacaatgatccatcccttgaagctccacaaaaaatatgcagagcatatttattgctagtactagtgtaaccgaaattaccaaaatctatagaattttcataaatttatgtattttagaataaattattataaaaagaattaaaggatgtttaagttcacaataaattttacatcatctatagacactgaattattagtcagcaagctttctctataacatttataattagaaccaaataattttgactcttccccttagtcatcatttgtgttttaatttctgtccatgtcaataaggttattcacagaaggcaaagaaaaaatattttttaagggtttgttttgctaagttacatggggagtcagaaattcagttaagatgaactgtgtgaggtattaattgaaatttaagtgtataatattcttgagttaggtatggaagatgacagtaatttcaatctcacttttacttcacatacattagatgtggtaacttcttttcagtcagagggacagatgaattctctaggaaatttatatgtamrtatttgcaggtacctttaagctagttctgaggagaaaaaagttatatgaggcaagaagaactttcaataaagaaaatgcatgtaactgcccagaccctccttggagttataaaagagccatataatttccacagcttccatatrccaccaacacttatggtcctacatagcaagtcccataaagcctcagtagacatgtgacatcccgaaaacagagcaatgcccatgatcctatgacatgaggtaagaaattcaaggcaccatggttccctctgacacctgataaactgtatgtatttattttttcctagaaaaaaagsgtatttgacacatatcgggagacacagtttcaaatcccacgttgaccatacacatgctgtatggccttgggcaactcctttgagtctctgtttcatcatttaaaaaccaaggttaataattcctatcttcacagagttgtgataacaataaaaatatattatgaaaatgaggaggctttataattaataaaggtataagggcattgattattttctcaaccctttacataaattagtagattattctaatcttgtgacagagaaaataaaataaatattgaaaagtattatgacagaaactagctagcttcccaccacatctgttccatcttcttcytgggcccacaggmagtataagcttcccactctcctttacagttagaaatggcaatatgactgcattctaacatgaaggaagtggtgggatatttccagtcttagccaataaaattctccagtgcctggtcctccatgccctttccccaagcatgagccacgggaagagaactccaaggtcctagataaaaaactaagccacacgataaaggaggcatatatgtgaatgaccaaatggaaagcctcttactgaccaggaacaccagttttgaatttcacatgtgcaagttatgctaaaccagtgagattttggggtttgtctttgacataattcagtaggacctcaactaaaagagggatatagacaagttaagtgtgaaaaggaaataccaccctcaatcaggctgccattcaaaaaaaaaaatatgccaccaagtatacagatgtcaactatgattgtcatattttgacaaaatattattagaaataataattgctcattttagagaactgatgatctatgaggttatttagggtctgtgtgaaacttttagttctctcaatcatctggggatcatgagggagctgagatgagatctaactttctcaataccatcaccagtgctcgtttccctatagcacactgctgtgcccactgaagtcactggcttttttttttttttttttttgagacagtcttgctccatcgcccaggctagagtgcagtggcaccatctcagctcactgcaacctccgcctcccgggttcaagagattctcctgcctcagcctcccaagtaactgggactacaggtgtgcgccaccacatcaagctaatttttgtaattttagtagagacagggttgcaccatgttggccaggatgatctcgatctcttgacctcgtgatccgcctgccttggcctcccaaagtgctagaattgtaggtgtgaaccaccgcacctggccaagtcccttgctttttaagatacagttagtcatgcagttcttgacaaaaaaaaaaaaaaaaggtacatacacaccaaccattacagaagccaaaatatcaagtctagactgacaacctctgcagctacactgaaaccccacatcactaaataataaaaaaatcctaatgtgactttctcatcttgaataattgttaaacaaatattatccctcttcctttctgccttctactctttatattcttcattttggaaagttttgtttatgaactaaaatattcgatattatatttagtacttagacacatctcttctagcttaccatctagcagaaggaaatgtaaatagtgatgttatattaaaaatctgcctttaatttaattttaaaatgaagggtaatggtaaattaatatggaagtttggacatgagcaatatttatttggctgaataacaaaccctctttaaagtgaatcctgtctcttaatttaacagagtgaaatttatgtttttataggcaattatgtgtcaattcagagaatctcagatttaaaagtggcaaccacttctgaatgaaaatgctttgagtatatttgtgtgatctggatatatttttcccagaaagtcattatgtattcataaatgtgaataaaaaccacatatgacataagcatgtcatataataaatcttagcaaactatatggagaaatataccacagaagtgaaacaatttttaagtatgtgtgtatatttatatatttgtctgttygtattagaatcattttatgacaaatggaataattcagtaaccactttaatttaatactgcatgtttaatatttattgagcaataaaccatayactaagcaaaaagttactaaccctcccccaccaaaaatgatttgctcgtattcactttttcccttatctaatgctgcaaagataattactttgtccctataataacatttccacaattcatttcaggaccagtgattagtccacaaagtttggcaggtttcagatcagaaatatgtgcataaaaatgctgactatttgaaagataagtaaataaattaagataataatttagactcatgttccccaagcttatctaataaaaagaatctcctagctttttccttagagtacatcctaggtaacagctaagagtcagtattattaacaagctcttaggtgattcaaaataagaaactggaaaacatagattcagactaagctcaattatcctattcattcatttatgcagtcattcattcattattttattcattcaatctgggcacactatgtgctggatacaacaggataaataagacatactctcagtctcatgaataaatgcaatgaaatatgacaaacgcttggctgaaagtatgtacagggtccattggcaacacaaaggaaggaggtgtcaattcaatctggcaggttgggtaaaggtttgtcctggcttcacagggaaacccacatttaaaccaagtgtcaaattagtaggtaatcaatcaccaagtgaagaattaaagaacatcctagtaagagaaataaatgctgggttcattgtgcagaatgtatcagctgagtatcaaattagaagacaaatctttttggaaactatttagagaaataatgagagctaaactaagctgagtcagtggaaaatagaagagaaggggggaaggatatataatattagaaaagaaggtggattggacctgggaagtgactggatgtggaaagaggaaagggagggattggagagtccaaaatagctccaaggctgcataaaacacatatagatggtgacactattttcaggtaaagggaataataaaagatgataaggtttgggggaaaggtaggaattcagtcttgcatgtgttacgttgggggacattcgatggatctgtctgttaagtagttgaatacgtaagactagaaccctggagagttctgagtttagagacacagatttgaaacttaacaacaggtgaatagtgagtgaggtcttaaagtggttaaaatcacacaaagaattttatagtgtgagaagcaggtcaagaacagaactttggacagttcttatattttagtaattatcagagaaaaaaagacaagaagaaaatgagagtgacatcagaaaagctgaggggagagagttttaataaaatgagttatcaacagcaaatgacccaaatatgttagaaaaagactaaaataatccatcagatttgttcctagagtggtcagtgattaagaagtggtatgagtttggaccaggcattgtggcttacgcctgtaatcccagcactttgggaggctgaggcaggaagatcacctgaggtcaggagttcaagaccagcctggccaacatggtgaaaccctgtctctactaaaaatacagaaattagctgggcctggtggcaggtacctgtaatcccagctactcaggaggctgaggcaggagaatcacttgaacttgggaggtacaggttgcagctcagatcaccactgaactccactctgggcaacagagcaagacaggaaaaaaawatatatatgtaaaaatatatatgaaagaaacagaaaaagaaaaagaagaagacaaaagaagtggcatgagtttaagaggaaatgggaggtaaactggcaacagtgaaagtaggctacagtctcaaacttgattagtaaagaaaaaagaaaaatatgcagatgaatgatcaaagtatacccttttttaaaaaaattagagaatctcagaattaaaaagagtttggataatcatctagtgcatttcttttaccccaatgcagaaatgccttccaaagtctcccttacatgtaatcatccaacttctttatttgaatatttccaagaataggaagcttattaactcaaaaaacgctcattgtaattaacttgtttttgaagtataagattttatatatattatatgtatacatatcatgatggtgaatattcataaactgaatacatctatgtaagcaatatctaaactaagaaacagatattacaaggggtacagcagcccgccccaccccaccccaccccaccccacccagtccctgcccagagtaaacactatcctgacctaaatacatagattagttctgtctgtttttgaaatgtctataagtagaatcactcagtatatactctgttgtgtctgaatgttgtgtctcactcaacattatgtttataagatttactcattgttatacatggctgatattcattcactctcacaactgtatacttctactgtatgaatattcaaatttctttttacctaaggacccattgatgagcatttctgttttggcactattacaaaaagggctgtttgaacacttttgtacatcttttggttaacatgtgtacatatttctcctgcatgtatatctagaagtagaattactgggtcatgggatatgcattgtagatgccctcaaaatttttccaaagatgtttccatttatacacccactagcagaccatgagaacttccattgctctacatcgttgaccaacacatattttctgcctttttcattttagtcattctcgtcagtgtgtagtattatcacattttgacttaatttgcattagtataatgattgttgaagttaagttctttttcacacatatatatattgcaatttggatatcctcttatgtgaagtgtctgttcaagacttttactcacttttttattggattgtcttttgtctttatcttttttatttgcaggagttcttatgtaatctgaatgagtcatttgtcagatgtgtgtattaagaatatcttctcccactctgtgactgtcttttcattctcttaatggtatgttttgatgaacaaaagttcttagttttaatataaaccaatctctctctatatatatattttttatgtttgtgtcccgattaagaaatccttgtggcggggagcagtgtctcgtgcctgtaatctcagcactttgggaggccagggcaggcagataacaaggtccggagatcgagaccatcttggccaacatggtgaaaccccatctctagtaaaatacagaaaattagctgggyatggtggcgtgtgcctgtcttcccagctgcttgggaggctgaggcaggggaatcrcttgaacccgggaggcggaggttgcagggagctgaggtcacgccactgcactccagcctggcaacagagcaagaccccatctcaaaaaaaaaagaaagaaaagaaaaaaaagaaatccttgcctactccagggttacaaagatttttctgctatgttttcctctatttcctacctagttgccctgtttactatattctttttttctcataacttttctctgcattaatcaaacatccatttatttatttgtagtaacatgctaactacactttcttttactgttcttttagtgtttacctgaggaattgcaacatgcattcttgagttggttctatataattattacttttagtatcttcccagaattgctaaacctagaagttttaaacttcatttatcacttcttacttttgcaatggtattgatgtcacatattattctgtatgtattttaaatttcacaaagcatcactcttattgttcaatatagttcacattcatttgtataaaatgcatttacactctccagcattcttcaatcactcagatatttccaaggttctatttagggtcattcttctacttacaacaattccctttggtattccttttagtgcaggcctcatactgattaattctctgtttttgttttgtttttgtattttgggtttttttttttttttggtcagaaaatgtctttgtttcgatattttcaatagatatatttgtattagttacagaattgtaggtttgcagttatcttctctcaacactacatttcatttatcttctcacttcttttgttaagtcaattctcaatcttgtacttagagctctttaaagttttttttttgtttgtttctttgacttcatttaagatcttgttatctggttttcagcagttttactgaaatgtccctatgaatgtttttattgtatttatcctgcttcaattttgctaaacttcttgaacttgtgtgtggcggtctttccaaaattttagaaaattcttggccttaactcctcaaaaaatgcatctccccgtgtattctctcctctcctttgggacttcattttcacttatgtttaaaaaaattagcataacacaaataccatttacacaatatctaatttttccctttttctttctatgctttgagtattttttcagttcactaaacttgtattatactgtgcccaatttatcatatgtccctagcaaactcttaatttcagatagaggtaggactttgttttgtttcagttcaagaatatgtgtttgattattatttttattaattatttttttgagacacagtctcattctgttgctcaggttggagtgctgtgcacgatctcagcgcactgcaatctctgcctcccaggttcacktgattctcatgcttcagcctcttgagtagctgggattacagacatgcaccaccaagcccagctaattttttgtatttttagtagagatggctttttgctatgttggtcaggctggtctcgaactgctggcctcaagtgatccttccaccttagcctcccaaagtgctgggattataggcataagccaccatgcccaacctgtttgattattttctatgtgtcccacttctctwatcgaattttcttttccttcactttttttagtccaccttttaagtccttgccagttacctgtaatatctggatcatctatgtatctgcttcaaatgtatactttttcttttgattatttgtcatgtagtttcacctatttgtatgtctacgtactcttttattgtatgatagaaattagttaaagaagaactacagaattccaaacgatatcttccaccagagcaggtttctcactttcgatattaagcagaagagacagaggctggacgtctcaagccaaccaaggactcagctgggttggggctagattgcagttttagtggaatgtagtcttccccttgtttatctatacttgtaagccatgacacttcctggattttgattgaaagcctggtatatctttatcttctgggccctgaaaaagttctctttcagaagttttcagctcatttctttatcttagggccctaacagctacaaaatttggtaaatatcttcaaaaagagttcaatggtatgtttgagtttggtgtctccaggctgccaagtccttttgtttgtttatttcctactaaaattctactgccttttggaagctctgccttttagaagcttttagcctagcctttggcttcctatgcagcctcaaaacacagcaaacatcccttggagaaagatgtgtgttttagatccctcaagtctccagtttgtcccagccttgcagtatcactaaaagttttgctaacttttcttactccccaaagacaccttccgcctaggcccagtccagtcctcagaccacactcagaataagcaaatgccctcagggaaataaatacatgcatgccttggaataattttcccttctgaaattttagttcttttagtccttgttgcttccacagctctaggaactatatctaatttatttggtttgtacagaaaaactggtcctatgacctacttgaaaatcaaagctattacattttaatagctctgattagtttttaaaactctaytgacacaaaattgactctcccatattttccattaattggctaaattttgaaacctggaacagtattttaccttcaaccatattgctttttttcatctatttaagattatctcccttaaatatgtttttccttcagtctaaatatcaccaaattctaaacttctattttatgtttaaatcctttgccatcctgatcatcatcttcagtaaaaactctcgtttgtcaacatccctcttaaacaagtatcaacaaaaatcctagatgctatgattaagcccaataaagagaaaaaatgagagagtcatattaaaaaaacagagatacaaaataaagaggaaaaaaacgagagaatcacacacaaaaaataatagagatacaaaagaagttatctagtgaggtgtttttaaaagcacatgaacaaaagatcaaaaaaaatcaaagacagataaacaaaatagagatcaaaaaaatgaaatgaaagcttccaaaattctcatgaaaaatgctaagcataatgaaaagaacattttgatcctttctaagtctttgtttcacaattacctgaattcattctcacaattcaatcacattttactgatgagttaacttggaaaatgttaagtaacttttgaccaataacaaaatgtaactaatagcagagtttctaggtttggatacagatatttatttcgcacagctacactcagatctactgaattatcaaaataatgccaagtagccattttaactcttttttttttttttttttttttgagacagagtctggctctgtctccaggctggagtgcagtggcgccatcttggctcattacaacctcctcccgagttgaagagatcctccttcctcmgcctcccaagtagctgggactataggcacgtgccaccatgaccagctaatttttgtacttttaatagaaacggggtttcaccatttggccaggatggtcttgatctctcgacctcatgatctgcccgccttggccccccaaagtgctgagattacaggcatgagccaccgtgcccagctgccactttaactctttttttttttttttttttttttgagacggagtctcgctctgtcgcccaggctgaagtgcagtggcacgatctcggctcactgcaagctccrcctcccgggttcacgccattctcctgcctcagcctcccgagtagctgggactacaggcgcccaccaccacgcccggctaattttctgtatttttagtagagatggggtttcaccatgttagccaggatggtctcgatctcctgaccttgtaatccacccacctcgggytcccaaagtgctgggattacaggcgtgagccaccgcgcccaacccactttaactcttttcatacaaatttatctagagaaaatgtccttctaagaatagacatttctattattcaaagagaaatctgtgtagattctgtcttatgccagctaaagacatgtatataaaaccacaaaatacattcttaatattatgaacataacataatttatttatgtatgtatgtatattatgaattataattcatttatgtatgaaaagcacacatttgagaatcaagctacctattaaaatggtctatatttaacacacagacatcatgctgaaaatgggtagctctctacctcccttttgcatattaagcaatatctgtgtaattgattctctctcttttggtacttaaagatgcatttggcacttgagaaagctatcttcagcttctaacagtaagtttgtttcctagagctgtttggtacctgaacaattcagatacatttgtagttactaaggctcagagaagagggatacaaatttggttgttttgtgttgcttctaaggatttctgcacacacacacacacacactcacacactactatttaaaatgctcttaactgaacaattttaaagaaaaatataatggtcagaaatcttaaattaaaaaaaaatcaaagcctactttatccataagtaggtaaagcaatggttacatttaaaactgtattaacaagaacaagtatttcattccaccattaggaaaagagttaccctgagagagatgccagttttacttaaattcattgtaagaggtaaatgagagcagagttgacttgggtctgggcacaagtaggacacctgccactattaagatggaaaagagataagaaaggtgaagttggaaatacttaagattctccaacgtcacgagactacatacttgcagttctgccaatgtttaacattttctcaaagtaagatatagacaaagtgctccagtctaggaaatcagatgggcccaacctaccactaggaggaaaaggaagctatgacattctgaagtttggcacctcgtaagtgcccactactattaattgcattgaatatgaactgaactgtgggttcactaaaagcatacttctggagttaggaggccttggcaaatgaggctaaaaattaactcacacattcaaagccatctatttttaaaatgcatgataagcaacacaggaagcttttataactagccagcaaaatctgagctttcaatcaacaatttctttcaacgaaggtgtggagcatggaaagaatccagaagcacagatggtattttacatctgcacatgcaatttcctttttctccatttttatataaacctctctctttttttaagaatgatagaatttaccagtaaaakgcagaactacttaattgcctctagaaatgttcacacctccatttcacatttttagcagcaatttaactgcctttaagtatatgtagaaagatgggagggtggaccttttaagctcccctgtattacaaagtgaataatttcagaagattcaattcctccagagagctacaatttttccagcacttaaaataactgcactccaccatccttatctctaactattttcctaggattaatgctaacttttcactggatcttaaggctaaaatgaacttcagagatcatgttacttcagtcctctcctcaaaatatgagtaatcatgatccagtagggctggcagcttgttcaaggtcactttgctgcatagcacaggggaaaggagcaaagtccacctgcatcataatccacaatcacagagacaaatgtaggaagaccaatacatagctgtgtctccaagaayctatttccaggactccatcagaatgccaagcccttcttcttataaagtaagtcagattcatttgagmacatagagaagcctgacttttaaaatctaaaagcgtttctttaaaaattgaatacaaataacaggtttcactgtcatattacattcaaaccaaagataaataaggcatgaaaataatattggatagaatgaaattccaggtaaccaaacatggtacaggggactgaatttgtacatttaggtaacggggaaaataaaaatactacaacataaactaagagaaactttcaaaagcaatgttcaacttacctttagaaaaatgctctactgaaataaaatcaattgacatatcctctgtttttcatactaattcctctggcccaaacctctctcttgagctctagaattgaacaaagtacctccatgacatctccattggactatgtcaaaatctcctcgtctttatcacgtctaacaccacactcaccgccaaagcaacttgcattgtctcttgtttcaggcaacgcccccaacatgaagatatttgtgcatccagaaatctaaacattcctctgagacctcctaatcccttcagcaaatcctgaccctctacctcaatcactcctgaaacctgctaaatttcctccatctctgtggccactccctgcatccacactgccatcttgcttctctcatggatcttccagtagcctttgaacagctttgcacatgttcgctctggacctttgttgtccctcctctccagaatgaacttttgtcaatgcaaaccagttcttatcactctcgtgcttaaatccttcattggcttccactggctttatgataaagtctaaatccttcaaaatccctaaaaatttataaaatggtccacaaggaactagtggccctgatggctttttgagtcccacctgacccagtccctttgccccactcccccatcctgccatatccctgtagtctccagtccaaccattctggaccctctgtcccctgcctgcctctcatcctttgcacaatgttaccttggcttgaagcatgcttcctcccactttctacttgattcattcatctcaactcttgtgaaactttcttaggaaaatcttctatgatgcaactccctgaaagactggttccctgtatttttcctctgtaaccaacatcaaaatttgtaatcttatatttgtataactattgtttaatgtgtatccccttatgataatatctatttctatttattcgctcatctcactagcacctaagacagtaggtggcatattatacatactcaatgatcatttattaaatgaatgaattaataaagagagaaaattactaataagagacaaaattaataaagaaaagatagaaatctttttatctagatttctagattaacagaggaggaagggaaggggacagagagagaatataagtgatttacaacacaaatctcaccaacagcttagaaagttcaattttatgtgtaactatctgttactttggataattctgagctagtaggatacatcctaactagaccacagaccagggtcatacttggaccaagtcaatcccagttacccaaacttcagtcagcttaacagctctctctcaggagtaataacctctaacaaaggtattctgaaagtctccaaataaaagaacaccacttttaggttctttgcttgatctcagtaaacatcctcaaatgggcatgaagagtgatcttcccccaattcaagttctggaaagacttaatgtgtacttccaagactgtaccactatagtgcctactaactggccaaggtacagtgtcaaaagccctaaagcacaattgctctaaagtttatgtgtgtgaatatttgttctgtaaggaaatgagaaagaaaatgatcagaaagaaaaatatttgagagagggaccaacaaaatgttactccccttaaattatttaggaaaacaaagtcaaggcaattattatgatttataaatttttttctgatacctttttttttattattattatttgagaaggagtctcgctctgtcgcccaggctggagtgcagtggtgcaatctcggctcactgcaacctccgccccctgggttcaagcaattctcctgcctcagcctcccaagtagctgggattacaggcacccaccaccacacctggctaattctttgtatttttagtagacatggggtttcaccatgttagccaggatggtctcaatctcctgaccttgtgatctgcccacctcggccccccaacgtgctgagattacagatgtgagccaccgcacccggccctctgatgtcttcttaacatcacaattctcaaacttcagagcaaggttagcaggacacttgtaattttgacaatgcaaaagcagagagagacagaatatgccaatgcaatgcagtagaccacttcatttgattatgtgacttagaacactggcataatttggctcccattaagagttttctgaagtttggatacaatttctaagacactcttaatccacttcaactagaatgtacactatgaatttcaagccaccaataattcataatatctgggaggaccaggaataatccatatttataagtttcagagacaagatttgcattccccttttggtttctctgatgttctgctggctgtattttttgtgtggggatgtatgcaaggttaacttatgagcacacgctgtgcacaagaaactctgtgttatagaacaaggggaagagtcctaggaatttaagaaactatcataaatacagacatcatggccatgtaagccatggcttggcttgctgccagttctctgccacagttgcagaaggaacacagcgatagggcagttcctagatataatatctaacagatgagcaatctacataaaacatttatttctaagtttagaaaaccccaataaagccaataaattcgcaaatatctcccgaggatcagaggaaacaatagaaaaggcaaagtattacaattaagcatctgtgttataattaggaagataaaacataacaataagatagtcacagcccagcgcggtggctcatgcctgtaatcccagcatgttgggaggccaaggtgggcagatcacaaggtcaggagttcaagaccagcctggccaatatagtgaaaccccatctctactaaaaatacaaaaactagccaggcgtggtggcgggcacctgtaatcccagctgctcaggaggctgaggcaggagaatctcttgaacccgggaggcggatgttgcagtgagctgagattgcaccactgaactccagcctgggtggcacagcgagactccatctcaaaaaaacaaaacacacacacacacacacacacacacacacacacacacacacacacacacaaagatagtcactaacacacagcagcatgtaagaagtgtcaagagaggagtaaaataaaaaattgctgtagttagaggagggtggttgtacaaggttttggttttgttttgttttctccaaagtcttcctacagcatgcagaatttaacctgcctcttgctgggatccaaagaggcagggagggcatggcaagaagaaccagaaggggtgacagccccaagtgcttgyatttcgttaaaaaattccctcttctcaagaaagaaaattattccttttacgtgagctactggattgttttgcaggctagagccattttctgctggattgggttttgaaatggtatttttccatttattttacagtatcttatgggggtggaaagagaagtatcagcaggttaatttctacctttcacagagaatctgctgtttacaatgtaagacaaaactaccgaagtatgggacacaattagggaagtcaggaacacatttaaataaactgatgttaatgaaaaaactgaattctgcatataattcccacttagaatgttaggtcccagcatcgcaatacatctactgacatgagatttttttttctcctcagagaggaaatttatrttttattatttatcattcctatgcttaagcttgcttattggatttattcaataggcatcatcttcatcatcttatagatgtgcatagaaaaggtgaagtaacggccgggcatggtggctcacgcctgtaatcccagcactttgggaggctgaggcgggcggatcacgaggtcaggagatcgagaccatcctggctaacacagtgaaaccccatctctactaaaaatacaaaaaattagcccggcgtggtggcgggcgcctgtggtcccagctactcgggaggctgaggcaggagaatggcgtgaacccgggaggcggagcttgcagtgagcccagatctggccactgcactccagcctgggcgagagagcgagactctgtctgaaaaaaaacaaaaaaacaacaaaaaaaaaaacaaagaagaggtgaagtaacttacctaaagctaaacaataaatcagcatcctatattagaatcctcagtcccttatatttaccctagttggatatttggcacttaaactatgatgctttccagtaataagccaacaattttaataatgtctaaatgtttctctctccttcagttctgacagacagagcttatacatttttgagcacatcaatttgattgcatctcaaatacagattaatgtggaaacagtaataattattggagaaatgactgttggcagggcatttaaaatgcttaattctctaagctcatttcaggtatatactgaacagtgatatgagagtgacaagcagtgaaatatgtagaaaaagaaaggacatgaggagtttttcaatcaatcagtagtaatacaatcatctctttcacttattgagaacttactatttcaggaaacacaaatatattttctctagcactaacaacaaaactgtaagatgcagattattatatccatttaacagtgccaatattgtggctcagagaggttaattaacttgcccaaggtcaccaatctaataaatgatataaattgacccattgtttccaaccctattgatagtatctgacttcaggctctcatcatctctcgcctaccattttgctatgcctgtattctcatatgtatacctgtcactgttgctccatatacattctttgctcctgccattttgagtagttctagtctcctggaccagctatgctgtctcatgcctctgcacttctgcctagaacagtcttcctacttttctctgaatgagttccttgtcttccttcaagactcagctcaagagtctcccctctgaggtctttcctgatcctagcccagcagaggtgatcatgccctcctctggagccagtatatagccctgtttattcactagtttactcactagttatgtttatatgcatggatccctattaaagacttagagctccttgaaaacagtattcatgttttatctttgaattaccagcacataacacagttcctgaaacttaatgttcacaaaataggagtacctaggctacctttgttagaagtttaagctggacccaaagttgattgcagattgcagtcagcattctcaagaaccaattttctttcaatgctatagagaggattttttaaaattaaaaaacagagaatttttatattacattttaattaaaaattggatctgctactccttcatttgctgttcatttcccctgttacatttattaattatcaaatatattagttggttttaaccgctgcttgctcccttgtagtccatctgtgctttcttctcaataatgcattgaagtcataagtgctagatttattgccttggtgattttcatggcacaaattgcgatttcgctagcactgagcagaaggaagagctaataggcaaggcagaaaatgcctaatcaatatcactcctggcataagtttaaaaccctaaacccccaagcagattttgcaaagggctatacttaaggccataatctctagaaatgcatttactatagtaagaagttgagaatcactttctttcctaccaaattctcaattacttcacaagcctcctaggaaagcactaaggtctttgaataamtcagctggcccgcaggagaaaaaaggaaaccgtgcaggaattagataggaatatgttatttccaagaagggccctttctcctaaagatacatccttttttctaaagataaaataaagtacttctacatcagcatagagaagaggatttctgaatatgagtgttaaaagacatcctaaggattagatatcagtcatgaaactgattggaggcatgttctaaactgggtagtctgggggatggaccacaatattatgagtcaagcaactaaccagattttgttgactagaagccacccacctcctatattaactacatcaatgaaattaagtgctcatgaggcattaactggattgctgaaccagacaggcatttctgctatagtcatgagttctaccagaagccacctgtgtgttctcacaaaaaagcaggtgttcacctaagggtcaggagaggcaagtgtgatcaggggaccagtaagcatcctggtataaagaccttcattactcagccttttaaactttgaatccctttaaatatccataggtctacctaatttgagaaaaaaaaaaacttcctttattcgaaaccacattgctaatgtcctcaagtaaaaagaaagtgtctaaagtgcaggcttagcaccataacacaaatataagccaaatagctgccttttcatttaatacactatgaagaccaagcaatcaatataatgattaggaaacagttccaatcagttattcaatgttctttcttggggctaccatctaggaaatttgtctcagtgcaaaaaaaaaaagtatagtcctatcttcctggccacccccactaaagcagaataacctgatcccactgtgttatgtttcgttgtctacctcaacacatttcaacaatgtgctaattttaactacatttgagttatatgtgaattgtttttattttttagaatttgtacattttaattttccttgagaagaagctaagaattattcagatactagacagtgatagcagtttcacaataagaacttgtgcatgtattaagcaaccatgtggctttccctctaccctatcaataatacatatatgtctcagtttcatgtcccttaataaataattaagaaatcactaaaataaacagccaaggcattcaaaatacattmgttctccccatagacattgggatggttcccattacatactttttaagagtctgatttacttgcaaaagctacacatattttattaaaatgtaagtaatcaaagcaaaatttaaaagcacatgaaaagaataaaaataaagataagaaaaatctaatcagttctctattaggaagggagagggacacagtcaattcagctagaaatataatggtttccaaggtcaatgccagttcaaggaagaggttcgttgctttgcaacacttttcagggagaaggtaggatcaggagctccagtgtttccttataaacaagcacaaaatatgatatattaaaacacctatatttataactaatctcaaattcacttatcacttttaacttggtattcatatattcagaataataatagaagctcagagatttaagcaatctatcctcatatgtattgttccttgagttatcctcaaatggttggcaaaaatctacacctggagtgagaattccacaaatacttacagagaaggaaaaataataggaagaaaataccaaagatgctcctgttgggcaacagtcactaaccatgaccaagttaaaaatttttatattatctaattgactatcacaacatcatgaatacattttaaagctaaatctgaagtggagaaccaaatattaaaatatatattaatttaaatattgtttataattctactctaaatttcattcacagcagaacaccctcagccatgagaaaaaatcattttcaccctttagattagaaaatttcctgatcctacattagatttccttaaccatatatttttacaagattcatgatcagtcctgcctttccaatcttactacttgggtaacagatactttgataacttttataatggacacttaaataacagagtaaatagaatgagaaataataaattattgctattactcataaaagcataagattaagctttttcatagagaaggctgtatcgcataaaaaatctgcctagactacgtttataaattaaggttcatcctttccttcattgctgattttatatcattcaggttatagattagcagtataaatgataggatctaataataagaaaaccagtttaaaataattacatgaaactccttcatattatgttatatttgtgccttgtatgttataaatatcaagacatgtcaaaggagttaaaacatattctctaagtagggtatcctaatgatactgaagatcttaaccttgagcttcaaatttgctgtccaaatatggtctgaattatttttaatttttaattgcattcaatatctactttgaactgtgagtgaaaagcaaataattacattgttaatgagacaagatacactatcaagaataacacctcacattttttatgtagtttattttttaacttgttttgatcaaagccatagttgaaagaaaattgtctacatatatatgtggctgatcacataatagtaatcaaaaatatgactagtcttcttgtttattatttataagaaacaaaagaaatactacatcctatgaaataaagtaagaaaaaatgaaccctaatttgtaaatgctagatgcaactgtgaaaaaaaaaatgagagggactaaaagtaaaaaacataggtaagacactgagaagagctattcaccacatcaccctccaatattacctccaatcagtcaacgttagtcaccctcatataatctatgtgtgctcataaaatttagaagttgatctttattaaaatatcaacaagaagtattttattgcataagagctgtattgtcagacttacttttaaagtttatgtttgtgtcatataaaaatttgaaataatgagttagtttacctttacatattagctcatcccttattatgatattttcattacaaatgtaaatacatagacttggttataatctattcagttccctgccaatctttccactctcaagaattttcaaacttttactaatacgcaagcctgcacaaaccctgagaagtctttattctctattgaatttacaatctagagagatagattatgttaatatcaatgaaataacagcaatatataaataagaccaacctggccagcttaaacatgacgttatctatataaagcctcatagcaacagcagaagatcttkccctccactctcatcatatcctacacataattccaccctaggaacatggtgtttaaaatggcttgcttgtaaaatcagggaattggtttcattcacccaagatctctaggatattcaataatgatggatggatatgatatggacagatgaatgagtggatagatggatagataaatggatgaaggggtggaagaaacagtatattttttttcatacttatgtggatataaatataaattttgaagaaattcatagcaakacctcatccctataaaatgaaactcatctgaaggattttctttaaaaaaygttacttgaactaaaacaggtgcaagatttttatgcaacctggcagatgcatacagaatatcacttcatttagttgggacagaatatcacttcatttagttgggagataatctcaaccaaagtctcaattaatttagtaatgaagttgaagagaaattcaatgcttatcagtaagtaatcatatcatttgaaagcctgtttggatgtcagctgcttgggttcagcaaatcctgaaatgctcctctgcaatatccaagtcctgccaaagcaggacaaactatttttagatsaggcatgtcaaaaacgtagtctgttttataaagaatgtgaagactacatcaatatagtaaggaagaaaatgccagttggaaagcaagtgggctattagaagtcatgagacacacacacaaacataaatgccaatgttcagggaaatcatatatagagcctctctgtgagaccaaaataccctatcagtcatagatatggagagttctttccaccagttgcttctataacaattccaaacactagtatctgttatgtttgtttgctttataatttttaatataatgtaattttcattctgccatacttatataaacctagaccaaaaacattaactgatgtagtgttattataagaccctccagtggactgttgtgactacaatttccaaggggattaaaaaaaggaaaagaagaatgagatgttttcatactgattagcaactgcacctcattgcaccacagtatgaagaaacggatttggaaacacagcaccaagattagagaggcttttgagccatagtttcaatttaggtctcatcactttacctggcaatagtaccaatttagcaggcactgggctgtgcagaaagatttacatgtaaatgaacacactttggggcattttgctttgcctcagttaaagagaaacatcacttttcattggcactacaaaaataaaacagaggttaacacagaagggtccagggaagagtccattagtggaaaagctaatttggcagctgcatcaaactcctggagatcatgagcagtgcttctaggaagcactaaagagtttgaaaaacacagatattgtggaagttattagatgataaagtgtacacataacattttgcaatttatagggggaaaatcaccaaattaagggatgattatcttatttttaatattcttttaaaaagttttatacatttagatacacaattcataccttctctaatataaatatattaaaataagtttaaaataaaataaagttttaaataaaaataataaaggatttttaaatagttaaaatcaaataaaaaataaagtggatctcaaacatcataatgcagtgccatgtgcctcatcattagtgtggatttctgctcactcattttagccctctacctctaagctaatgtcataatggcctggatccttacataattcgattttaatagattatctcagtcatatagttcctataaagcccagtcaccgggggatggaggtttgtgatttcttctcagactatattaactaacccttactcttttctttcattcattcaagtattcattcattcaataaatacacatatagtgcttaataagtataaggaatcatgtgagacaatataaggcatggagaaatatgattagtcatagattcttgtgctcaaaaaggttatggtctaatatgagataaaagatctgtgcaaataaagacataatctaaaaacagacatataataatatcatgtggaaataccatgataatttaaagagaaagaaagcaagaacaagagtgagagagtaagtgagtgagwgaatgagtgaaaaattgagagatgccaaatggggagataagaaatgcttttcctacatggaatcctctgtcttctgcttgctaggcatgtattggaatggcttatgttccatccagaacccttcaggacaagaacttggcatatggcccagagaaggcattcagcaaaccttcactgaaggaatgagtgaataaattaacgaatgaatatttctctttggttttgtagacattagcatgtgaatttataaaaacaatgcatatagccaatccatatttattttttcttgcaaaactgaaacaaaatgcttcataaaacacaaaatatattcaaaagtggccacatcatttaaatagttaagattttttattgcaaagataaamggtgcctgcattacataagactctccctgttacttagatggactaggggcattactgaaagacaaatttgcaagacacccataaagctaccaaaattcagaatgttttttccttactctaaatgcattttgatgcaaggagaactgtgacctttcaaatagaactcttaagtttttttcactttatattttaactttgcaggatttcactataatgaagtttttgcacaaataccactaaaagaattattattatgttcctgcaaaaaatattttgtctctcattattctcgttacagacacttgaaaatctgcaaatttatattgagttcctgccttattatcctatactgtcagccctccatatccataggttctacatccataaactcaactaactgcaaattgaaaatatacaagagaaaaacaaacaataaaaaataacaatacaattaaaattaatacgaatagaacaatacagtataatgactacttagatagaatatacattgtattaggtattatgagtaatctacaggtgattttaaatatatgggaggatgtgtgtggattaaatgtaagtactacacaccattttatataagggacttacataaacctaagggaccccccataggttttgctatcgggagtcctagagccaatcccccatggatactgagggaggactgtacttgtgacctcagaatagtaactgttactttagttggcaatttagctcttaagaaaatataaaaattaagtaccagggcctggattacatttaagaattataaaggttattttcaaatgttaggtgtttaaatttaaagatagacaacataaattcaggctcttaattatgtgcttcttgaaagtgctttcttaaaaaataatttactagtagaatcaagataattaaaattaatgatccaacagcctgttgtactcacaccaattaaccattggaatactaaagagttctaggagatagattgctcttcgaacaaataaatcagtttcaaagtaaagtatattatctctgtgggggagtctataaagtaaatattgaatcacttctcagcaatatggactcttgccaataaatctcaaaaacaacattattttcaaagaaaaaagatggctacctcatttggcacacataaaggatgaatgatatagttagtcgaatcagccaatcagagtatacatatgtgtatatacatatgtgtgtgtgtgtgtgtgtgtgtgtgtgtgtgtgtgtgacagaaacacatatactgtatttgtctcctaggccccccatccattgccttcctttactatcttgcaccatttgtccatccctttcacaagcctataattttgccagagagcagaaattgtgtcttcatcatgtttgttctccatttcccagtcctgtacttctgcagcacctgcctagctatgttttacataaagaaaaaattcaagacaagtatagtctcatatgaaacaaaataatcaaactacagattaattcaagtttctttttgcacattttgttaaaaagaaaagctaacatattttaactggaaaatatctgccaatttctaagtcaacacagggatctaactttaaaaaccccaaaggtcttcctgaacatttttacacatatatgtatccaggagtatacttaaggttcctgtccccatcttgagtgttttcgagattggactcttctttctatgccttgtattggtcaatatgtgtgtagtaagaagcagagaactctgattttgagctgtcactatcttacccacatcttaaatccatcataaactacgtttctttcctgaagacccaatgtgcaaagaagcatcataaaactacagtataaacataggaaatcttaatgttcacactaatggaaataagagctaaatgttgagaattagtgttacagagaatcagatgcctatattgtgttcacctctctaggttctaaggccagtaagaattagatagagtgatagataagcaacaaaatgtagtggttaagaaggcaggcaaccacttaggcaactcactagacgagtgattttatacaaattatttaaactatctaagtcttccttttctcaactgttagtcttagaaggcttaaaataggcaacctctgtccagcatgtggtatagtacctgtgctacatagtaaatgcttaatgaatgaaaataatgaagagaatattagagacgtgtccaggccacgcatcaactgacagacgcaacaaatgcccacagcttcttcaggtggctaggcagagtaacagctgcagaaatcctaaagaaactaaggtagaacctgcggtaacatctaggccgtccctgacactttgccagggacccaagctgcagtgtgataattgcttacactatttatctcatatagcacttatattttatcaactgccttaacacttagaaaccaaaatagtgattagtgacaaaattttcaagctgggagtcaagccggtagaaaggtattttcaatcaagagtttcttaatattactcaaataataccaaagggacagctttctattttgactctaagtaaaactaccagcctgtatataaaggtcaagcttcataggacaaaataaatgttgctagccaatctccaaacacacatcaaattgcgcataccttagcaaaacccaaagctagttatgaaaatcagcttatataaatgaaacagatagtagaggcatcaaaatgaaaaagaataaagtcatcatcaagtgtattttttagaaattaaaacatttctttaagtaaattgagaayttaaagacagtgtgatacatacacaaacatacatgcataaatatatacaygtatatatttaaggaatatatgtaaataatatatttaaggatgccaatttcccagaataaagtatactttaaatcccacttctttccaaagacaaagaataatgcttcagacatgaccaccccccaaaaaaaggaaaacaaaagaagaaagtatttactattttctacatattgcttacatttaaattaaaaatatagctaatttcctccaggataaatttataaatgcccagttttattggcaattctacagattagggagaccagtcatagtcactaaggtgaaaaaggtaatgatactttgagccgagatagtggtaacagagatgagagatgtgtgtgcctgtcattgatgtcaagaaagtaactggcaaatcatgggacatttggaacaagagacagggagtcaaagtagatgggcaacaagtagattaagctgacttaatctaataagtattccctagaacaaaatagggaccaaggaagaggaaccagtttgtattcagagataatgagctcagtttgaaacaaatttaaagacaaattagagaaatatcattaactagaagaagactgaaatgcctatttcttattttatatgttagtaggtagaaataaactcaactgaaaaccccttaagtttagtagatgaaaaataaaagtaagaaaatacgcctctgaatttcaagataaaatgcagaaaaacatttcgatagtgacaaaggactacatctaaaaaactgaatttcttcattaagaagtctgtttctttcactgtatgcagatgatcaaaaatgatatttacaaaaaccctaaactatcatcttttcaacaacctagagagttagaaaacttactagataacattcagccttacaaaaatgggaagatttcccctgtgatatatgaggagagcatgagaattctctcaatgagtagagatatttatacatactaaaatctctattcagacataacacttaccaagcaaactagagagagaattctagagaaggaaaacatggcctttttgttattccttcacaaaagaagactgtcattttctgttcttcagagtattttgtactttaaaaataaccttttctatccaacagaagagattcttgagtgaccttaaccaaattatgagaaattcatatgaatgttcatatatatacaaagatatttgtacaaatatacctagatattacttatatagttaatatgtggtaaaaattattatttttacttaatcacaacttagaaactttaaaaaactattcttatcctttataatcacaaactcaaatattacatatgaatgggaaaaagaccattagtaattagttatttttaaccatcyaactttgtactttttatgtgaaaggtacatagcattgatgttgatacgagacastgatatgagacttggcacatcactggaaaattactgctagggcaaatatcattgatgtcaagacactactagtgtagcagaatcgaaattattcctaagggaatttcctaaataatgggtcagctactactactcattattacaatagcatataacgattttcttagctaagagtatacatgataatgctttctagagagtaagtttttatacccctgaatctccacaattcatagccttaagaagaattacctttcttggaaaacggtgatttagaggattaaaagaaaccagaagtaatgataaacaggagtttagcagggtaaattcatggagagaaacttaattctcagaaagatatgacaagaagattctatggacactttaaattagagccttccaacaaaagatctggagaagcaaatgccttattagatttaaatttcctattgcccttccctgagcctattccaactagctagttcagacacttagggtaactgtttattttatgaaataatgtatttgggtaacgttcaggtaggttgactaagtcatttattgtcaaaatgggacgataagcataaattgggactgtactgttgaacaccctaatctcaggagagaccatgttaataaaaattaggtaaaaatggagaaatagagagaggttactgtgaaaaaaagaaaagaataaaaggacccaaagtcacttgatggttatgtgaagagaatggaatttattgtgagttggtgacaggaagggatctacaaggttgagtcaaacagatttgtttttttaatgccagctggtagcctctccattactacccagcgaccagtcattttttggtgcaaggacataccctcccaacaaaactgaaactcccccccaacaaaagattgctgaattcacagtcgttgcccaaacctctgcatcaggtatttaccctggtgtgaaaaataccatatgcagattttaatttcttatcattttagatttagtttatttgaaacataaataggtttcatcctagtcacactcctttttcaaattatggcactaacacaaattgtcatttgccatattctcaaacaactgactataatttgaaagggacggataatctcttcatggaagaaccaaagaatacctcttaaggcaataccgtgatgtcaggcagcaggtagtgcactgctacttgagcagaaaatgtgttgcacactcagcatctgacttcctactcgaattaacttatgtaaaaatctaataccctaagctgagaaagtaatcaacatatgatgttgatatagagaagaaaagatattacaaacaatatatgtaatatttttcatgaggaagacttgctctgacaaagaataattttctcattataaataattagaagcaaaaatatccctcccttacaaatttagataatagagactatttttatttttattacatttaggaatcattgggttcctaaatggatatcctacatggatattctaacgaaataagtatttccagatagcatagccttttaatgtcatctcattaaacagtgaactaggtcttttaaattgaagtaaaatttattttcattctacatattttaaaatacatgatagcaattgtatttaatgtaaacatctagtaaattattatttatagtaattgggggaacagtgtataattaaaaagaaaattactggccatattctatacctaaatcacttggtccttccactgatatttaggttcttcatattgtcaagcatggtgcctcatatatcacacagtttcaataatttttatccatctgattagccacaaaagaataaacataccttgtactacatctgtatacaatacttataaattaaaaattgaggaagaaatgacttaaatttaaccaaatattttatatattaaaaaattatcttacttgacattccaataaaattgtcagtgcaaaatattcataattcaacaaagacttacctgaacacaatttgaaaaatttatgagtaaatgtacacacatgtgcatacatataccatatcatgtatatatccataggtatgtatactatatttacatgaatcttatatagatgtcatgagtatgtaaaagtggtccaaaactgatgtatcaccaaaatttgcattttccatacctgatttaaatgattttgaaactataagtaattggctttaagtttatacatatatgtgtatatacatatatgtttatatattatatatgtatctgtatgtgtgtacccctatatatacacatgggtatatatccaatgctaactctcttaaattttcaaaatcatttaggtcaacctgggaaaaatctactgtgatgctgtattcagatatggctagctgttacattctacttactgatacatcttactatgttattttattgttaataagatagaatcaactttaaaatgcactctcaattacatggaaatgatatatgttaaacattcacgttgcttataagttccatcctaatttcagaaataataaaatgtgaaaaaatgtggatttatatttaaacagtataatcatggcataaagtatttcaaaataagacatatccaacagtaagaaactcactaaagaaaataatatgtgggatttttaaaacagatcatcagagctaactatttaattgataatggttcaaattaggacttgcactctgcataccagtcagtagccttgatacattaaatcaagcaggaaattgtgtgtgcacacacacacacagaataaatgtatcatggtttattatttttcataaatcatcaccatagaaattacaaattattcacagtagagttaattctaagtaagccagaaatgattctgcatatatgaggcataagtttccatgacgaataaggacaagtatataaaatcctacagatatatgacccataacacattacagagcactgatttcccagaggataatgtaaaactcrtgtacccagtaacagttctatttttgttctcttctataactcaaatctattcatgctgcacatttacttttacataaaaatgtattttagttatctgggctatttcatctgtgacaacaagattcttatttattttaaatggaagtatcctattttattcttaagcattttctttacgatctttcagtcgccttgaccattttttaaagtatgtgatatctttcattcacgcatcagataacttcatgttttaaatcttaaaaatccacataaataggaagagttactctggaattttcatttaataagctggattacatttctctaagaactaagctatatatattttatatgccgaaatattcatattataagcaaataatcttaaaagaagtgattagttttattttttatttttttgattacttttattaaagagataaaaggtaatatttgctccaggaattttcactgaagtagaaatacatgtaagtagaactgtagggatggaaacagaagtggcaaagacggttctaatgcatggagagaaggggaaagaatgtaaagatgcagttaataaaaaaataatacctaggccttctatttttcttagctttggactctaatctcagctaagatcagaaaggaatttagtctgatgtgctcaaacaaatatacattctatctgttcaccaaacaagaatggcagaagcttttatcctccagagaattcaacagcatgaattagtaattaggatattaaaccaagatcaggactgaaggttcctgaaatctgcctactttttaggacaagtttttatcttattgaaaacgaaatgggaaatatctctagactttgatatctgattatatttcaggctcccctttgtctgtaactgtgtttcccttctcaccatggtcatgcttgctttttccctcacctttagaacttgctttctttagttggcaagggagtcccttcctcatgtatactactggttccttcaaactagcatcatcctttgatgctttttggactttcataggaaccatagatttttcctgggaatgctctatgctcatctaaattttagatatatggaccaaactacagacattaatattttaaggaatctttatgataaaataaatattaagaagtcatgggtaagaatagccagaatggcttgtctagataattctcttctgcaatggttatcgaagtgtggtgtgtggattaatagtccagcatcatataggaacttgtaagacatgtggattccaggacctataccagacctactggatgaaaaacttgggtggcagggggttgactasttaaagaagtgggtggtgatttttgtgaatgctaaagtttgagaatcactcttgttctattgtatcctaaccaaataataggataattaacactaataataataataatagtgtttatcagttctaaaaacacaattattttcccagttagcgaaagcaattttctgactgttccaataaatcttttatcattttcagaaccatgtaggctactacttatccraatcttctagtaaagaattaagcagtttcatcccaggatttaaaactgttgcactgatctcaccatatrggaatagggggcattagcgggataatatagggacacctgggccacagggccacagatataaccatggaggttagtcaggtcagcacttcagtctctaaatctttcccctaaagttgtccatatttttataactgacttttctcatgtcatttttccccagatacctttatcaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaatccaagattgattcatgaaataaagaagacatgaattgttttaagtctacactttgtaattagctaagttgtgcagtattttttgacttaaacagagtatgaccctgaaaaataaaagaatctttttttttcaaaactcatcctacctacctgtaaaaactgtacaaagctaatgtatttttcatattgtaaagtttcaattgtagaaacaactggtatgtacagtaccataatttaattacattttactttaaaaactttacacatttcagtttctaaaattttaaattaacaaaaattatttcttgtgttattcagagttactcagttttgtaaggactgttttgttactgcttttgtgcccagaaaccttgactctaaaattctgtgctgtgcgaaacatgcacgatttttattatgcttactgcgtagaattttatctacttgttccagaaataatacattaaccaaaaaggatttaattgttcagacttgtaagaggttcttcaattacataggcaggtttttcttaaaaatgaaaaaaaaatcaaagatttttttaacagttctcagacttaactgttgccttgaattacagcctagtttctaagcagtgaaatgtaatgataaagagggatattttaacatatttccgaatgaatgactcattatttcattcttttgagtaaccattgttaagggttgggggaaagcatggacaaaacatcactggaaacaaaggctgtaaccacagcaacagactttgtgatacagttaaaaggtgcagctgccagtgacaaataaaaacttttgttacatctcattattttcaggccaaggtgggagtatagtgcataataattgtacagtagcaatttttatcctaattaacccatagcggtttacctaaaagtaaccatcagtcagtgcaaaatgtgcctggttcttaagacaactttttatttagaactgtgagaccggtattttggaaacatttcaaaggaaacatatgaatttgttttgcgttgtgcactacatcatttctctcctgaggaagaattttaaacatgtacagctcattcaatatagatatgagccatggtggagaactttatcactcaagtagacggtaaacatccttaatatgttctaaattgtttatattgctatccataatgggattcacctccaaattatcaaagaaataactcagagtaatttgacaccagcccagatcatatattgattatacaattgtattataaagttcattcaaatcaaattaagaaaacctgagtctttagaagctgaaataatcaacttgtttgtgctgtttgcttgacataggttattgtttgaaaatattgttactttatcaatagtaatcatgcattcttgtgtttttttttaatggaaaactgcaagtttcaattactgttgcactagaagtgctttttatgttgtcattttatattcatgccatcaaaagtagattgacaatacatcaatctaacaggggccaatcaaaacaatgaagaaaagaataactgaaaacaatgtcaaacttttaaatttttatctcttccaaagaagttatatctataaaatctagttttatgcaggtttgtcacagcaaatgtaaaagcggattcaagaagaatgaacttaaaaactgtggagcaaatttttgttgaaaatatataaagtcagaaagaaaaaagatgtaaatgttggaagaagcaaattctattactaattcaaatgaaactaaatgtcaaacacagtacttgtgtcaactatttagcatcccagattttgtaacatattttgcataaattatttgctcttcaaaaatttttgtcattttaaatctaattttaatctttatgttttccattttctaatttccttgcaatgtattattcttattcttaattctctacattgaaatttggctttacgtcgttagcaaatttataaagggttataaagctatgattcgtgagtctaaaatcaaatgcaaaattttatttattatgtaaaccaaaatgtcatttgcaagttttctcattagaagttatccttgcaaagatagaaaaagaagaattaatttgtgtaaacaagcacaaattaacatatttgttaataaataggtttatctactaataaacctatttctagacacattcaaattgataatgatttttagaaatgttaaggttccaaggagtcttacaagtgtatgcccttgatttcctgaaggaaaccactttctttcttaaatattttaaattcatctaaagtgaacgactataaatagaagcaatcaccttggaaccacagctctgtgcaaccaaggccctaagctacaccaaatacgccaggaattttgagacttctcatctttaaattcaaccaaaagggtctttagcaagaaaaaaaatgctggatgatgattattattatttttgcttaatttttattttgccatgtccaggttaagggtgagggtggtgacaatctgaaagactgtgtctggaatctttatcacatatttccaatttatttcagtttttgtctaaaacttgcatttctaacctatcttttccagcatttgataatctcccatttcctccttctaacccccattcctatgtctcccttcctgtctattcctcaccgatttaaacaactgaaatgtttacttatgtttggagctgaaaaatggaaagtttcacccagcatggttacaataacagccagcagctgcagcaaaccataaagttatgcagtgttttgaagttcacaaaccacattttacataaattatctcattttgtcttcataacaaccctatgaagacacattaatctcaaagaaattgagctcttaccccaaaacacagggccaataattggtgcagttgaattattctcaaaatttacaggctgttagtctttccactgtactaaaagatttctttctctgatcagagcaagagaacttccagagataatggatagaatgaaagaatatatatctatatatatttgacatgttgtttagtaatccctattttaattcaattctccatctgtaaaatattagctaactgaattatttctgtgttctactctgggctctcacattaaaactctgttcaaaaagtttaacaagtcacatatttcttaacatacaagttcgtttgtgaatgtgcagaacagatgctcccaagatgtggatgcatgtaggccccgaggtacagacataaaatcaaggaagcacaaggaaagaaaccccaaggaaaaaaccaaagaccttctaaattgagactgcataattataaaagagatccatagtacagggttgaacacatgttcaacactttgtcaactgaacacatgttcaattcggagctaattgggaagacttacataaaattctttttctttttttcttttggcaagatttcttcttaaaccatgaaattttttttacttgtaataatagagaacaattttctccattttccttataagaaaaataaaatataatttatccaaattgatgtatagaacctaaaacatacgctaacttgcaaataatatattttactgatcaactcatttttgtcaagtctctatttctagtccctcctgaatgttttggaaaaccacaaaactatacagattaatacaaattacatttttacaaggaaagaaaacattcccaaatttaacactcaagactaatcacataatcctattttgaactcagatctctctgactccattgactgcttagaaatagtaaaatctttttgaaaaaaaaattttctaaaataaaactattgtatatgagagtaaaaatatatttgtttttgattgttcctgactagaagacagatatcatctctcaaactaaacactcaaaataagaaattgaattcatgaaaaccaatacctgatgtgaattgttgttattaaactgtataaaagaaatgcagatgttctgggtatgtcagagcatgcgaaagaagttatgggactggcaggtatttggcctcaggagaaaaggtgaaaattttccagaatagatataataacatcttatattggcacagctcttaacagtttataatgctgggtaatataacaatctcctaattcatcaaaaagtctcaaggtgcagatgaattggtcttgcaataagaaagagcttccaactcctcccatgaccttcccaattttccccaactgtctctaaatagggaggcgccaagtacaaaggacccaggagcaatgctttcaaaattctgatttaccccaaaggtagggtacctggacaatcaacaattgggcttcattttatcatcaacattaatgggaaagaaatgtttaaaaatttaaaaccaagcaaacacacacacacaccatcaaagtggtgatgagtcttttttgaaggtctctcatgacttgcattatagttttattgtgagataggaggcaacttatatttaatttatttagggtaaatttcacattttaaaaagtccaccattgacttttttattctatgaaggacagtgatcttacagcagcagagtgcctcaaccatctaggacttaggctactaagtttcttcctcctagctctcatttataaattttgtgttatatgatatttgtcttcctgaaaaggtgagtgaaaatttattttgtgtaaatcaaataatatttcaaatgtatcaagagaccttgtgataaaggaaccttgaaattgctttttaatctaaaatattacctgctaatttatcttttttaaattgatttccatatatcttgtgttattataacacagcacacttgtactacatggtttaaaggttctgcaagacagtcttttcctcagtctataggaaatgacggtctgactccaggttttgagttggtcagttgagcagtttcagtcatttccacttactgactttatctggattaatgtggaaaatagtagtaagacaacatggatggataaatttgacaaataattttatttgtttaaacttttgccacctataatatccttgaagttactattaagaggtcaagttgactccaaatcccttgtgtcaatactagatttactgaatcagaaccactgggatggatcccaaaatatgcattaagacatgactgaggtgatactaatgcatgctaagttttgaaaaatagtgctcaaatgaatttatttttcctaaatcattcaattgctttctattctaaagtaaaattgtgaattcttgtgctttcccatatcaatgtgaatctagttttctaagcctgactgaacatttttcttgactgaggaaagcataccaaaagacaactatatataaaatgctcaggttgcttcctgacagactgttgtttatagattttattccccattaactctttcgagaggcatatctgaaaagtcttaaggcttctgggttagttacttgttagttgcacccatgaatataacaactgaaaagctggaagtggggagaaaggcaggaagtaaattatgatgtagcaggcactatgccctcctctcatttttaaatcattttaggaaagaagtataaccactattttaaagaaaggaaaataaggctcatagtaattaaataatttgccaaggctcacacagtggggttgaagattcaaatctagatttgttaggctctaaggatgtgctcctacccccatcatagcacattttcaaaagtgagaagagattataatcaacataatgaggcttatatatattattctgaataatttatacagaattatttattctgtattcagaataaattcttattctgaacacagcagaaaaagaatttgcctatttccaaatagaaaaattatcttacactgtgtagagacttccttcaatatcctaaaccagaggcctaatggaaaaaacaacaacaacaacaatattttcttgaagttttatacatggttccctaaaaagagtagacatttgaaagaaaaatccttcaaaacataaatacccttgaatattgatgtcatatttttatttccaatcatcttagcccttttataaatttacagccaaaattacagccaaaattacagccaaaattgataaagaaatatcaataatataaccttcaactggctgaaaaaaagaggtcaggttgccaattttaccaaaaactatatggatgaatggtcaataaagtcaccaagtacaaatgacaaggtggagaaaaacaccaataatctacagtcgcaaactgtagcaatgacatggcttgagctacagaatatttcctgtgagtgattttaaatggcaatattccttataggagtattataacttacacagatgatatgggatctggaagcatactacatcaaaagaggctgaaagataacctttataataaggcagac

SEQ ID NO: 10615 - DNA, 1126118 bp, Homo sapiens
  misc_feature (1)...(1126118): n = A,T,C or G, or insertion/deletion polymorphism (see Tables 1-2)
aggaaactaacatgggaactctccctgtttcagcataccttacaggtcttggtttaaatttgtcttagaaccttcaatccacagttctttgggttgactgttgaccttctgctaattcactgttatttctggatataaggagtctctctctatatatatatcagagacagcttttttttttcatttgtgtgtttgaatgaatagatgaaatacaaacatatcttcctaaataaggacgcattgattagaagagttttccataagactgctgttcaacattcttccttattggttacttctcaatgagaaattatccgaagagctaggatgcctcccagatctcattggtacattgagttttgcaccaaagcatcaggcttaattttccaaggaatggcaatttaagttaaatcaggtttgcagagttgtcggggtgtttgtgtatttgaggttgggaggggaaggaaacgatcatcttcagggtaatgataataaactaataaaatgtggctccaggaatgttgcactaaaactttgtgcctcctgcatacatttcttttgagtaatgccaaattgtgttcagtaaaatctgatcaatcttatgtgcgtaaattgtcagttattgcagaagtaatcagtcaaaaagaaaagaaagtttaaatgtagagacccttgttaggagctgggctttagcctttaaaatcgtgggtggatagggccatctggtgtgcagttgtgtaactagacattgctgttttttttttaacctccttgctaataatcaatgtgattcatttgtctttacaaaaacaaaccattcttttgttttgtttttttttcttcaacttttactttaatttcaggagtatatgtgcaggatgtgcaggttttttacacaggtacatgcgtgccatggtggtttgctacacagatcttcccattacctaggtattaagcccagagtccattagctattcttcctgatgctcttcctcccctcctgcctccctctgacaggccccattgtaggttattctcctccatgtgtccgtgtgttttcatcagtcagctaccagatagagaacatgtctagtctgttttcatgctgctgataaagacctacccgagactgggaagaaaaagaggtttaattggacttacaatttaaaaagagatttaattagacttactccacatggctgaggaggcctcagaatcatggcgggaggtgaaaggcacttcttccatggtggtggcaagagaaaatgaggacgaagcaaaagtggaaacccctgataaacccatcatatctcatgagacttactcacttcacgagaatagcatgggaaagaccagctctcatgattcagttacctcctgctgggtccctctcacaacatgtgggaattttgggagataaaattcaagttgagatttgagtggagacacagccaaaccatatcaatgtggtgtttggttttctgttcatgtgttagtttgcagaggacagtggcttccacctccatacgtgtgcctgctaaggacataatcttgttccttttcatggctacatagtattccatggggtatatgtaccacattttctttatccagtctatcatcgatgggcatttgggttattctatgtctttgttattgtgaatagtgctgcaatgaacatatgcgtccatgtatctttataatagaatgatttctgttactttgggtatataccaagtaatggaattgctgggtcaaatggtatttctgcctctaggtctttgaggaattgccacactgtcttccacaacggttaaactaatttacactctcacaaagggtgtaaaagtgtttctttttctccacaacattgccagcatctgctgttttttgactttttaataattgcccttctgattggcatgagatggtatctcaatgtggttttgatttgcatatctctaatgatcactgatgttgagctttttttcatatgtttcttggctgcatgaatgtcttgagaagtgtctgttcatgtcctttgcccactttttaatgggattgtttaaaacaaactattcttaaggctttcttagggtaacatttggagaacattggctcattcccaaacataagccttctcaaaccgattaaaatctaatcctcaccaagttaagtagggcttgcctgctgatagatcctcatcagagcaaagtcaaagctaaagttcagggggacagaaactgagtaaacagaggaagccagtaaggagagagcagaaaatgtagcccatgggagggaggagacaaacctcaagaggaaaaagttcccaacacttgcatgtcttacttctttaacctcatagaacccaacaaataagttataagaaagggagaagaggccgggagtggtggctcatgcttgtaattccagcactttgggaggccagggcgggtggatcacaaggtcaggagttcaagaccagcctggccaagatgatggggaaaccccgtctctactaaaattacaaaaattagctgagtgtggtgacgctcacctatagtcccagctacttgggaggctgaggcaggagaatcacttgaacccgggaggtggaggttgcagtgagccaagattgtgccactgctctccagcctggtgaccgagtgagactctgtctcaaaaaaaaaaaaaaaaaatggagaagaaaatgtgatcatgataaccattcccgccattactggagcctggaccagccggccagatttccacaggatgtctctgacctgcagaggggctggcaaggtgggaggcatccagaccatgttacagaactcagtaatcagagcctgtgctggagccaccagcatcccaggaccaccatgtgaacctcctgacaggagcaggctcctcaatgactgaaatgaatctcagcagaactcctgtgattcataagtgactcatttactaacttattgtcagtatagattctccactgggagaagacgggcaacttctggagacatttttggttgttacaactaggagaggggcatctactactcgcatctagtgggtagaggccagagatgctgctaaacatcctactgtacagccccaccacaaagaatgatctggctccaagtatcggtaatgtcgaggttgagaaaccctggtgtcagcagtgggagaagccttagagggaatttccaaagtggtaggatcagcacaggatagaccctgaagtttaaacttcttccagggggaccgttacccagtttggggaacaccatggtatatcactagctgtgggctgatgccaagttacaggtaacagatgccagcagaagctctgggcagaggaaaccaagataaacctaagcagacagtccttgtgaaactgaacagagtcaaagataatgaatggagaaactgaggctaatcagtttgacctcattccttcctctccccacaatcaggggatcttatgactgaatttcttacaaatagcaaaggaataagtaggcttaggtgagaggggaaaggggctaaattgaggggagcagtggagcaacagattagtggtagcagatttatttttatttatctttttttgttgttgttgttaagacagaatcttactctgtcacccaggctggagtgcagtggtacaatcatggctctctgtacccttgaactcctatgctagagcctaggagtaaatactaggattactagagtaatcctccgacctcagcctcccgaatagctgagactacagacatgcaccaccacactggctaacttttaaattttttgtagagatggggtggtgggggtcggcggggggggggggggggtctcactatattgcccaggctggtcttgaactcctgggctcaagcaattctcctgccttggcctcccatagtgctgggattacagttgtgagccactacgcccaatccaatggtagcagatttaaacacaggtggatttggaaaaaaaatcttacgataggtttaatatgagtcagcaggcctgttgaaacaaaacagtgctttgttaagcttgtttttggttggtcaaatgtagaaaggcaggtgtctccgctaatgagtacgtagagcaggaatcctaagcaatcatccatttcagaacatgaagacaaaaagcagctgcccctcccatacactgcccattaaaatacatacttttaaaattccttattttcaattttatttttttgctctctcagaagaatcaaatatatgtaattattctgatggaggcttgcattctttgggacctaggcctgagaaatcacggtcagtagatttccctataacatggggctggggagcaagtgccaaacagggaatgttctgaaaactccttaggcacaagctgaagatatgtttgaggttttggatacagaacatttataggatatcttttggtggtccaagaggacttgagtgtaccttgtaaatacaggattttgtttttaattagattgattcacagagaaccaaacctaaggaatcacatcattcattcatttgttcatttaataaatttgtaggttgaagcatttaccaagtgctggcaatagaaagaagtcccgggtgtgctttgtcagtttagtcgggactacacaaatgagtcaataactgtagtggagtgatgcgatctcaactgccaggaatcccccggctctcctctcttcctgtgcctcctcaggtaattagctatcctttctttcttttattttccttccttccttccttccttccttccttccttccttccttccttccttcctccctccctccctccctttctttccagattctggacctattccagacttactaaaggaaattctctaaaggtgaggcagttttttaaagacagcagctctctctgtcgtccatgctggagtgcagtggcccgatcatagctcactgcagcctcgacttcttgggctcaagtgatcctcccccttcagcctcaatgagtagctgggactaccgatgtgcactaccacgcccggcaaactaaaaaaataattatttttggtaaagacaggggtcttgcgatgttgcccaggctgttctcaaactcctggcctcaagtgatcctcctgcctcagcctcctaatgtgtttggattacaggcatgagccactgagcccggcctagctaccctgtctgagttgtgcccactacacaaaggtgtcagctacatgtgatgtctgtgcatttctggcctggaccgcacattaagtgctccgtaaacatcagtctctattatcaacagtctctattatcaatcagtctctattatcatcagtctctattatcatgagtctctattaaacaacagtctctattatcacagtctctattatgtgttttggctgaaagaaagttctctaaaaccaggaaatcaggaatcagcagttttaagttctccaggttatattttaacattgtgttcatatgcaaaacaaaggttgtgaatcagcacgaatgctggcaagccctggaaggtttgtgatcacggactttcacgagaccccaaggcaaggagagacagaagcccaggacaacagcatgggcgccgctttttagtcgggcgccgctttttggtcaggcgccacctggactacatttcccatatccaattgccgggctcctgcaggattggccagaacaacgcggaagtgattacgggtcgcccagcaacgggcggagtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtyagccatggcagcgctgcgctacgcggggctggacgacacggacagtgaggacgagctgcctccgggctgggaggagagaaccaccaaggacggctgggtttactacgccaagtaagggggccgcagtggggccgcggacgcacctgggaccctgcacagcccacggacgccacctgcgcggggaggacgcgcactccagcgcagcgcgtgcggtgcaaagtgaaagtaactgttaaggagcttcagggaaaagggtccagggttcccagtaggggccgscccccttggtgggcctcgggtccagcgggggtcacctggtggcttcccggcgcgccctctgctgttcaggatgcagcactgcgyggcgcggcgagggcaaagcggcctcatccccgccaaaaaataaagatgttttaaaaagcgcacatgctcagctccctcctgcaggctctgggttgcagggataggagttttgttgtgttttgttttgttttgtccagaccggtattgctcagtcatccaggctggagtgcaggggtgccatcatagcccactgtagcctctacctactgggttcagacaatcctctcatctcagcctcttgagtggctgggactacaagcgtgcactactatgcccgactaattttttaagtatttgtagagactagggtcgcaccatgttgcccaggctggtctcgaactactgggctcaagcaggccacctgcctcagcctccagaattgagattacaggcgtgagccactgcgcctagccaggagtattttttagtagcagtcctagatagcttcactatcatttcctgggaaagttttggaaaccccagcagagccttcatctttaactgtgtgaccttgggccattgaaataacgtttaatcttggttttttcacctgtaaaatgggttgatatgagggtcagttcaggcactgtgcgtaaagcacatagcaccgtgtctagtaggtactctctgttccttaactgtckttccttgattrctcttaagatacgacartgcctcttatatcggcaccttagaatcacctaggaaatgtcctaaatacacgttttgggtctccatagagaacctactgtagccgactctcaactttgggagtctctttttttaagctttccaggtgaggtggaatatcacctggttttgagaaacatggatgtaaatctgattttcagcatctgggaaactttttttgtaagagcctttttctgggccccacttccagagggtttttctttttttkttttcttttgagacggagtcttgctctgtcgcccaggctggagtgcagyggcgcgatctcggctcactgcaacctccgcctcccgggttcacgccattctcctgcctcagcctcccgagtagctgggactacaggcgcccgccaccacgcccggctaagtttttgtgtttttagtagagacggggtttcaccgtgttagccaggatggtctcgatctcctgacctcgtgatcctcccgcctcggcctctcaaagtgctgggatyacaggcgtgagctaccgctcccggcctttttttttttttttttttttttttttaagacagggtctcgctccgtcgcccaaactggagtgccgtggtgcgatctcggctcactgcaacctctgcatgccgagttcaagcgattctcgtgtctcagcctcccgaatagctgggattacaggcgcccgccaccaggcctggctaatttcgcgctgttggcccggctggtctccaactcctggcctcaagtgatccgcccacctcggccccccaaagtgttggcattacagacaggagccactgcgtcagcccagaatttctgatttaattggtttggcccctcccctctcccttggtaggttgtaaaatcttccctcccaggtgattctaatctatgcaaggatgtgaaccactgctgcctttggtggcaaggtagaggaaaaacaaccaagttctgatgagttcattcaagacacacacaggtattatgtgacaggcctttggctggcactggttataccgaggcaaataagagccagttgtcatccttaggacccaatcttattagggcacagtgacatgtgtaggagcgtccccacgcagtgtgtataccaggaagtagtgtgtctggcatgaggtgtgtgtaggtagttgggggggtcgtgagggaatatggtggcaccctcacagtaaccttcacttcctgggctcaagcgatcctcccgcatcagcctgttgagtacccgggaccacaggtgtgtgcctccacacccagctaattattacatgttttgtagaaatggggtctcaccatgttgcccaggctggtttgaactcctgaactcaagccagcctccctcccgaagcactggaatcacaggcctgaggcactgtgccaagcccagagcggtgttttgagctcaagtagaggtgggtggggcaggagggcagtctaggtagagggaacagtgagaggagagaccccctgcatggcctgtccaggggcctgtgatctttgtgagggtccaggaatgtgaaggttaaggcagsgaagggaggacccatttcaaggatttctgtgccttgccgagaagcttgggctctgttggcagagccagagagtggcattcattcagcttgtgaattctggaagaatttctggctctggagaattaaagggacatttccagcagcagagctccagtagcttttgcagggacggaggcaagctcctgagcgggcacttgctgttcctctcacctgtacatctgttggggaaaggctccttctcatccttcagagctgagcttacatgtcactgcccaagagaccttcttaactgtgggtgtcccctcgaccttgtactagtcaccttgyttctctgcttcttcgtgcttagccttggctgtgtactcctccttgttggccctgtctcccttgcccaggttgcagatgtcatggggcagcttgttcatctgagtgtccccagtgcttggcacccagaagccataagatgagcccctgtgggatgagtaaatgaatcaccttgggagggtcagccgcaggcttctgtgggtgggtgggtggtgcactgggccccagagtacaaagatgcacatgacccgcttccggcttcctaagcccacctctgcctctggctctgtggggcgtctcctcctttgccactcagccccagaggtgcttctgcttccctgcaggcttgccctggagcctggcgctagggccctggggctcccttgctcctgcktgccccctgygcctgccttcctgctgcctggcctttctcccatctgctttcttcctgagtggcccctggccaggggactcgggtgcatacatggtttccaaacrcctttcctccagccctcccgactagtgtcttaaatctcaagctggcctctctggctccgctgtttttttttkttttttttttttaatttaatttaactttaaattccgggatacatgtgcaggatgtgcaggtttgttacataagtaaacctgtgccatggtgacttgctgcacttgtcaacccatcacctagttgttcagccccccgtgcattagctatttattgtatacaccagctgagatgccagggcttggctggctctcagctggagggctcactctctggaccttgtgtccgtccccgctggccctcagttctctggatcagggttgaaaggctgaaattctttgggtgttagcttaggatgcctctgatccatcctaasccgacattcccttgatctctcctgatctgtgagcatcctggcccttcttttcttttcagttttaatttttgcgctggctccaaccccttttcattcctgactctggaagtgacacttgtttttctcttggggtttgggaaactttgtggttgttctttctaggaggctgctctttgagtcatttcttttccatattgtttctcctactgtagcagggccatggccagggatagaggctgtagctcccactgagacctcggggtctggtggaacccggtcttgtgtgggtgctgtcggcctctcctgctttcccacctgcctcacggttcacttgtgtgcctcaaaggcacacatgtcctagcactccaaagcccaccagggtgggctcccaggggtgaggtcgaggtagaccgggaacccaagagagctggtgggcctttcttctacccctctcccctcacagtctcagagcagccccttcatgggagatgggaagtgagggacaaggtctcagtgtcagagccgtccttgtttgcccttccccgtgcctcttatgaagctcaggccttttggcagtcagaggcctcaatggtgcctgtgtccacagggctggctgtcctcaccgtsaagtctagatctccctgctaacttacactgtgctcaaaacacacacacacacacacacacacacacacacacacacacmcacactggctgtcctcacygtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagcctgggccacagaatgagaccttgtctaaaaaaaaattaacagaaaacaccccatacgtggaagtgtggtattcacataatatgatgttcacttaaatttgaatcctttggtttaagtttagattactcttaattatctttttaaatgacaagctcgttgaaagaataaaaaatcaaagacggcttctatttaaaggagaataggagaatgcttaggggacatgtgttctaattttctcttcattaaaaagtcatttaaggttataattaaaaagaacatcttttaattaatttttatatttattaaaaaaaagtcttctattgaaaggtacagttcttagttcttcccgtgttaactcactcggttctctataaccccaagaagtaagtgctgttattgtccccatctaaactgttgaggaaactgaggcatgggattaaatgacttcttcaagggcagagtggctggcaaatgggagacccagaaaaccttggcagttgggcttcagaatcttcacgaccaaattactctctctgcttcagctggttccggattcttccccagggatggttgtgtcctgcaggggacggctggcaatgtctggagatgctttctgttgccacagctatgggactggggtattggcatctgatgggcagaggccagtggtgcccaaggcagccccgcaacaaagaatgatgcaggccgggtgcagtggttcacgcctgtaatcccagcactttgggaggccgaggcaggtggatcagttgaggtcaggagttcgagacctgcctggccaacatggtgaaaccccatctctactaaaaatacaaaaattatcccggcatggtggcaggtgcctgtaatcctagctactcaggctgaggcgggagaattgcttgaacctgggaggcagaggttgcagtgagctgagattgcaccactgtactgcagcctgggtgacagagtgagactctgtctcaaaaaaaaaaaaaagaatgatccagccccaagtgccaccagcagtgagaataagaaaccctgattcaggcatgttctgtgaaagtcaagaacgtaggttgacagagtttgttttgttttttaaatgtctttctgaataaataaaaactgttctgagtgagttttgtagttcctttggaaagtattcattctgtttgtttacatttgtgcgcctgctgtgggccaggcatgaggctacatgtctgagggcccagcttcaccttctaagggctgggaggctctttctatgccagcctgcctgccaacaaggctcagcttccactgttaagggtcattttgtggatttttttattttttatttttaggttgagtcttgctttttcgcccaggctggactgcagtggcgtgattttggctcactgcaacctccacctcccaggttcaggaaattctcatgcctcagccactcaagtagctgggattacaggcatgtgccaccatgtctgtctaatttttgtatttttagtagagatggggttttgccatgttgcctaggctggtctcgatctcctgggctctagcgatcctcccgcctcggcctcccaaagtgctgggattacaggcgtgagccaccgtaccccgccactccatggattcttgagggcagagttttttggagccaggcttcaagcacatttgatgtgtgcctatgagataaagactgcttttaatggcaggcaaggaaaatgcaagtccatctcttaactttcttgaagaagcttgagacacagctctgcaaggggctggaaggtttcatgttattgccaatgcttggtttatctgattgctgttgccattcattttgaaggagaagcaggagttggtataccaatattcccactgtgccagcagagagcgggttatccttactagagagccagagagtcagaacggtttttttttkttttttttttttttttttgagatggagtttcacaattgttgcccaggctggagtgcacgatctcagctcaccgcagcctctgcctgccgggttgaagcaattctcctgcctcagcttcccgagtagctgggattacaggcatgtgccaccacgccaggctaattttgtatttttagtagagacagggtttctccatgttgktcaggctggtcgcgaactcctgacctcaggtaatccgcctgccttgccctcctgaagtactgggattacagacatgagccaccgcgcccggccacagagctgcttttttttgcaagtgatattggatggtggttgatgtacaaagtaggagtttgtccttgctactgataccgtagctggtacaaggttttaatcgttctccaagcactgtcacaggtgtcatgtgtctcgccttttcagcagctctgtgaggtggcagtagccctgaggagactggctggactcagctagcatgggctgctcaggtcttcagcgtgctgagtgaggcattcctgcactatgacagagacccagctgccaagactttgtcaaacagaccagaagccagcagttcatgaaaagaccttgcttgcaagttgtagaattttttagaaaattcgtgctctctgtatttattttctgtaaaataattgatagggaaagaatgttcacatcttatcatctagatgttgctgattaaataatataactttctgggttggcatgagtaggtgaacttttaggaaacgcagcctacccttcgaatacctcttgtagcacctggctgtttcccttttgaaataattgtatgttttcctggataccttattacctggtgacacgtgtttctagttattgacctatgtttttaattataactttgggtggtggtctgaaatgaaatgttaagtttgacgcaaaaatmggactagtttgtgtaactgatttgttcaraataacagcttacatttctcagagctttttgtatgccaagtgctatgcgaaaccctggatgtacaatattcttatagtagcccctgagaccagtgctaggattatttccattttgcagatgaggggatggagattaaggagtggggtcacttgaccaaaggtgcacagcgcacagctagrtgccctatgggaaggtcttactgcatctcttaactacctcttgggaccagttaggaaccagtgcttaatgaaacactttgaagttacatctgtggaaagaataaacattttagctgggcaaggtggcacgggcttctagtcccagccactcaagaggctgaaataggagggttacttgagtccaggagttccagtccagcctgggcaacatagtgagaccctgattctttaaaaagaaacacaaataaataaacattttaagagattatataaattagatattatgaattttgtccctacatcgtggaataaaaccaaaacaaatacacagcaaaatgcctctagatttatttatttatttatttatttttgagacagagtcttgctctgtcgccaggctggagtgcagcggcgtgatctcggctcactgcaacttctgcttccctggctcaagcgattctcctgcctcagcctcccgagtagctgggactacaggcacgtgccactgtccccagctaattttgtatttttggtagagacagggtttcaccatgttggccaggatggtctccatctcctgaccttgtgatctgctcccctagggctcccaaagtgctgggattacaggtgtgagccaccgctcccgacggcctctagatattttgagtgattcagcaaacctcctaaagttgaccccgtagctggggtcacagtcctctttctccttcttcccccyacttccttcttatatctggctatctgggagagaaaaaatttaatacaattgattactttttagaagagttaatttttacttattactgkggattttttkttttttaacagtcacaccgaggagaagactcagtgggaacatccaaaaactggaaaaagaaaacgagtggcaggaggtttgtatgttgttgtctaaggatcttggatggaagcattaagtagatgaggaaatgtcactggcagagaggtgacaggttattgtgtgtttagggagggctctctggtagagaaccagactcccactctgaggagcttatgggatttggcagaagaagatgatgagatcatagggtggagtgaggatgatttcttactggtcttaaagtaccaaaatggccagatgtggtggctcatgcctgtaatcccagcacttcgggaggccgaggcggatggatcacctgaggtcaggagtttgagactagcctggccaacatgttgaaagcgcatctcttctaaaaatacaaaaattagctgggcatggttgcatgcgcctgtaattccagctactttggaggctgaggcacgagaagtgctcaaacccaggagctggaggttgcagtgagccaagatcacaccactgcgctccagcctcggtgacagagtgagatgctgtctgaaaaatagcgacaacaacaacaacaaaaaccagaaaataattgaggcctttgattcacagtttatgatgttttcctatcgttgcagtgtttataaaattgttcttggctatactatggaattaaatatataagtatttggaaatttcgtaaagattaccatgacttctaggtgattctgagataatgtatgatccacggaatagaagtataagaaagggacaggcacggtggcttgtgcttgtgatcccagccctttgggaggcagaggtgggaggatcacttgtgcctgggaattcgaggtgagcctaggcaacatagtgagaccccatctcaaaaaaaaatatgagaaggttcctgcccttaagaggtttaggatccagctgaagaatcaacatgtgcacatgaaaaaaaatggccgtgccctctaatgtcatakgaggtcagcgtatgaatgacgttgggtgcctgccctgcatatacatatgttctttgagctcattcaagggagaattcccatggattggcacaaccagtatggtttatagagcgatcaggaataaaataggttttcttcaaaacaagaggcaaaaatgtggagcccagggtgggatcaggggccttctgcagctgtcgcagttggaacatgtgacgaaagccagttgatgtgacaactgctgggtgggagggacaggcttgggggcggggctgggagggctccttcycttcctgacccagggatggtctttacttctccctggcacctgtagacctgtctttcttgtgtttcagatttgccatacggatgggaacaagaaactgatgagaacggacaagtgttttttgttgagtaagtgtctgcaaagaaaccactctcagctgttttgctttttaataggaatttttaattataaaagtaatacatagtaactgtagaaaaatacaaagtataacagtgtgtatctgtaatcttagcagaagtgactacttttaacatcgctggaacttttaacatcgctagatttattcttctattttccccgcacacgcatccttaaaaaaaaaaagtagggaggccaggcatggtggctcatgcctgtaatcccagcactttgggaggtcgaagtgggtggatcctgaggtcaagagatcgagaccattctggccaayatggtgaaactccgtctctactaaaaatataaaaatgagctgggtgtggtggcacgtgcctgtggtccctgctactcgggagggtaaggcgggagaatcacttgaacccaggaggcggaagttgcagtgagctgagatcgcgccactgcactccagcctgggtgacagaatgagactccttctcaaaaaaaaaaaaaaaaaaaaaagagggaatgcactgtgtggactgtttagtaacctgctttttccatgtaatatattatgagcattttcttgtatccatatctatttttcaaaaagatgctatttagcagctctagagttattattttgtacagatatactataatttatcaaattgcctattggacattaatgctaaattcctgttatagagaacctataattataaataatgtattgagcatccttatctgtaagactttttcacctctctgattctgtctttaggataaattccggtatcacgcagcaatagtaaccacctgtccaacatatagcatgagccaggcctgattctaatcatcttgtatctgtagcattaggtcattggatccccacagtgccctgagaggtagtattgttattatccctagcttactgccagtgacacagacttgagggggtaagtgacttgttaaggatcccacagcaaagaagtagcacagccaggctttgagcccagcacctgctccagggactgtactcttgaccaccgtagttaagaggagaattaatgtttcacaactgtcaacatttaaattagaagcttgaatagtctttgacaggattaggattggttggttaatagaagttgatttgagcaggaattttttttttttttaaagttatgaatgtaacataaacgtttcagtatttgattcaagtacaccaacatttaggggtcgggccagccctcctctgagtgtgagtccacttgcatggatccagtgtggtcttccttcccctaagcatgcctgtaacataacatctacaatttctactttcattttatgtgggcgaaagagtacctaggtgccgaggcaagagactgaaggcacaaactgtttcagtataataaagaaagtagttagaataagaatagtcataatacaggttagatatggagatgatcatggacaattatcaatcattactataaacactattaatcattagcttttaatattactctttgtggcattactaacataacctaggaataactggcatgtataggctcaggtgctaaagggacattgtgagaagtgacctagaaggcaagaggtgagccttctgtcacacccgcataagggctgcttgagggctccttggtcaagcggtaacgccagtgtctgggaagacacccgttacttagcagaccgcgaaagggagtctcctttccttggaggagtcagggaacactctgctccaccagcttcttgtggaaggctgggtattatccaggcctgcccacagtcatccggaggcctaaacccctccctgtggtgctgtgtttcaatggtcatgtacgttgtccgctttcatgctcctcccgtactcctggttcctctttgaagtacgtagtagatagtggtagaagaaatggtgaaagttttaaagtctttgatctttcttttaagggcagaaaagaaaatgctgacgtatgctgccttctctctctgcttcggctacctaaaagggaagggccctctatcctgtaatcacgtgacttgcttcaccttgtcaatcacttagaagattcaccctccttaccctgcccccttgtcttgtatgcgataaatatcagcgtgcccagccgttcggggccactaccggtctccacatcttggtggtagtggcccccaccctgggcccagctgttttctccttatctctttgtcttgtgtctttatttattacaatccctcgtctctgcacacggggagaacacccgctaagcccagtagggctggaccctacaactttaaggttgagcaaacacagtattttcaaagaatctgattgctacatcatttgggagttttatggtatttttctagcattttcactgtagttgattgaaccaaaactttttttttagctgcttgtctttgaggctctccaaagcattcgaccacattttcatagataccactgacactatttttcacctcccatgttatcagtttgtgtaatagtagcttgctggtaatgtagttacagtaacaagttcaaatgacwtgtgtgttttttgagcaaacctggtgaacttttggtgcaaaactgatattgagagcaaataggccaaagcttgcttgagagaagtctcccaggccaccataggcagccccaggaagacggggctgtctagcagttggataggtgggagtgcctattatttgttaaaaggctttttgcctaacttgtgaaagttttttttcctcaactaattaagggtatcaacgcattggttgtatgttgaaaatgttgaaaatgttttttttttttttccaagttttctttctttttttttttttatactgggtcttgctcttcttatccagggctgaggtgcagtgacacagtcacagctcgctgcagcctcaacctcctggactcaagtgatcctcctgcctcagccttctgaggagctgggactacaggctcatgctgccatgcccagctaatttttaaagactttttttttgtagagactgaggctcagtatgttgcccaggctggtcttgaacttctggccttcagcgatcctcctgccttgacttcccaaagcattcatattacaggcatgagcgaccacacctgactgaatttcttaaattttttatgtagtcaaatcaattttctcctgtgcagtctttgcctttgcattcacgcttggaaagttactccctgaaatgggtattaatcaaccaagagcagcagttctcaggcatggttcctggaccagcagcattaatatcacctgggaattcaataaaaatgtacattcccaggcccccaccccagacctactgaatcagcactggggtggggcttgcaatctgcgctckaatagtcatccaggggatcctgatgttccctagcttgagagcctcccgtctagagcaggggctgtctcctttgcctgtaaagggctagataatatgttttaggatttgcagggcatatggtttctgttgcaatgattcaactctgcctttgtagtgctaaagcagctatacacaatatacaagtgatgggcgttgttgtgttccaataaaactttatttacagaaacaggcagtgggccagatttggccagctcctggtctaatctagaggagtaagcaagggctttggggggaacctggaaattggctcccctggctagttctcacttttctgagcctgttgcagtggggtgctggtaaatgtttagcaccaggtcttcagggggaaaaaagccactgtttgtttccacagtataaatactttggccatagctgatttcatgctgccaaggtgaagtgaggaattgggaagagatagtcacgtttggctcttgtaagccagtttgagccagtctagcatagaactgctctgttgtgtgtgtataatattggggtcacaaattaaggttgttataaatagaatgaggatgaggatggtaataattagaataaaggttggattattactcttgagtcttggtacttatagggagatgagtatatattttaaactaattttacacacacatacttttaaaatatgaaatttcatctatatttagaggcttcttaatagtttttaagatattctgaggtctttatctcatatcccaagaatacatttaagatataaaaagtaaattctattataaggagtactcttttcatccatatgtgccttttttttttttttttttttaatggttacccagggtcttggtctgtcacccaggctagagtgcagtggcacaatcatggctcactgcagctttgatctcttaggctcacgtgatcatcctcctacctcagcctcccaagtagctgcgactacaggcatgtgctatcacacttgaaattttgtttagtgtttgtagagatgaggtctaactatgttgcccaggctggtcttgaactcctgggctcaagtggtcctcttgccttggcctcccaaattgccgagattacaggcgtgagccactgtgcccagcctccagtatattttaataccatttctacaagatttagatcaattccaaatcaaaatgagtgctcgtaggaggtatgagtgcagagtcttaaaatgaaaatcgttagaattttggtagttggcaggtttcttatttacaactaagactttatcattttgagttttctacttctctacgtctttaggcccttgcacagggctaagagatttaattgaaatctactgaaaagagtggctgacagatcttatagctacatttacatgaattacataaaagcccaaaaccttctcaagaagccttttttgagatctaaggatacatggcaatagttattgtatgttacagcgtatgttataggcagttctgaaggaaaggattcgatgactatctttttttggcacaaatgtgatccttctggaggccagaagatagattcagtgggccccagwtctttcaggtttaakgaataagcattttggtctatgaaaaatggggtttkcctaaagtataagattgtcttatatttataaatgcytgtgttcattgctgtgggttcactgctttctcttttgggcagccatataaataaaagaaccacctacttggacccaagactggcgtttactgtggatgataatcygaccaagccaaccacccggcaaagatacgacggcagcaccactgccatggaaattctscagggccgggatttcactggcaaagtggttgtggtcactggagctaattcaggaataggtaggctcttcacttmgttatttatctttgggactgctataatgagatccacttagatctagctataatggaattttgtttagtggttctctgatttaaacatgacttttatcyttttcagmtatcgtttcattaacatcactacctctttttaaatcctaatgttgtcatggaagcctgtgtaggggctgaccttgaagtctctgaaagctgaacactcagcaaaagactgtggctattttggtattcagggatgagagacaacaggctccgtctaagagtttttgacctggtctgcatggtgtatgggcatattccaattacctgggttattcaaaccaaaattgattggtaatagaatacggggaacaacaaggtattatgtctttggaacaaaggatactacaggtttcgactggtcactgagcatatcattttcttttgggcacaggatcttatttctctataaaattggagaatgagttcctgtcttcacctcttaattgccaatgtttacccacagggactatcatgggtagatggctcaagagggtatccttgcttcaatatgatgggccattaaggagacaggagcaaggcgggagcaaaccataactcttcataggattttattctgattttgctttgatctatttacataagtatctgaatcagtgagaaccacctgctttgagtttagatatgcatcttcagatttgtcgacatatgaaacgttgcatttggctgtcttctgtcaagttctctctgtccttttggtcccccgcagccctcacacggcccccttgatgccctcctctactcatttgtttctctttcctaattttgtttttatttttattttttgtgggtatataaaggtgtctatatttatggggttcatgagatgttttgatacagggatgcaatgtgaaatagtcacatcatggagaatggggtatccatcccctcaagaatttatcctttgagtgataaacaattcagttatacccttttagatattttacaatgtrcaattaagttattattaactataatcaacttgttgtgctatcaaatagtaggtcttattctttctttctatcttttttgtacccattaaccatctgcacttctttcttaattttgaacaattccttgaagctgcagaaatattttctagcatgattagggaggcacaggaggtaaaaatacattgttcaagggtcaattattgtgttgtacaaggtgtgaaatctaccaggttgccatccgagtggagaatttttttastgtacttgcctatgaaggtaaagaagcaaatggaaatttttttttaagaattgaaaggattttatttcaaatcaactctcatacctcatcctgggctccaaatatgttcaatccacttgtctgaacttctgcattggagtaaattttatataattgtcattgaagtcaaaactgatggcgtaatatttaaaacaatggctggatccccaatctaagaagaatacattttgttgatcatattaagtactgttacagtgaatgcatggacccatacaattgtggaataattaagaaaaaaggacttaagggcttaaaaatgtctttttaacaatttaacaagttagccagaaactttaaagatcttattctcttaatcttctagctagactctttttctgtaatgagtaagatatgtgactactgattgttttttgtgttaagtgttcgaactgctccatgtgacattagatagcagactcttgaatagagctaatgctctttcaaagatttgcaacagcagacctgcgacattgtaatccaggactgatagagttggttcagaatattaaaagggtgatatctagttagatacataagtcttgatggagaggaggagattctgaagcattgagaataaatttgtggttgctgagaatggccctcacatgttggagtaaagccagaaactctttgtgcctcttcacagctcccacttccccctaagactcttccttcctgatacctataattcattttgtggacactgcaggaggtgtctgcggtccagttggaggttgtggcaaattgtaacgctcaggatggcacagatgtcgcacaaggtcttagggagaccagcctttcctattcaagtgcccacagctctttccccagctgtcaccttccgcaggaatggcctttaacactgtcacctcaccccattcccctccactcttgggaagcatacgtctaggtgagtggtgaagatttttattctgmatttttgaaataatatcgtactgcaagttccaggcaatcaaaaactcacaaatcacttgcactctgcagcagtggtatcaggtctgaagaaaggaagaggctgcagataggcacatggctttgctaagttagcttttatatcctgcgtggctgccttagaaagtgtccttgcccaagtaggctgtggcttctagataaagtccttctactaagctatgaaacatgccaatttataaattgctatcactactttagttccgctcatttaaaatgaaatagctgaatgccgagtgagtgaattgggcatctttacttccaagacttctggggcattcaggagtcatattctatctaagctttaatggtgttggtgttccctttcctttggccactcaagggagcctgttttctttggataaaccgtgaaatctttaaccctgtgaatgtccgttttctctaaggcggggtgggctgaaacataacataacaggatttattttgaaagtggtgactccacaataaaaacatagatatctaatttgccttacaaaggccgatttgcaaatctagtatttccagtggttctttctttctttctttctttctttttttttttaaatgccccatatgacgctgctttgttggaattgccattggtgaggatctcactgataaagaaggggacatccctcccttgatagactttagggttgcactagagccatgccccctttgaagtggcctctaagcaaactctgtcttgtcatcattttcctctctgcagctgtaagtgatacggagctgtattttgagtttttgatactgatattactaaggcaattggagggattcttaattcatctaaaaaaaatcagggattctgacagataaaaggatttggaggaaatgtcagaataaagcattgtgggttcatgaagtcctaggttttataattaaggtttataggcaggtattaccgctgctgactggattcaactgtctggattggagatgaacaaactgccatctctgggctaactctgacccactgcctgattttgtaagtagaattttttttggaacacagccatgcccatttattcccattcctataatgttgaactactgtttgtgtatattcagttatcccaaaataatatggccctttgcttgttaccagaagagtcgcccagttgtggcagagatcatctagctcgcaaaactgtaaatatttactctttggcctttcccagaaaaaagtgcsgactgctatgttagatactccagttcattcaaagtgatatcaccctaacattctctaaattagccacagcttagatgaaatttaggcaaatggaaygccccaggccccaggaagactgtggcagcacattgtatgtaactgttggggatgttgcctgaaacccccsccytttttttaggcagctgcaaggattagaatgttgcctcctcagaaactaacactcttctctccttgacctttgtttaaccagctttctgaacctgaagaactttgtagattgaaagctgtagcttgtggacctctctctgtggagatcagcatctcagtatccagggggaagccatctcttcacccaaagcttccgctaggagatcaagaggcccggaaccccgcagtcctgaatgctaaccagtagagacaagggaggaattcatttctgtttgtgttcaacatagactgagcaggaaggrccaggtgttttacgactctttggagttagcagcttgttggctctgatttggtaaaagcaacggaaatgccttcagcacggtgaacrttacatgcaaatgttgggaagtgttaggaaagggaatttttttaggcgagggaatttcgcattgaggaaggtccctgcttcgtttttagacacagcctatcagtcagctaatttggctatgcatataaatactttagtataaaatgctgccccctgctacctgcaggctgacatgttgctcatcaaaggcaggatccttctaatgagggattagttggatgcctaaatgtgggaccacctactctgttcattgtcttaattagctagatgtttgttggagcgcatgcaaattattttctgtaagcagacagatttattatcatatttacggagtgacatccagggtttgtgagacatccattaaatttttttttttttttaatgtttgagatggggtctcactgtgttgctcaggtgttggtctcaaactcctgggttcaagtgatcctcccaccttagcctcccaaagtactgagattactggtgtgagccactgtgcccagatgctattagcaagtatgaacaaattagatattttcagtctactcttctgtggtaatgatgataaaacttcttaactttcagtcctaaaccagcagtggctaaaacttgatttttaaaatttttttcagagtttggtccagatgaagtttctttcaccttgcgaacctttagaacgctgggctgcatcatgtgtgttgtaactttaaagttagaatagcctagcttcgttacagtttttgagccaaaggacccattaacagaaacaaaactttttttcctgcaaacaaatacaagctggccacactggtaaataccagtgaaatatattttgggactgacacttgcattttctattggtacttatgtcacaaaatcacctctctaacgtgtattacatggacctatatatatgcatacttacatatcaaaatgtatatattttgaggtataaaaagtacgtgctcaaggtattggtcactcctcaatttgttttccttgaaacaaaatgaaggtataaatatttcagccgggcrcggtggctcacgcctgtaatcccagcactttgagaggccgaggcgggtggatcatgaggtcaggagatcgagaccatcctggctaacaaggtgaaaccccgtctctactaaaaatacaaaaaattagccaggcgcagtggcgggcgcctgtagtcccagctactcgggargctgaggcaggagaatggcgtgaacccgggaagtggagcttgcagtgagctgagattgcgccactgcagtccgcagtccggcctgggcgacagagcgagactccgtctcaaaaaaaaaaaaaaaaaatttcatgcagggaatcccaaaatgtaattatagtgtgatgttgaaattgattgtcttagcttagagagcctactttttaaaacttagggtcttgtttctaaatcatgtgttgaaattacagtgtgaactgtagttgccatactctttgatcctacaaattgtcaccacgatgaattcatatcttgtgcaaattttaccagttctacgtgaatagaagaaaattactttttcttcatgtagagaagggtattcattcctaagattttaaatccacacttcccaattatggactacgccagcttcctttacacctttgcttctttgttttcttttccatacctaaatgttactaaattttgcctttgagcctaaagcatgtcattgatggtttttttttttctagttattccaaaaggtcccataaatctggggccatagctaacttacatttagtcattttcatgggtaaaacacactcatatgagatcattgcacttgggatcttgaaatgcctgattagtttcctttctgattgttgaccagacttaaactagtgggatcttggcatttatctttttaaaaacctggtgctcattaaggaaaggaaaatattctgaaataatcgaaataaccttttgggcattggaactccattttaaattaaaaacatttgtgcctactattatcttatgctaaattatacccaggtattgtaagtaaaattattttgaagttactttgttctaagaaactatggagattcttgacagtgttagacaaagtccttaaatgacattatataaaaattgagaattagtaccttatgacttaaccattttacactgagatattattggacattgagtgtacatggaaatcacgtgatcaaagtatttgagaagtaaatatctaaaggaagagaccaatttaaaacattctaatgagcatcatctcataatttggtaatctcatgtaaaatgcttataataggggtgtgtgtatgttatatatattttwaaaataaatttgtaatcatgtatacagtagtccccccttatccgtggtgtttcagtttttttttttttgagtcagagtattactctgttgcccaggctggagtacagtggcgtgatctcagctcactgcaacctttgtctcccagggcctggtgattctcatgtctcagcctcctgagtagctgggattacaggtgcacaccaccactccctactaattttatgtttttagtagagacaaggttttgccatgttgtccatacaggtcttgaactcctgacattaggcaatctgcttgcctcaacctccccaaatgctgggattacaggtgtgaaccgctgtgcctggcccgtgtttcactttttgaggtttcagttacctgaggtcaacaggcatctgaaaatactaattttgagagagagagagtgtgagagaccacatttacataacttttatacagtacattgttatagttctattttattattattgttgatctcttactgtgcctaatttataaattaaaatttatcctaggtatgtatgtataggtgaaagcatagaatacatagggtttggtmctatccagttttcaggcatcactgtgggtcttggaacgcatctcccgaggataagggggggctactgtcagtgtgaacctgattagatctcaactgaaacttttttgtcacatgaggccatcagttgaatttcatgcctgcatgtaggtttagattttaattacttttttatggtgtcagcataacaaatgagagtcatacaaactattgtttaatgacaaagtgggtcaaacccataattaaaaaaattaataatagatttttgttctacttgaggttttgtagcattacgtaaagcttgaaaacttggaaattgttttacttaaaacccaattaaaataatttgatcttttgcttttacatcatagagtggcacaataaaaattgtaatggaagatgttattttacattttttttctttttttttttttgagacggtgccttgctctgtcacccaggctgtagtgcagtggcgtgatctcagctcactgcaacctccgcctcccgggttgaagtgattctcctgcctcagcctcctgaatagctgggattacaggcgtgagccactatgtccggctaatttttgtatttttcgtagagacagggattcaccatgttggccaagctggtcttgaactcctgaactcaagtgatccgcccaccttggcctcccaaagtgctaggattacagacactagccaccatgcccgggggtgttgtacatatttcctttaatctaaaagcagaaccatctttatatatttttatttttttccactagagggctctgttgccctttgatataattaaacaaaagaggcagcattgcaatatagttctgttcctctcagtccatcttgctttcattttggttaaataatgtcttttacttttctaacatatcttttaggtcttctaattctctgtgatgaagttcaaactgaagactgttactagtgtcgtgtttgtttctttttctctctcttttgttttgtttgtataaaatgccrgggatgaagggatccacttaataaaaaggcccattgtgttcagggagcagcctgttctgccaaatcacacaagggcatgtgttttcatgacattattgcttttgagtgtgctggcctagcaataatatgatttttttttcctaagtggaaattgtaatatttaagtattaatacctctgtttaaggttcattttgaacgccttggtgaccctatgtttttttctttgttttttgttttgttttttttttttttkttttttttttttktttttttgagatgaagtcttcctctgttgcccaggctggagtgcagtggcgcattcttggctcactgcaaccttcgcctcccaggttgaagcaattcttctgcctcagcctctcgagtagctgggagtccaggcacctgccaacacgtctggctaatttttgtatttttagtagagatggggtttcaccatcttggccaggctggtcttgaactcctgacctcatgatccacccgtttcggcctcccaaaatgctgcgattacaggcgtgagctactgcacccgcaaccctatgtttttttctaagaatatagtgtcccttgccccctgctacaagccttacccagtgttacataatttattgtaattaaattgtttattaatgatacattcttgctgtagaagaaaacgtgtccttttgggctcagtacagtatatgtttcttaagtaagagggatcatattaaaccagctacttaatgtgaagcagatagccagtgttctccatgtacaatcttagggagggtaatttttgttttggctgtgtaattatggtttgaggcagcccattaatcgcatatttcagctgtcaaatagaaatttggcccagaaaggaatacactttggctttacaaaactgcttattttcaaatttttaaatggggacaaaaacgaatatgctatattatatacttttatttatataatttttttttcagcaactttttctcttttgaaaatgcaagagcctgaaaaacattgtgaatatacttgtaacattgcaaagctatttcaccagagtaaagatattttggttgttcatatacgagtgtgttcgttgtttatctaataaattgttaaaactagatggcgattctgggaattattatagacttcataataaataagatgctgacagttgaaacccccttgaccgttgcctgtttggtatgacacagaccttcttggacttttgtagcctatacatgagyagatatgaatcctcagccttctccaaaataaggttggggtcactaggaggccttcttggaaagatgtcttaaattaaggcaccagtagatggatcaaaaagcaggttccaatagctcgcttttagtttcttgcctaaatttgtgatctccctttggcttcataaataacggtacatttcatgaagagctggtctcagtctacacaagcctaactgaatggggtrcataggaagggttgcattgtgtgacaaggtttaaatctaattgttttaagtctttgagttatttgctcaccaggctgtgcttgatggttttactttttgtgatttttggagccttcatgttagaagccatagtcatatggtgctctctgaaagcaagacaaggtttcttcactasactctaagaggagatctgagacagagagatgggggcggggaggaaacctatttcagtgtctctactatttctacctaggtggaggataactagccagatgaacggagctaagccttttgtatgaagtttatttcwtataaagaggaacaaaatcagaatcaaatttcttctgtagttgcacagaaactgaagttaaagctaatacaatgtttttcatttttacccttacctctacaatgtacttaattgttacagattcgtatttattgattatcatrttgtattacattgatagccgtttaaaatttatgaagattccgtacttgtcatatttaattctcagcaccgtgcttacagctgtcttgtgataatgtcgaaaggaaagagaagggaggtgaggtaacgtgcttgagatcatacaggtcttgggcggcgggtgcctgcaggatagatcaaagggtaattgagtctgtgcctggggccccttccactgtacatgccaccatcctgttgggaggaataacagcacactcctgaatgagctctttctaagcagctcattcattttgttaatcctgagtttggaatcaaccaatttatttaaacccgtgaagcctcgctctgtgcccggtcaagtgctgggagtggcatctgyggggagggccaaggcagatgtcatttccagactgcattggatcctggattcagaagctgaagcttaggagtgggcatggtggttcacgcctgtaaacccagccctttgggaggctgaggcaggaggattgcttgagctcaggggttcgagagcagcctgggcaacatagcaagaccccatctctaccaaatcaaattttttttaaaagctgaagctttctttaccaaaaccactttggtattatgattgtaaaacaaacattaaggaataagtctgggggaatgggaagtagcattcatcaagcgcctgtatatgccaggtgttaggctagattagcttgatgtgccttctcatttaatataagtaattattttaaaggttattgtgattaacatgtattccttatggaaaatttagaaagcgaagaaaaataaaaayaagaataaaagatttaaaaaaaccccaattcttaccagttagaagtatactattaatatttagcatgtatgattgtaagcatgttttcccttctttcgtgatttttctatttaaattgtgattatctttctgtgttgttaaatactccacatcttaaatggctgcatagtattccattatgtggttccagctcttctcccagtgtggtacattcgggtggtttccagctttttaatagctgtggaatggagaagcacattttgtaattaaatgtttgtacccatccgtgactcttctatagttttattttgtggaagtggaattgctgaatgaagtgatttgctccccaaccttaatatcttgatttgttttgtcaaactgccctggaagattgtaccaatttgaatgctcctttgcccagcatccttgccaaacttgagaattagaatttttaaaaaatatcacttaaatttgcctatctctgatgattagcaagattgataggcttttcttatgtcgggccatttgttttttaacgaattgccctttcatcttatatgcatgactrttggatatgtatcgattactaattgattgcttgcctcatgtgctatmatttaattttcaaaatgtcccttagaagttaatttataaagtgtctattactttaagtacctgttcaatcctgtgatcaagaggaaattcacagagaaagaaattggcctaactcctcagtttgcttcactaaaatcttttaagcacacatcttgtctattatgccagctgcaactcaaatcaaaggcactgttgctttggtacccgcatttaaggagggaataccccaaaaaacttaaacttgtctggctttgcaatggtggtggagtcccaagatgacacagtaggcaagatttgattactttggttatgcaaatttcccctagatcttctattaatgacagtaacagcgcttcagagcttttctatgcattctctcatttgatgagcctgctttcaggtggagaaattgtaccattgctgaaaatagcttcgctgacagttagggcaagcttcattggtagcaagtttctatctggaaagatgtaggasaggaacactgactctggaagcagacgtgacctagttttgaaacctgggataaccacttcctatctgtatgacccgagcaagttactttccttctcagaactcctgttccacctctgtgcaatatggacagtactcctactttgcaaagttgttaaagatgggaactccagagtgcccagggaattgtctactcatcattgcaggcgtttaataacgtgtagccatttctggaatgggaggcaagaggatcgagttaccagtgaaattagtttggtattttcctagcttcctggttcccagatcctcaagaggctgccataatctctgtgaatttgtcctaaaatgacctgtataaataactgctttagacactggcttgtctttggtatgaaggaaaacattttagaatttttttggctggaggtcagtagctttcatccagaaaagaataatcaacggaaaaaaaaaaaaaccaccgagacgaggttatttttgttacagtcaaggaacaaaaagggatatattaaacttgggggaaaaagagaaggaaaactattattctttaaaaccgttataccatgcatcatggtaacatcttttttactgagagttctgcattagcacacttgttcacccaagtttgtgatagtttataggactgcctggtgtattaagtagaaatgctcaactttgctgtcctatttttttgatcatatccaaaaagtgtcagtgtttgaatatagttttattgccacttaaaaaggtaggacagttttattggcgtctactggacatggtaggaagagagctgtaatttgacacagattgtccttaacttgggtgacttaaggcaagtcacttaaccatctgagccttaatttcctcgtttgtaaattcaagagaataataacttctctgtcacatactgttttgtacagatcaagtaaaacaatgtgtgaaatgctgtaatgaagaagtccaatagtgtatgaatataaggttgctggcgtttggggaaaaatcatagttatagaagaaagactcctaaagggaagattagggttggaagaagatggaggaagagagtaatttaattccttaatggaaagaataaaataagagctcttgacttttttttkttgttgttgttaggatatggggagaggtttctgcaaatatcttcttcagggtttacgaagtgaaccggatgtccggtaacagggttgcatgtcatgcaattgactgggtggtgatgactaaaattttaatgatgcgatctcatttaaagttgacaggctctgactctagccagatattcaggagcagaaacttgattcaataagaagggaacctgcagaggcagaaacttctgtgggttgcagttgtgttgagattacacaggtggaaatgttgcgagttcttgggtgatgcgatttcttcctgcttgccttaagtttcacctgcccaggtccttacttctgctcacagtgcagcacgaatttagatactgattggggattcagacacaaacgggatgctccttgcttatataacatcaacagaattgctggccacatcttgattatagaaactctttttcctggtgatcacacaaagcaaaagaatgaaaataatcaatctctttcaaatggagagactccgctgtgtcagccaccattggctataaggatgaactctcaaaactttttgtatcttgcaatataatgtcttccaactgcctttgattttactgtgtggctgtgtgatacagcaaggcagctgtggcttctaaattcagcagctaggtttgagaagcttctatcagctgagagatcatcagtacattccaaatggcattaaaaatgctgttacagctttatctattagcaaaggaagtttcaattctaagttcacgtacagttactagattgagtgtttgacaaggtagagagctctgtagtagatccatatggggaacatctcagtcagggtgtggagtcagatttttggcaagggataccatcctttcagcctgaaaagctgacttgggagctgtcagcctgtgtgcacgaggacctttttcctcccagggttagcgtcgccacttgcccagtgtttcttttttatttcctgctggcctgatccgggagggatttgggaaagctagtcttgttggtgtgtcatcatcgcgacgctgttagtgattgacttacccgagtgtacacatgtttgcatctcacttgtatgttccttacatgtttacttaattattgggaaggtgtattaatgtcctgttgctrctataatggaccaccacaaactcggtgcttctatgctgcaaacctaagattataggcagtcataacacagtgttaagtatttgtgtatctaaacatagaaatggttcagtaaaaatacagtgttgtaatcttatgggactgccgttgtgtgtgcagtccattgtcatgtgatagtgattaagggaggtggacatttttgtgtttgcttatttccataagctcaagggtaaagcttcccaatcagcctttaggacagaggtaagaactggttggtggcctggagcctggatctggcctccagatgttttttgtatggaccacacaaaaatggtctatagtgggattttttttctttttttttttgtcagactacttgccagcatactaaaatcaggatattttacttaaatgtagatttatgacagttttgaaaaatcagaatgagtattgkagactaaatgtttatgtcttccccaaaaattcctatgttgaaaccctaatcttaaggtcatggtatttggacatggttgtgtccccactgaaatctcatcttgaactatagttcccatgatccccatgtcttgtgggagggacccggtgggagataattgaatcatgcygttctcacgataatgagtgagttctcatgagatctgatggttttataaggggctttcttcccttttgcttggcacttctcttactgctgtcatgtgaagaaggacgtgtttgcttcctctcctgccatgattgtaagtttcctgaggtctccccagccacgtggaactgtgagtcaattaaacctctttcctttatamatttcccagtcttcgatatgtccttatagcagcatgaaaacagactaatacaggggcctctgggaggtgattagatcatgagggtggagccctcataagtaagatttgtgccctgatgagaagaggatagaaaggtagctaactttccttaagctatgtgaakgtgagaacacagtgggaaggcagccatctgtaactagtaggagggccctccccaagaacgtgaccatgctgccaccttgaccttggactttaagcctccagaactgtgttaaagaaatgtctgctatttaagccactcggtccatgatattttgttgctgcagcttcagctgactatggcttatgtctatcaaggaacatagttgcactgaggttgaacagagctgttcctataggctgaccccctgtaggcaggcacaggctattttccatggtcagtttacctgcctgcttcctgtagaggcttgagcttggtttagagtctgcaatgaaaactgtgtgatgatattggactcactggctcatagccactgccacgcccttattcagtcttttgtgcaattaacaaacatttattgactactgagtaccaggtgctaagacttcagtgtagaaacaggcagggtccctgcccttgtggaggatacaaaacacaccaaaatgcagtcagcttcactgaatgacagagatatgatctgagaagtgtgtcaggcagtgtcatcgttgtgcgaccctcataggatgtacttacaaatcctacgtggtataacccattatacacagaggctgtatgggatagcctgttgcttccaggctgcaaacttgtatagcatggtacygaactgaatactataggcagtcataacacaatggtaagtatttgtgtatctaaacacagaagtggtacagtaaaaatacagtgttgtaatcttatgggaccgccgttgtatctgcactccattgttgaccaatgtgttgttatgcagtgtgtgactgtaccagcagcttgatctttgtgcttctagagaacatttaaattgattcgcttttgtgagacagggtcttgctctgtyacccaggcttcagtgcatcagcgtgatcatagctcactgtagcctctccctcctgggccaagtgatcctctcacctcagcctcctgagtagcttggactacaggcatgcaccaccattcctggctaatttcttttgtatttttaatagagatgaggtcttgctatgttgcccatgctggtcttgaactcgtgggctcaagcagtccacttgcctcagcctmccaaagtactgggattacaggtgtgagccaccacatctggcgaaactctgggtagtttctaattatttctgtatttctatttgtatttaaaagtacaggatactaaaatgttttttttttcttttttgagatggagtctcactctgtcgcccaggatggagtgcaatggcccgatcttggctcactgcaacctccacgtcccaggttcaagcgattctcctgcctcagcctcctgagtagctgggattacaggtgtgtgtgccaccacgcccagctattttttttgtatttttagtagagatggggtttcaccatgttggccaggacggtgttgaactcctgacctcgtgatcctcctacgtcggcctcccaaagtgctgggattacaggcgtgagccaccgcgcctggcaaggattttttttttttcatacttgaggaaacatctaacagcaaatatgttcttataagttaaaaagaacttttgctattttgaatgacactctcattaagtcttactactagtctctgatttttcttttttctttttctttttctttttttttttttttgagacagagtctcactctgtcgcccaggctggagtgcagtggtgctatcttggctcactgcaagctccacctcccgggttcacgccattctcctgcctcagcctcccgagtagctgggactacaggtgcccgccaccacgcccggctaatttttttgtattttttagtagagacggggtttcaccgtgttagcaaggatggtcttgatctcctgacctcgtgatctgcccacctcagcctcccaaagtgctgggattacaggcgtgagccaccacgcccggccttgatttttcttaacctttatttccaattatgcatcttctgagtaactataaagaaaagcaaaatctacrgtaggtatggagtgagtgcagagtcaccatcagcttgaacaaatgtgtgtatctgtggtcaagtttaattgcttcttctgtaatttatattaatcacgcttccattgcttgccttttgttaatacgtatgcggccatgtgatgattttttaaaaggtcatccagtatcttgatgtccagtccatgcttataacctgagcagtttatgtactcttgagatggtatgtgctaaaaatgagtagctagtctgagtggcagccttacccattttattttgtgggcagatttcttttacagttctggctgggtttcttttagttggcttctttgctttgctcctrttacgacttagccctgtagctctgrgctcttcgattctcacgtgctgatggtgtagctgagctctgctaatgctggttattaatctgacaatctataccagggaggttttataattgccataattcttatttgctccattccatttcccagcttctcaaatggggtggcagctgcaaagcacagtatttgaacatgaagtagagaatcgtcacttcagcttatgattttacattctgtcaaggctgcagggaaagcggtcatgtttctggatggtatttggatctacaaattccaagcaaactttttacttcttattatgtaaaatggaagggttagccaaattaagatctcaccatcaaccttgagggagtgacttctacatgccrtgtattactggttataaagctagtcttgtttggattgaagaatttaatcatatttaacttttcaaaggatgctttttaaaaaaccttatccgcgtgttatgtttaaactgagaagtacctgaaagtgaaaattttatttatttttactttttttgaaagatggagtcttgcactgtcacccaggcttgagtgcagtggctcaatctcggctcagtgcaaggtccacctcctgggtaaaggagattctcctgcttcagcttcccaactagctgggacaacaggtgtgtgccaccacgtccagctaatttttgtatttttawtagagacggggtttcaccatgttggccaggctggtcttgaactcctaacctcaagtgatctgcccgccttggcctcccaaagtgctgggattacaggctcacgccaccatgcctagctgatttttgtatttttagtagagatggggtttcaccatgttggccaggctggtctggaactcctgacctcaggtgatccacccgcctcggcctcccaaagtagtggaatcacagacatgagccaccatgcctggcctgaaataatttcaaattaacccctgaggaacaaatgctcatgactttcaatgaatagaaaaatcaractgctagaacctccagactgcatgtcatgcrtagaagtagaatcctggggaagctagctcacaaaagcaagggagatacctgcaaggctgagctgagcttgcaagggaagaaaaatattagagagttgtcacatttagaaataagtgattccaaatttacagtcaatggactgtagatgccttccatcttcttaagagattttgtgcctcttgcacaggtattatccctaagatgtgttttcttcaatgtacctagactgtttccttaaagaattgcttttgtatggtacggctctatgtgtctgtgtttctcatgttggttaggagaactaacccttgtgacgaataagaaatggcaaacattgttaatgttgactttactagttgctcaaatattagcattggattttagagtcaacatgctagcaggatggctttattttaaaaccatgtgatagaaagctatctgctattattgatagcatttctggatggctgtcagaagtctttctttagaaatttaaccatatttttaatggtgggcattgcagtcaacaatagtacagactttgcaaagactattttttttttggggtgcagtgaatacttcgcaatgcctgctgaattttacctattctgtaagtctttttgggaaccgttgagcccctcttctcttagttgcctttagcctttgtttttattatgacaattggtatgaaatttttccttttcattacttcttttattcagagcacacctctggcttatctcttcattctctgtttagtttcatattttactttaatttctgtacatcaatatctgccattatagtatttaagctcttggaaacatcaggcatttgttaacttgttgagaaaataaagcactccactgttgttatgagctgcttatggcaagtgaaaaactcacaatatttggccaaacttgggatcatttaggtgttgtttgcaattaatggcaggagatattttccttgttgttaagagtataacgttggttttagaaagcttgatctatgtttttctccatgttagatgtgaaaagaaccaggagagtgtgaggatattggtaatattgtcatatggtgatcccactgtggatagatacgcaagagagaaaatccagaagaaagcatttcactgaagcctggggacatttctggtgacaaatggtgctgatggcacagtgagaacgggagagggcagaagcaatgcacagatagaaagggtgtcacctgcgcattgaaaaatcccagtgccataacaatgcagtccctgcaatacagacaaacctgactcccaccattcctgtaaatgaagatggggccttgctgagaaatagaggatgcagattccaccctcaggcttcccgtcttgggatgcagagaaaactcacccacgtgcaacaactcaagagtcgttatttacctagcaaagtgttcacatgacagtgtttgaaatgtaccacgtgccttttcatgtttagtttagagcttgacactagagctctactgtggtttaccaagtgtgagggactatttctttctgagaaggaggggaagctttagtttccttgaatgtctaatagagtctgagtttccttttagaagcataaaagacgtacagtaggcagaatctggatttttaactatacagttgctgaagttatcttcaattcaaatcttctaaattcaattttgttaatgttgtttagatattattatagaagccagctttactgacttctgcacatttaatcataggagattcttccattctgtgaacttagatttcttttttctatccatgacatttatctaaatcaggctttcttttctttctactaaatttttcaattaccaataggctatgagaataattagactgacagtattactgaaaaaaaaacaaaacaacaacaacaaacaacaaaaaaaacaccttccactaaaactgactcaaaaagataatagcagggaaaatgacatgtcgrtctgtgattccttttttacttgtcagtccttttgggagttgaacatataagcacatgtacctctatgtgacttttgagacgtctagaatagagaattcacctttgtagctggaatttattcagcatgcaaatgtgggtgggtgattgttttatagatgcctggtgttgaatgatgggcagttgtgataactatatataaaattatattaaagtccaagaggtgcttttatgaggcaggctggaaatggcatccgattttcttatggctttttcatgtccattttgatgaatctatttattacttctataatgagtagtacacatggttggttagccaagttattgaactttatcaaccttggctgaaattcacaatgcgtgccaaacttgttgtaacatgtaagaaattacatctgggctaaaaggttcaataatgattactcttataatggaatcttctacaaagcaagggatttcatgatatscctatgcttttaaaaaattattgtgatacagtgaaacaaggaagaacgtgtagctggaaaaatagtatttgcttgtaatatacattcagattcataayaggcttatttgattcccaggacagggtgagcaaaggatgctgtttcctgggtgtctgctttggtgttcattgagtcatgtctctctctttagaccttactggatctagtcttcatcatggggcctgtgagctctttcaaatctagaggacaaaacctaataaagtgctgtcatatcacatctgtttatgagtttcaaactgaaatgaaatgtgtagccgtgttattcttaaattacagagacttgaggaacgtagagctttttactctcactagagaaatctaagcacaggttggttcgttaacctgtaaagagatgtttgggttttaagaggtctatcaaataacacagtttccctttcccaagttactacctaactgagcagtaagaccacccattaggcaaatggaagaccaaaacatcacctgagtcattcatgaagctgatactggagaatatgtatagctgtgtgagctggtgggctttctaatcctgaccaccacaattagacagggtaatgggtcagtgctaggtcaggccagaccttcgcagagggcagaccccattcatgcagcatgttcaagacagtgcaggagagcagggtgtgtgctctctgtaagaggagaggagaggcagagctgcgtgtgcccggttctcaatcctggaattaccattcacataccattcacaacataagttggatcagctcccttgagcaggaataagtgagtggcagagggggtcagggatgttaacgcaaatggagatcccttcacccagaaagacacatctgaaatggagaagatgcytttttcctcctgcaaccaataagagagtgatgaaaattatgacgccttgggaaataagactgcaacgtaaatgtgtgtccaccccctagttttcttttggattgtgaatcctcaccctccgataactagacgtgctgttttgacgtctatgctttccagcttgccaattctggggcctggcacagtatctttcaccccggagtctcagtttcctcatctgtaaaatgggaaccatgacgtcrgcatcacagagttgtgagaattcgacaaggtggaatgaaagcaactagtgtggtgtctgaccgcttgtgttagtccatgaggaatttccttacgtattgttttgtgtctaggaccaagttcttattttcttcttatggatgacttcatatatatgccgccacagagggaattaccgtttttctttgtaggtaaaaaggagctgggttaagatgcaccgtcatatgaaacagggaaaaagggtttgcttgggttttagattcctgaaacagtctgctgagggattctaaagttgttgtggtctctgttccactttgggagtttgataaaaattggcctgttttatttgacagctcttaggtagtgtgcaaaattgtcaacagataataaaagttttttgcaaagctatggctctatgtgctgtacttgagcagtatccatactcttaatagaattgatatatgaaagcaggtctttttccttatccgtttagacctaaatcttatccatagtgtgtggatatcacaaacagcacaagaggaagtgaaaggaacagagtgggtgagcaaaccattgttcaaaggaaacagaacctcgctcaaggaaaatgagaattcttctgatcagcttctataatggatgcaatgaggaaagttgtctagcagactgttcttggccaactgtctaaatggctcgctgcatcctcttcacgagagctgatggtaggactgtagaagagtcacaaaacatcacatgacaacgccagtccctctgataatcctgcaagagccagcccagttttgctgacagcacagtctgctgtttaattattgtgtgttcaatgacttacctctttttagtttaattraaattatttctcagattaagagccatgctatgatgcttgccaacggatatttaaaacatgtaactgatttgttttttrtaatgcttcaggagaactcagttgagcagtaaagatgtgctcgtgatgtggttagctcagaataaggatgtgaaaaccaaaagggaaaggaggacaggagtgaatctggcacttatctttcagtggggcctgagtgcaaattcttcctaccttccatatgagagaatagggaaaattaaagaataaatgtctctgggtttaatgcaactttactaaggaatgaaagtccgataagaatccrtatcttttgaaagaagattttttaaattccttatttttccttcctgcatggtcataaaacacactggggacagcccaccctgagaagtcaccaggcatctgcctgccttcagtagcaatcacccaactgctgtagaccgtaatcaagctttcaagaaccacgtgcagcacgctgcgggagagtcccagcgaagtgcttaatgcgccactccacggatgtgagtggggagcaagtgctcaaaatggggcttctgaattgcaatcatcatttggcatctctattacctacagctgctcaaagatgttccccccatgcaactgtttcttgcaactcctaacatttgcaacgaggcctctgatgcagacaacccgtttatacctctgggtggttgaaaccttcatggtttgttgtaaagaaaggtacacagtcccaccaatcagaccgtatctagaatattacgttcatttaggggtggcgcatagacaggctaaaggatggcaaagtcattgggtcatgtcctaggagcaacccttaaaggaagagtgaatggctggttagttggtagaagaaaagatttatgtaaattagttctctcagtagctatctaggagagagataatcctagctttcttcaagggacagaaccaggaccaatggacagaatctgcaaggaggcagcatttaactgattagaattgtcgggggtggggttggcgagagggtgttgcttttctaatgattcacattgtataaaaagcagacagtaggtctggcactgttggctcatgcctgtaatcccagtactttgggaggccaaggcaggtgaatcatgaggtcaagggttcaagaccagcctggccaacatggtgaaaccccttctctactaaaaatacaaaaaattagttgggcgtactggcaggcgcctataatcccagctactcgggaggctgaggcaggagaattgcttgaacccaggaggcggaggttgcagcgagctgagattgcgccactgcactccagcccaggcgatagagtgagactctgtctctaaatacataaataaataaaagtagagagtaagttttctgtattgaaaatgttttaagagttctttgtcttaccttaggttcctccaaaaacagaaccagagaaaaagacatatttatgcataatttgggatgtgattacaaagagagggatggggaattcaggaaggaaggagaggcaatataaaaatgtgttttttagttagtcattactagaggcaactagtgctcaactccaggcactttaggaaatgcatctcatagctgtctgcctgcggaataaagggcatttatccaccggcttctgaccccgttggacaagggcgtcccataagttttgatgtcccagaattttgggtttgcacatgtgcaagtgccaagcaggttcttgtaggcatcccatgctgcagagtcagagaatctctaggatggaaatggggggatccatattgtagccccaggtgaggccatctggttgcatttgtgtcaagttggttgaaaactgcatggtgggcgtaaaaatggtttgagtaaaatggagctgtgagaatttgaaggggtgcatgagaggtgcccgatacagtccaccccctgcaccatgctcaggtctcttaagagtaagcagaatctaccacagtgtatccttaaagttaaaaggctctctgatgggactataaatgagtcccagtttgatgaattctggggctttagccttttctgctgtggtattagttttctggggctgctgtagcaaagtaccataaactgggtggcttgggacaacagaaatttattgtttccaagttctagaggctagaagtctgaaatcaaggtgttggtagggccatactccctttaaaatgtgtagggaaggacccttccttgcctctttcagcttctggtagccctagatgttcattggcctgtggcagggtaattccagtctctgcctccatctgcacaagccattctccctgtatcttttcacatcatcttccctctattactgtttgtctctgttttctgatctcctcttcttctaagggtgacagttttactgggtgagagcccaccttaatgccctcagtttaactcgatgacctctgcaaaggccctgtttccaagtaaggtgacattctgaggtactgggcttaggacttcaacatatctttttggggggacacaattagaccaatagcaactgtgctataaaagagatgttgctttttatcattgatgctatccagatgcatagcaatcattcaacaagtcattcgaaagaaataggtatttcctgagggtctagtatgtaactcagctctgctctaggacctggtgattacagcagtgaacaaagtgctcctgcctacgtgcagcttactttcttatggagcatgattttcagaagtaattgttcttttgcctcgttatcatcagacattaggaaccaaggggggattgcctgcttttggatcacagagcaagctgccttgagcaagtgagttcgaattgcaaaggtgtttaagcatagcttggtggctgcttagtgaggatgttgcagaggcaatttaaatgccgagcagggctttgggtttgtgatggttaaagtccatttccactgcggagatggtatgattgtacaaatggacaggttctgggcctctgtctgttttgtcaagtatacaacacttctgtttatctttaaagggaacaaatagtgttttcacaggtctctgcttaaataaaaagattctagaccactggatgtcaaccccaccatcccccttcttttttttttttttttttttgcatcctgtactcctttgagaatatagtggaacctctggcccattctacaagggaaaaataaatgtattcctagccaggcatttgtgtacaattttgtaggggaggaaaggattgttcatagacactgaattaagaaatccctacactttatgggaattgtaatcattagtagcagttacgtagacatacttccattaaatacacatacttgctttagagagtgtgtttattcataaaaattcattgaataggattaggaataaaaatatgcatagaaatatttgttactttttcattgtaatggttttttttggatagaaatttatcagtgtgtaattaataaagtagtattgatttcagaattatacggtgctaaacaatggaaatttcctaaataactggcaggtaatggaaaaaaaattcagttactgacagcctgtcatagttgaatctaagagctaggggcaaaatacatatattctatgtagtttccatttctagaccctggatttctaaattcttccttataaaattttaaatttcttttttttttttttaaagatggtgctccctaactgatttccttcattttattatctcataacagatttgattttcacaatgaaggtaattattaaaatgcttcctttggtagtcaataaatataattagtttaagaaaactagaaatatttgttattagaattaggtgaacatctaagagtcttatttatggaagcaacatggtcaatatttatggaattgagttgaggctttgcaacactttcaacagctttttaaaaagcaaaatagttactgcctctgtggaaatagaaattacccacctattatgtaatgaaaaactaatgttggtttacttaaaacaaaactgtgtagcagtgtgttatagccacaggaactcctcagccaaatgttaagttaatgcaatgaaaacatttgtaaaaacattatcaagctgcaaaagaactagaaatgctagatactccctagtagctgggtgttcaaaaacacttgtcattctcacagttatatttgtggtatcttagtggtcattcaccttggatgtgattcctcaagtatgccagaaaagcatcgtcttgtgcaagtgttgtatttaggaagaactttgtgtgaaatcatgattgtgggtgaataactttaaataaataaatcgttttccttgatatacaatattgtgctactttccacagaaagatggaatcaatgctcttgactgtaatggaggtttacagtttttctaatttcttatttaggctgatctgagcaaagatgttcaaatttccacttatttaaacaagatagagtttttgctatgttgaaggaatatttttagcttagtaatttacttagaaactgccttattcaatattcgatgttaaatttgaactaaaacacatagcatcatatgacatggagtcttacattcacattttgttggactggaaacagaatcaacatattagtcatcttaattcatttaagttggctttctccagaattctagaatccaaaaacaacacatttgtcagttttacacacaaaaggagaggcaggatgtagtttatagttaaacatccagctttgcaatgaaaagccaatgtagctatagcacactgaatgaaattctgggtgaaacaaactgtgtaataagattttgatgcatattgaatacttagaaaatttgttttatatttgttttaatgagattctctttatatctgctttcatagaaacttgtaaattgtctaaaattaaattttctgtggttgtcatccacatgggttctgaacttgctgttataattattcacattttcttgcagtgaaaatctacagrtcaaggtcatcttcacgtctttagttcttgttttgcttcaggtcastttagaaccgaatgttaaaaggatattgtctattcgaagggtcagattgtggcacgtggaccaaatccagccccccgaggcccacttttgtaaatcaggttttattggaacacgggtgctcatcgtttacatatcgcccatggctgctttcacatcataacagcagaattgagtagctgtgagaccctatggccagcaaagcccaagatatttactgcatttatttactgtatttatgtttattctcttgccctttacagaaaaagtttggcaacccctggtttattctgttaacatgtttcctatataaggattcctctaataagttttcagaattattaagaaaacaaagctcattcctctaaaagaattggtatgtttttttttttttttttttggtggtggttgtttaatgaggaggacattataaagtattatatttcgtttccttaccttggttgccaggaagctcagaactttaaacattaaaatgtttaagtaaccagctcacttcacgtttcggatcagctttctttttcttaacacggggatacattttcactttaaaaaaaaatcaactttttgaagcataatttacatgttgtaaaacccatacatttaaatcatacacatgaaggtcttgacaagtgtgtacacacacataaaccaccaccccagtcaagataatagaatattcacatctgtaagaaattttccacctgccccttggctcaggcaatttgtcagtcttactactgattattgcgttattttaaaaccctgggttgtatgcaattgtctattacaagctgttttaaatagttttcggtagtggctggggcactaatgattaatagttgaatagcacagctggagaagttaagattcatttattctatttagtcttcagtacaaatttttaggtttccatgggagaatctgagatacagctcacatggagagccttttagctaatgtagcaataattaataagctggatagcctgatagcctgatgttttattagggtggtgcaaacgtggtttttgccattactatatatatatatatatacacatatatatatatacacacatatatatatatatatatacacacacacacacatatatatatatatatatatatatttttttttttttttggagatggagttttactctgtcgcccaggctggagtacagtggcgcgatctgagctcactgcaacctctgcctcccaggttcaagcaattctcctgcctcagcctcccaatagctgggattacaggtgcaygctaccatgcccggctgatttttgtatttttagtagaggtggggttttgctgtattggccaggccagtctcaaactcctgacctcaagaaatccgcccaccttggcctaccaaagtgctgggattacaggcgtgagccaccgtgcctggcctgccgttacttttaatggcaaagataattcttttaataattaaaatttgaaataattcttttaataagaatttgctgcttgccaagagctctgcagttattttattcaattttcctaacagctcttaagagtacatcttattattcccctttcacagatgaggaaattgaggttcacagaagttaagtctattagtttgctagagctgctgtaacaaagcaccacaaattgggtagcttaaacaacaaaatttattgtctcatagttctgtaggccagaaggttgaagtcaaggtgttggcagggttggttccttctgaggactgggaggagatacctgttacaggcctctctccttggcttgtagatgagtgtattagggttctctagaggggcagaataggataggtgcattaatatttatgaaggggagtttattaaggagtattgactcccacaatcacaagctgagggacaaggaagccagtttgagtcctcaaacctcaaaaatagagaagccgatagtgtagccttcaggctgtggtcaaaggccccaagagcccctggcaaaccactggtgtaagtccaagagtccaaaagctgaagaacttggagtccgatgttccagggcaggaaggatccagcatgggagaaagataaaggccggaagactcagcaagtgtgttgttccatcttctcctgcctgcttttctcttggctcgctggcagctgattagatggtaccaacccaaattgagggtgggtctgtctctcttcatccgctgacttaaatgttaacctcctttggaaacacccgcacagacacacccaggaacagcaccttgcatccttcaatccaatcacattgacactcaatatyaaccatctcagyaggcttcttcgtgttcacatagtctcctcaccgtgtgctgtgtccagatttccccttttcataaggacaccagtcctattggattagggctcccccattatgacctcatttatccttaattatgaccataaaggccccatctccaratgcagtcatgttgggggttagggcttcagtgtatgagtttgggatggcaggggagcagttcagctcgtragaatcgtaagattcctgatctgtttctcttccaagaaattgtttggtttcatgttgattttatctccttttccctatctgtctcaaagcactgaagaaaatcaagtcccccttgccctgataaggactttaaaatggtgtttgctaaaatggtgtgtgcttaggggcagctttgagccagataacaattctagttgcgcatgcttccataagctgtttactctaggaaggagaatctctgttgggatcttttggggagtacttgcctcccaagtgcttaggctcccgctgctgacaagaccctctgcctggsaagccstgcaggttggaatcctctgttagggttccaaagccttcaccaactcagagctctttctctctctgtttctcttttttgaatttaaattgatcctagtcacaatgttcacattacctatgttggggatcctaccaagaccctctttttggcccagaagcagcagcggggtgaggggaatgaaacaaaaatttatagctgtcgagtctccagaagtcatgtaaaatcagcctcagctggaagctcctccgtgcatccctcacattcacacaagcaggtgcctgatcacagctgatggttagattacacgtttcctgagaggtatagatttcaaaattggtgtatttcacccgtccctcatcatggtatccccaaacaaaatgttatcaaatgaaraactccttcccagctctcccttctgagtgtctgattttattcaagctcagatggcttctcagatagcktaaaaagtgatggagaatttcttttaccaattgtatgccctgtgggaacctgggtgctgtaatcactgaatatgttataaccaaaaaggtcaaactcgcaatgattcggtgtgttttgttccgtgcatcctggcatgtgaaagaagtgaggtaaagagtayaatttacttccttgttttaaagctagcattgcccrtgccttccacgcgggactgttgtggatatttgaccactgcaagaaaactcacagaagcagaaacttagggcttgctttaaatgttatcagtgtgaattgagatggtgtcagcattatttttttaaagaccaaaacaacaakagtaacaaacacacacaagccactgttagattttacaaaactttaaaaagtaattatcttaaagatatctaagatagtgatctggttacatagattatcagagatacttttttttttgattatcagagatacttttaaaaaagcaactacaaggtaaggattatcckttaatttagtgtttttctattaaactcaatttgctttaaagttttttacattttgcctcttttttgtatgtttgagtaccacttcctaaccaatcacaataaatgtccggtttggagttggaggagtcattgattttaggcaaggtgatggtgagcccacagagcacagagttaatggaactctggccgttgatgtagcttygaagcctgaatttaagtcatatttttgaaaagttgcgtcttaaaaagttactagcgatggagaatgaaaagtcaatttggacactttaaaagtgagcctcaaaaaactgctgaattttcccaacattgtgttttgagcacttccacgtgactttggtagcataaagactttagtcttttcaagaggcaaagtaatataccacttttcgcttttttaatggtgagagccaaggtcaatctgaatttttctttttctttcttcctttttttgtttttttttttttttwwwaaaaaaaaggtgcttgaattagaaaggtagcacaytgtccacatggacagtgcaggatggggctggctttttcatttctgagagctggcaatggaatgaaggtcttttttttttttcttaatttttcttttttaaacaattccctcctaagcatttcttaattgacaggggtggaaactatgttgccaagagggatcacagcccttttggtcattaagaaagtcaaggaacggggtctctttggatgagtgtgtgcgtgtagaatcctggtggctggcctgcttgctctaaatcataaagaaccctgtctcgagcagacgagaaagagtaacggaggcctcaatggtgaaaggaaatcctgtaccagctgtgaaaacaatgagacacrttcagtaatagaatatagtgtgcttacaaattcagagttgggttcccttcttctcttgaagtggctataaattaattcatcaaaataaaaaaggccaaacttcaggataaatctttctacttctaaacaaccagaaacactttggttgtcttagtagataggagtgtgagtacagaattatacgaagtgagaccatgggtgtgtgtgtgcacgtgtgtgcgcatgcctgtgtgtgtcattgsttagttaacaaaaggattgccctctgaagaacatgaacttgggccagacagcacgtgtagggggtggaattatggagcaattgttactttcttgtattaagaagaaagggagcaaaagagctgtgtcttcttgagaacctttaaaagacacagaggtctctgcctctaaaaagctccattacatttttttttttaacaggaggcctaaattttttatgttttattttgtgctgttttatttttcttcctaaggttctcagacaagtttataaaagtgccatgttggctgggcagagtggctcacgcctgtaatcccagcactttgggagaccagggtgggtagatcacgaggtcaggagatcgagaccatcctggctaacacggtgaaaccccgtctctactaaaaataacacaaaattagctgggcatggtggcgggcgcctgtagtcccagctactcgggaggctgaggcaggagaatggcgtgaacctgggaggcggagcttgcagtgagccgagattgcgccactgcactccagcctgggcgacagagcaagactccrtctcaaaaaaaaaaaaaaaaaaaaaaaaaaagtgccatgtatattttgattacaaaaaatttcatgcggtgttactttctttttattggtrgagggtctttatgttttatttttttgagacagaatctgctccatcactcaggctggagggcagtggcaggatcgtagctcactgtaacctcgaattcctaagctcaagtgatcctcctgccttggcctcctaaagtgctgggattatactttgagccactgtgcctggctggcctttgtgttggacgttaatacagttggttctttaaagtttgacagtgaagacttttggaaattaaagaaaaaaaattgagtataacttgtaacggtcatggtgtaaagatcattttttactggttggaagtatagaagtggggttaaattaagtctataattgtaaactattgatgttggaagaacatagagagaaacttattcctgtggactggtgatcccatctcacagcccttacagataaatgtttgtaaaagcaaaggacagtgttaattctgagccccaagatgaaatatcaagtaaaagagaagaacatttgccaatgcatcactgtctgggaatggattccatacagcaggtaggtttatgtaatacagtagctgaagagacctcaattctgtgccttgatgggattacaccgaagggagcactggtaggctgttgatgaaacaggtggtatttggaccacttctccctctttcmggacagctgcttagtaggtttagcttaaattatacacatgccaagcatgtacacatatgagaagcctatatctcrtaatatccacagagaatagatggcaaatcccatgatttgtatttgactgacagtcaagaccctgtggggtgtgagcctggtgggggcattccaggctggtttctcctgcctcmaggagctgcttctagtgtgtgctcttaaccctaaaggaaggaaacactgtgtcttcctcttctctcatacagagcccttcccatgacmaatgtgtggagtgttccctccttttacgtaattctccaattttctggaccccagcttggtgtcctacaattcagttttgacactaacgacccagagtcagcacagaccccatggttgagggctcagtcctacaggatcatcccctacttcaaatgccagtagcaagttcaagattgtcaagtgcacttctgactcactggctacaaattggggttcccacgaccatctcctcaggcttgataatttgctataatggctcataaaactcagggaaatatttacttatgtttacctgtttatgataaaggatattacaaagagtacagatgaagcggtacatagggccaggcatgcggaggggatgtggagcttccataccccctccyggcatgcccctctccaggcaccacatgctcagcaatctggaagctctccaaaccctatcgtttaggtttttgttgttgttgttttgagatagggtctcgctctgttgcccaggctgcagtgcagtggtgcaattatgcaatcatggctcattacagccaggacctcccaggctaaagccatcctcctgcctcagcttcctgagtagctgggactacagttgcacaccaccatgcctggctaagtttttttgttttgtttattagagacgaggtctcaatatgtcacccaggctggtcttgaactcctcagctcaagcaatcctcctgcctcggcctcccaaagtgctgagattacaggtgtgagccactgtgcctctccatttaggattcttagagaggttttgttaccctaggcatgattacttaaatcattggccattggtgattaagtcaatctccagcccctcctcttcccccaaggtggggaatgtgggggttatcaattattcacaactctctaattgtgaataataaaagactctcccctcacccacattgctcagaaaatttcaaaggtttttgtttttttagacagggtctcgctctgtcacccacccaggctggagtgtagtggtgcagtcatagctcactgcagcctccaacttctgggctcaagtgatcctcccacctcagcctcttgagtaactgggactgcaggtgcatggcactgtgctccacaattttttttttttttttagagatgggatctcactgtgttgtccaggctgrtctcaaacccttgggtttaagtgatcctcttgcctcagcttcccaatgtgctaggattacaggcatgagaccccatgcctggccaatttcaaggattttaggagctctgtgccaggaacctggatgaagacccartatgtatttcttattatatcacaatatcacaaatscacagtcacatggtgattgtggtagtktggggggcctgatggtggggtacacctgcttgaagtcaggctaccatgcccattggggtcctcccccttttttgccctctgatcttgtgagttccttaacattggggatcagtggtttttctcttacatgaaatgacaatgacactttatagggtttctgtagagaacaccttagaattagttaatgtgtttcataaagcacatggcgtggtacccagccaagagtaacactctgaagtgctcctccttacctggacattacagcatcctttgtataaatcaggatgctcaggaaataccttgtttggaataggaataggctcctccctttttttctcacttgccttgattgctctgtattaaaattcataaaggcycatgaattatcaattagatagcatttggtttgttatttttagtttcttcctatagcaggcatgtatgcatgtgttaaaaatggaagtagcgtcgacattatgaaatgcacaagaagttttcctgcccccaaccggtaactctctcctgcagtaatcaatgttggcacctgtttaaccacttttgtgtcttacgtgcacgctgttcggtactttgactttttttcttaatattataacatggaggccaggcgcggtggctcacgcctgtaatcccagcactttgggaggccgaggcgggcagatcacgaggtcaggagatggagaccgtcctggctaacacggtgaaaccccgtctctactaaaaatacaaaaaattagccgggtgtggtggcgggcgcctgtagtcccagctactcgggaggctgaggcaggagartggcgtgaacccgggaggcrgagcttgaagtgagccgagatcgcgccactgcactccagcctgggcgacagagcgagactccgtctcaagagaaaaaaaaaaaaaattataacatggaaatgtttccttgcatctccgtatcatttctcctcattctttttaggtgtaacacagtattttgtcctattcatgcaatataatttatataacctaattgataaaacattttggttgattgcagtctgtcgtagataatgccgtactgaatattmctcccacatatttgcaagtctatttgtaggataaatttctggttgtggctgggtcaaagagcatgtccacttcaaatttgatagctatgtcccaactgcccccaaatatgttaagccatttcctatcccccatccctcattaatctatgaagttgcctggttgccccacatctttaccgacaggactgccgctcaatgtagttacccttgtagaatctgtctgcatgtgcctgtctaggaccatgttaattgtaatctttgggcatttttctcactcattcctaaccaggactgtcactggcaggttaaatgagaacttattcacccagcacagtggcagcactagtagccagcctggggtcagtcttgcctctcgagagatctcatgcagtcaactgggatttattgtacagctttacaaaacattacggcctcagccttgtactgcccaaagcatgcagatgccgcctggtgtattttaaagatattccacatgaactgacccgtttcccacttcttgagttggtatgttttttgattaatatatttgagatgtatttatgttattagggctatttaggaagctctgtagggatttgttgcttgctgtatataacacatacttttaaaaagcagggctggctatgacttatttttctctagagagacctgtgtagttttgtaagttcttaagatttggcagctgtggatcgtgtttagtaagcacgatctctaactctttggaactcagaactatgtaattgaaatggcctgggaggcaartgtgatcattcaggtaatcaaagtaactacagaaacagaggtatggattagctagtcattgcagatgtggcattgagcatatargcgtggtgtacwtcttagaacttcatctggaaatgcctgtgggggagttggatttcaagatcatcgtcaatgtcatgtcactgtaatttcatttacattaatcagattagtttggaaagtatggtcttcctacttttaggaggatataggagaaactcatccttaaagatagtagtctgttaatacaaaaacagtccccacatttgcattgtccccaaatctaacccaagctgaaagacattaggcctatcttcttgctttatgcataatggcagatctccagggagggagaggatgtgtgctggaagattctacaacttgttgattggttcctaaagatsgttttagtgctatgtttgtggggcggggctggagggggctggaaatcaccatctctgtggccttttaattgtgcccagttacaagtaacatttgtccccagtgtttcacaattataaattaataataaccacccattagaaattacgggtattgtaagccccaactcctttgggcgtcttaataaaaatgataattaaaaccataatttacagtaaatggggacactgcccaagtacatccacaatatggagaaaattaaaaaacttaaaccagaaggaaccttcctggcatcggggaaagaagctgcctttttcttagctcctacctctgtgggagctttgtcagtatttgaggggacagrgttcccaccttcatgttttttgtgcctgaggattctgtgggcgactgtccccacctgtccagcctaccagtgagtctcatggtgtgcggctgcctgctccgatgctctccaccaccatgcccaagccatttctccctttgtgttccctgtctgggtaaacaacttgccaagctcaccagtggcccacagggcaccttggacacctagacttaggcagtccctggctttgtagattttttttgcttcctacatgattttctaatttataccttgagctgctcgggataagagggcacctcgtccatttctggctggtcacaaggccacagtatcttgagcgagtccattgtgaccactggaggtactgtaaatggataaaataataatatgaataataactcatagtgtttactccctgcctaaatccacaggctcccgctgcctacagaggagtcccacagttttcgcttgcttcatggagcttcatctctgttgtattcatgtgatttatttacacggagttgctccccaatccttgatctttttttttttttttttttttgccaagcaccctgcctttttgcttgtctgtttcgtctttatctctccttccagtaaagttcttggcccagaggttctgctgccactcartgacatttgtgaaatgcaagggagcttgcaccatgggttcaagctcctgcagatccctgagcctgctacccttgtgcttctctgtccacgcaaagccaagtgctactgcggggttttccaaggcatagctagcatcctaatagtctcacacttgacakagtagggtttgacatggtttaaataaaatctcaaccagatcagtgggagatgttctttgagattcggtgattgagttgtgaacrtatggactgagggtgttttgtggtaaggcttgagtcatgtctgtagcaaggatgtttcctgrataatgtgcactgagcatcaagtgcctgcagtggcctggcgggtaatgccagcagcacgggtgatgatcatggtcaacatgaccaactagaaagcccaaaccccacctctagctgacagtggcttctcagctaacctgtcacyacgtgggattgggcccccagtggtgtaagctttttcagagaagctacacatctagcttttggacctgtgatctccccaatgttttaatgctggcaactaattcaaattaggaaggaaggaaggaagagaggttggaagggagagagagaaagaaggagcaaaggagaaaagaaaggagagaaggaggaagggagggaggaaggaaggaaagaaaaggaaggaagggaaagggaaggaaggaagggaagggaagaaagtatgggccacacaaaacaggtctgtgggcttgacttgtcctctgatcatcagtttgtgacctctgttctaaagagtgaaaactatgtaagatagtatmagataagtaggtatttaaattactttgcaccttttccatttcatagaacttgaatgtttgtgttcaaagcttaaaacccaagacagtgagctattaagcctccatggccacgtcatttttctgattgcatctgatgtaacaagtgctagaaaaactgatgctgttcattgctttaaaacgtctttctttattttcttggtattattaggtttacatattcttccgaacacactcttgccatctccatgcagttaagctagttcaatttaaacattgtcataaagttaattttttataagatgaatcaggttattaaatttagtaaaccattgccttcattattttgcacaaactttggcactgtgcagaataggcttagcactactacatttagctaattaaactggccgtcagctgcagtattacaagagtgagggatgttattctcttgggttttatccaggactttaacagtaggtagcattattaagctttttttatataaaactccacactctagagatatggtttactataaaagtgttattgtccttcctgttaaactatcatcttttgaaatagccacgctttgtttctgttccaaaggcaattgtaaagggtaagaaaatggagttgtctattgcagcttttaaaagtagactagcaacgggtaatgcattgcttagataaaggaagatgtaagaaccagagtgtaatttcacaagacacagagacagatggcttacccgtaactacagtcaggaattctctaaaggagagagggtggaagcttgagcctgtagcctgttgctgctgtcttgtcagatgtgccctttctggtaataaaaagtcctttgccgtgggttattttgtcaagtgagatagcaggacttaacaggtttgtttgggaaaataaaatytgatagaaaaacggcatgcttttcccccacagatttcttggtagcatcattcaaaactacagtgagcagtatctttgcaggattttaatatttattcattattataaaggaaggaagagggccatcgtgttgcagtttgaaacagcctggattgttttaaaatagtccagagctgcagcctattagcagtctgcaagaaccatttgtttcttcagcagatatttattgaatcctactgggtgctagtctggcgaaatacggagattggagggtgtaaggctcaaggagcttacctgagaaactggataaataaagctctgtactgggtgtggtggctcacgcctgtaatcccagcactttgggaggtcgaggtgggtgggtcatttgaggttaggagttcgagagcagcctggccaacatggtgaaatcccgtctctactaaaaatacaaaaattagctgggtgtggtggcacgcgcctgtaatcccagttgctggggagactgagacacgagaatcgcttgaatccctgcggtggaggttctagtgagcagaggttgcagattgcaccgctgcactccagcccgggtgacagagtgagactctgtctcagtcagtcaatcagtcaatcaatcaagttctggaacctgcctggccttgtgttatatcgatgctttctcaatctgttaaaaacgtagctgctattgaatgactaagaattgtttactctcatttccactctctkacatcttttttttttcttttaataccctgtgatgaaactgtgaagaaagatattcctgatcattgctttgacctggaaatttcaaagggacccacagtccaccattccgtccaagatcttctgggtgtgtgaagtcccgggctcacaaatgcagttgtgtttggtcactgtgttgcttgcatatggctgttggcatctcattagcctgattgatggggcagatcagtcagcaagactttgttcggtgcctgcccccagccagctgggctacaaaacctggcattttacttctctcattttccccaaatgatctaggtgtcttttgctcactggtgataaggggtgacattggtatcacaggtaaaartgagtaaatttgagattattgtcgtcttgctttaaaggttggagatacagcttcaaaaaccttttactacccacacacccaaggggagtcaaatggatttaggtgttaaatacttcaggtttgaaatcctttgtgcattatttcagcatctgatttaagtatcagaggtcatctttaggtaataagtaagtattttggaatatgggatttggcaaaatctcaagaaataatttcaggttgtctcagcaatgaggttaaattgtgctccagagtccatattcagacaaacggaatggtggagcccgaggttgatttctttgaattctggttggtattaaagtcattcagccctcgggttaccattggtagcacatctaggagcaagttttaattttttagtcatagtgactgtgctggatttggtaggtcgtacgaattgggkaagaggcataggacaccaaggattttgcaaaaagcaggcaactaacatttgttttccacctactatgattatgttaggctctcaatatatgtttaccacttattccccattttacagaaacgataactgagtttcacatgggttcaaggcgtgaccttagatcccacagcttgtacgtgcttagaactggcagcaacacaagtgtgtccaacttgagttttcctctgtgctatgctgattttccttgagaagtattctgtataaatagactgttttctatgaagattaggcctgtgggagtgatatgaatgaatgaactttactaggctctttcacatggtgatgtcaggaagataacggtatgctgattttgcgtgcatattaacattatcttgtaaacaataatttatggccatttgacatgggtttggctgaattgcatagctgccttctctagtagaattgactactttgttattgtactgtactctatagggtcttccaccacagattacaaaatatggtattttttagtttagagcaatgggttggtgttcaagctctggattagactgcctcttctttttcctccctccctcccctcccctcctctcctttccccttttttgagatgactttaaaatatagattcatattttttaaatatacagaactttttcagttttccatttcttcttgtggcaactttttttgtagtgtttttctaggaatttgtcttttttacctgtattgtaaattcattggtataaagttgttcaccatatcttaagatcttcttagggttcataggatctgtagtccttttctttatttttcatttttaaaaacaactttattgaggtatgattgaygtacaaaaagcctyacgtatttgaygtatagaacttgataagtttggagataagtatatacctgtgaaaccattatattttataagtacatgatacaatatgagcacagtactatatggtagatctctagggcttttccatctggcgtacctgaaacttcataccctttggctaatacctccttgtttctctctcccctcagccctttgcctacaccattctattttttgcctctatgagtttgagtgtcttagattcctcatataaattgtatcatgtagtatttgtccttctgtgtctggcttatttcacttagcataatgtccttcaggttcatccatgttgttgcaaatagcagaatttccttcattcctaaggctgaataatattccattgtgtgtgtttgtgtgtgtgtgtgtttgtgtgtgtgtcttccacatttcctttatccattcattcatcagtagaaatttaggctgcttccatgtcttggctagtatgaataatgctgcagtgaacatgagagggcagacatattgttgtgatcctgatttgagttcctttggatatgtatccagaagtaggattgctggatcataatccagcaatttttaattcttgtttcgttttttgaggaacctccatactgtttttcataatggttgcaccaatttacattccactaaggaatgtaagtttctcacgcataagggggctcttgtttccacaccctgaaccacacttgttatctttcattttatgatgagaaccaccttaagaggtgtgaggtgacatctcactgtggtttcaatttgcattttcctgagaattwgtgacagtgagccccttttcatacacttggctatttgtatgttttctttggagaattgtctatttggttcctttgcttgtttttaaaatctgtggttttttttttttttttttttttgctattgggttttaggagttccttatatattttggatatgaacactatcagttatgaggtttgcaagtattttttactattttgtagcttgccctttcagtgtcttgattgttttctttaacgtgcagaagctttttagttttacgtaacctcacttgtctagttttgcttttgttgcttatgcttttatgtggcataatgttgtccttttattcatccctgatattggttgttcaagccctctctttctgtctctgtctctctctctgtcattcttgctagccctttatcaattttattagttttttcaattgacagacttttagcttctttttttctctgtattttatgtttgttttagatttataagtttctcctttctccttttatttccatcgttctgctttctttaggcttaatttgctgggttattttcctaatgtaatggatgcttagatcatcttggatgcttagatcatcattttttctttctttctttttttttggagcaagatctcactctgtcacccaggctggagtgaagtggcatgatcatcctcctgagtagctgggaccacaggtgtgcaccaccacgcccaactaattttttgtagagatggaattttgccatgttgcccaggctggtctcraactcttgggctcaagcgatccacccgcctcggccaccccgattcctgggattacagccatgagccactgtgcctggtcttctttttaatatatgtagttaaggctatagattttcttttaaccatggctttagctatactccttaagtttgtatatgtgtttgtaattaccgagtttaaaatatttctaactttcattgtaattttttgagccataatgtcttatttatttatacatatatttccagaaatgagaattttctgggatcttgttattgatttgtaatttaattccattgcggtcaaagagcatactttctaattttaatcttttgaaattcattgagacttgcttttgcccctgcaaatcatcagttttggtaagtattcttgaagtacttgagtatattttgctgttgctttcagtgtttatcatattcaattattttcagtttatcaattaagttgttcaagtcttctatatactttgtgtttgtctgcttattttatctgttactaagagggatatgttaaaatcttccrttataattgtgaatttgtctatttattgtcctaattctgtcaatttttgacatatatgagaggctctattattaagtacatataaatttagaattgtcatgtattcttggtggattgaaatttaccattgtgaaatattcagcactttctcttgtaatgcttcttgctttagagtcttttttttctgaaattagtacagctatatcagatttcttttggcccgtgttatacagtataccttttctattcttttactttttttatgcttatgtttaaataaggtataaaacataatgtacattcttttttaaggacagtatatgtatatttatgttttcttcagtctgacaaactttttcttttaattgccatctttaggccatttatatttaatgtaatgacagatatatttgagtttgggtttaaatataccaccttattattggcttcctgttaagttattctatattcctctttcccttatttctatcctttctttctcttttttcttttcctttttcctttctctctctctctctctttctttctctttcctttctttcttccatttaaattgagacagggccttgctctgtcactctggctggagtgcagtggcataatcatagctsactgtgcccttgaactcttggactcaggcaatccctcgacatcagccttctgagtagctgggactaccggtacctgccaccacacctggctatttcttttttaattttaatttttgtagagacagagttttgctatgttgcccaagctggtcacaagtgatcctcatgctttggccgcccacggtgctagaattacaggccactgtacctagtcatcttctctcctttcttgcctttttatcattctgcttttcttctccattagctttttaaatttgtagagatttacatcttgcatctttgacttattaaaatctaatataaatcagtattatatcacttcctggagaagacaagaaccttaggatactttgcttccattactcacctcctaggttaagcattgttattattattgatatagtaatttttgctatatattttaaaactcacagatttcactcttaccatttggrtcttaacatgtcgttaccctttatgttgctctttgttactttctgcatctctgggtttatagctaaggtcattttcctcctgcctgaagagcatcctttagtgtttcctctagtgtgggtctatacgtgacactaggtgtagtgtaggtgacaaacaaaaagcagctttcgtttgcttaaaatttttgttctctgcctttatttttcaaraatattttcactaggtatagaattctaagatgaaagttttatttkttttcagctgtggcttccatcattttcctgagaggtataactatcagtcttgtagctactggtctctaactacttctaaaactatctgcagtttttagcagttttactctgatgtgccttgctttgacatgtatgtgtatatatgtgtatctacacacacatacacacatacagatacacactcacatatatatttctgtttgcggctcacacagacataaatatatatatatatatacaaacgtacatttctgcttgtagcttgcacayatatatatayacacacacacatacatgtagacacacacatttatacatatacatgtcaacacatacacatacatatttctgcttatggctcaggatacttctttttttggccgtgtatgcgtcattgattttgtaacattatcagccattctgtctttaaatattgcttttcttagtctatttcacttgttttggaactcagattacatgtatgtgtaagagcctgggagaatgtgtttcatatgtctcttttgtgctttgttttattgtgttatttttttctttttatgcttcactttggatttttttgttaacttattttgtagtttcctcaatcttgtcgtcagctgtgtcttgtattctgttaaactatatgctgaattcttctttactcttattactcttattttgtttaagtttcagaatatctatttgaatttttttattgtttctaattccctggcaaaattctccatcttgcctttttgttccttgaatttgtcagtcagacttattttaatcactgtttctgaataacttgattagacagatctcctgtgcatttatttccatttgttcccctctggcttttggtgaagttttttctttttgtatgcttagctattttgtttgaatgtctgagagtttatatgagtatttgaaataatcatagtggtaatttgagactctagataatggtatcttcctccagagaacattttctcttgcttctggaaattggatagatagggactgatcactttaatcaaactaggaattgaaatggcctgaagctgagtttccactcttgtgaaggctggactgtctcttgttattacagcgagggtataactctttaggatcccgaccmaaggtttggtgtgtttaccgtggccctttcctggtgggtcctgagctcaaatttatgtctttttccttgttataaaattgccaaaagctcagcccatcttctcaggcttccaaccactatgtttggaaatgaaatatgccttgaaggaaaaaagctgccaaatgctggccttgcagtttttgcagatcttggccccmaaaattcttagtcatagtgcccttctgatgccttcaaacagatatgggtgtgtatgcacgtgtgttattttgtccatcttttctaattgttctcagtaggaaatggggctaagaaacctaggtaacactggtagaagcagaggtgctggcgacacttaccatagagtagagcataaagtccttatcgtgggcacaggatctggtcattattgatggttaaatggctggacatgccgtgaactcttctatgtcccagtcttcatctttgaaatcactgcatccctaggacaagttttctcaccatcacagtgttgacagtccgggccagatggttctatgttgtcaggggctgccctgttcatggtaagatgttttgtaatgcctggtgtttacccactagatgccagtaggactctaccccacaacygtggccactgaaaatgtctccagacatttgcttctgtcccctggggatcaaaatcacccctggttgagaacttggggtaatttaagtggtgctccggtaaaggccattcaacwtgactcactgtgttgatgttatgttttctaacattgactttcctttaaaccatagggttcgaaaccgccaagtcttttgccctccatggtgcacatgtgaycttggcctgcaggaacatggcaagggcgagtgaagcagtgtcacgcattttagaagaatgggtaagygcttgactgttgttgttttttttaattgtcaaatacacatgccrggctaaccatatggagatttyagtggagtgtgtaaagtttattgctcttggaatcatgtctttatttttaaagtcatcttcactttgtttgtcttatgaatgaaagcatgagcaagtcmattattattcacgcatttgtttgtagttcattgtcagtgtcatctgctttattagtcaggggtttgagaatgtttcttcctttaactcatttattaagaaaaataaaacgtggtgaacgcccatgattgcaactaggagactgttatgcttatggttgttaagattagaaagaaggargctttaaccctatctctratttcttacttttctctgtctatgtagaagttgatgttgatacgtgtctacataaatatttactaagggcttgcmttagtcttgggaccaaggatatagtattaaacgaaacagaatccctgccctcataggcttaccttctaggtaggaaaaatagaccataatcaagtttaatatttgccataatgtcagtaaataaaggactgtaaagcagaggaaggtggggggaatgatagcgtgagtgtgatggagtcatcagcagggagccttccaaagttgtgacatttgatctgagacctgaatgaagtaggggtaagccatgcagatgtcaagagaagtattctcttagcagtgagaagagcatatgctaaggctcagaggtaggcacaagcctggagatttcaaggatcatcagggaagctagtgtggctggagatgaatggagtgggtaggagaggtgctgttgggggatgggtatctggtagactctgagrtagcggtgaggaagacattagagggtttgagctagagagtgatgcgagctgtttgatttttgaaacatcgctggatttcagaatgaagtccagactgcattcattcacttttcattcattcacatattcatgaagtgcacctctgtgatgggtgctggggtctactgttaaggacaacagacgttgccactgtctttgtagagctttcagcctattgtggaagacaaatttagtcaaaaaacacagatcttaatgtaaacttgaaaaagcagtgagtggtcctaggaatcagtaatgatgccagggagttgggagacctttggggtccccaaggaagaagtgattgaactaagatctgaagaaagacctgaagagggtggagaagggtcagatggggtaggggaatggcaggtgcagaggccctgggaggagggggaggaggagatagagcagcgtgtttgggagcagagcctgaagggggctgggtacaccctgtggaggccgtcttcatttttgaatgctgtgaaagatttcttgccatttgaagaaatagactacagtgtacttaagaaaatttttggtactctggactgaaaagtagtgaaaataaagaaaaggaagatttatttctgctttttcagtgtatttatgatgaaatatttgaaattcagtatatttgaaatgagcccttatcttgagctcactgagcttattattttgggttaaataaaaaagaaaacagagtcttactttttctgatcmttttattgtctttctgactaatgttaaaaagtagtaacctctagtaggtgggatagtagcaatttttagggatgtattgagaagagtacaaatgggaatacgtgcatcttatttgaatctacacgcagaatgggaaggtgaaaaatgaaatgtgaaagtcgttcttggtccttctcttggaagataaacattatgtattcttccagaaaaaggttatctatataccagcaaacacactcacattctgttctgtactttttttttttttaaacttagtactgcaggagatctcttattagtgcatatagatctacttcattgttttaactgctgtataatattccatcatgtgcttatgctataaccagtcttccctttggtggccatttaggttgtttgcattgttttgctatttgttattccaagcaatggtgtttcacagttctctctttcttgcatcagtctttcttrcgatatcatctgatattgggcctaaactatgctgctgtgagcattctttatttacgtatttgtgagtaaatgcctggggcagaatcttagcactggactccttgattcaaagggcatatgcatttaaaattttggtaacagttcccgagtcattttcttttttcttttttttctttttcttttttattttttttttgagactgagtttcactctgtcaccaggctggagtgcagtggcacaatctygactcactgcaactttcacctcctgcgttcaagcaattcttctgcctcagcctcccgagtagccgggactacaggcacgcgtcaccatgyccagctaatttttgtatttttaatacagacggagtttcaccatgttggcygggatagtctcgacctcctgatctcatgatctacacacctaggmctcccaaagtgctgggattacaggcatgagccaccgtgcccgacctcccgagtcatttcttatcttgttgctccaatttccattcccactgacagtgtagacagacaactgctgagggcttgcagtgttcttgggactagcaggagggcgtgtcaaaattgtaaaactctgcctatttgatgtaatatttgaaactagaaaggtaaaattccagggaygctagtgacactatggtaacctgattgtacagtgacattcatgtttaaaccagtcttggaagataatgctgtagcacaactgtttttgcatcattaaatttatcctcttcttttctgagaacacaatatatatgagaacacattcatctgcatttatcctattttaattattgtttgatgcttagagcagaaattcctggacctgccccaattagcgatgagaccttgggtaagcctctggatctatttggagcctgtttcctcatctttaaggaaaaaggttggatggatgatgtcaaagacccactgttcagtctttctttcttatattttgagccttaattgggtccctgtgagtcaatttcmgatgatagaatttgctgttttatagttttactctaacatgtagtaccttgagatagaccagtgatcccagactaagaattattcagaatcattcaccgtcggggacacagaaaaaggaaaatggaacagaaacaaaactaatacacgtggctccagatgtttaaaattagatttgataggttgtaggctgaagaaactcaacctgttcatcatctctcatcttttcacttgttctctctgtatgccattatattgtgttcctcattttcccaagatgatgattatggaaactcaaattttgcaccagaagctgtagttaccatttcattccattgcaccattcataccctgcagagaggatgtgaagtygtaaggccttcttgctctggtgacatctgttaggcttcgtctctatatcatcccccaactccttgacccttgatatttgctggtctacttcccttcaggtccttcctcacctcacatctctgcgcaaggatttcatctggtatgtcactaaatattaccttcctgtgtttctcaaggtcaatttgatagactccaatttttcaagctgctggccagcttgagcgtattcatatgttacctacgatgaatcacatcagtgtcggggccgggaaggtactgcaacatattggcrcctcacgggaggctctcaaaatgatccaaagttttttgttgcagcaaaagctcattcagaagtctttgggccatttggctcagcggaggctgtcatgtgccaaggctccgtgggcattcttagctctgcttctggagataagagttcattcctccatcccaacttgttcttccctgcccattcttcctcttcctgccttcactgcacattccgggatcgccatgttctagaacattcatgtctgccttttagccagcagaatgctattctcacatccacaatgggacagctaayagcccccatttatcaaatccctgtcatatgctgtgtcaggcactttatatccctcatccaggaggatgcaaaaacctggtgtttttcttttttttttttttgcattttccagacgagccaagrgatggctcagaarggtgaaggaactcacccgaattgcacagctggtgagctcagagtcagkctccttgcttggtccatctggcttccaaactscaagtctgtctgctccaccccatggcccatctttttaccatgtttagtatcaatgttcatactttgcagattttgctttcaaactctctagctgcggtttgagtgattaatttcaggatccatcctatttcttagaggaagccactctgatctaccctgtcgtctctttatattcaagatatcctttatagagctctcaaattacttttgggaagaaggagctatttaataaaatacaacttaagtgaaaacacattccatatagaagtatattaagaacctatatgtaattactatgactactaattatttcatgggaaaatgccctcctgctgagatgttttagatgctccaaagttagaagagaaaaaatgaaaacaattaaaacaggataacatggacagtacagaagtaaaccactgtcttaaaaggccaatccatttggcataattaaaaaaagagggaggagatggaggcacatcagcccccattcatatttaaataaagaaaacggggcagtggggcttgttcctatgttgtggaacagcacacagatgtgatctacctcattcacatccttatgtgaattatacactggtgccctcacctcttaagacaagcacctatcgttttcctgtgtattccaagaggccagtgtggctggtggaataagatgttttcctgttttcaagatgsagtggactctcttttatttarcagcagtgtctatgtgttaggaatccatgtgagttctctaagtctgggacaacgataggtgtgtctgagtcctgcattaccatggtttattctttcctttacccagtatctattggagttgggcttctgttgctttatttctcggggtctggcatatcccactccctgtcttgagatctcaggacctctgaggggcattgcatktaaagaacaagagcttattaggtatcaaaacatacttcatgaacagctacagcaagacctcgacattccagtgtagagctcttgaaagaccccagtggggctctgagttcctccttcttctgtttctattagatttctaaattttagtttctaaattttagatccccggaacttgggatctaaaactctggtcctgtggaagaaggaggtagggtagagtgggagcagatggacctgatgtcatccatctccctacgttgtttgcaggaggaaaagggatgaggctgaggctgggaggcaggggcggtggattgagagagaggagagggattgttatgagtaaccaatgttcctcatgcctgccaggccctcactagatctgtttaacagagagtgcagaagagcttctgttggggactggccattagtatagcgaggggcccaataagtgttgtgaaacatcagcatctgctggacattgagatggccacaggttggtcagagagggctggtatgggaagaggggcaggtggctctcccttagagttactatttgactcacccctgacttcccagaatgtgtcttgagtctattmccctctcatatgggaggggtgacccaagtatgtttgtggcaaccaaaatgtctccaggcattgccagatgtctcttgggggtgcaaatcgtccccagttcataaccacggctataaaacatgctgtattatagtggcaaagattagaatcagatacatcttatgaccttgggcaagtttcttaacttctttaaacctcagtttcttcatctgtaamatgcacatcataatatctctattcagagatacaggtggttctattaaacacatcaactctgtgtatataaagtcttaacccattgtggaataaattaagtgctcaattaaatgttagctgctgctattaataacaacaataataatattttcttcacgcatgaaagtgcaaagtgatgcttacttttcttaacctctccaactggctgaaagaggagctctagggcagatgtttatcagcctgatttcagtggagttgcaatgaattctttttctgtcttcatatgtctggactcctacattttaatggatgtgtatttagtttgttgattagtattttccagtgtagctcatattagcactcaactgtcatttgaaaagccatcttaactatttatgtgattgctttttcttttgtatttacaaagaaatacactctgcatatattttggaaagatgattaagggattagtcatcaggaacagcaagcaatggtttatatcaaaatgattattgagaaagcagagagatgaggggtaaaaataaaagatttattagccagaggtaatggaatgtgcatgttttagggagagagcgcatgctcagttgattgcaaccacacggtttgctgctgaagtgctgtaatgattcaggttttcaatagagttgatatcgggtctatttattttgtgggagtgaagggatagggatagtactgacagcattatgtgattgcagcctcattgataagcatcrgaaataatgactttaacattattttcagatagggagcactcagtaccaaccattatattaggctcatgggctcaacattttgctgtrcttttcatagatactgacacytgtgttttcattttgttgttgttgttgttttccctgccgggaaactgccgcatcctgtgttttcatggcatgatattaaggaacgatgggtaggatgctgaggagtaarttgctcgcacttttaaagacttctgcaaaactccacctacttttaggctccttaaaattcagtgactttatgagctggtatagcttcactgtttgtgggaattccatgcaatctcctttgacactaaaagcttaagtcccatgatttgcctttgtggatggaaggccttggccttcttttatgatatatgtgttggggggaggcatgtggtatgtggrgcgggtaaaatacgagcctcatgcctgtctaagctggtgacttggcttggaaaagatgatcattcgtcaacgcatcacaagtcacagggcttatctccattgttctgaacgatctgtagctaaacaaaaagataaaagctattaatattattaatagttgtagattaccgggaagarcgcatcctaaatcagccattagatttgttcctcatttctttgctttacaaattgtttttctgtatagtattggattttcaataaataaagkatgatataaacaagtctgcaaaccagcaagaactatataagccacttgctcaagtcaataagcgcaygctcacaaaggaacgtaaagttctgaagttcttctttggggcgtttgcaaaatgtcctattattgtcacctgcaggtggggggttggatattcctatttgtctttgtactaggtactgtgcttagcatttaacagtaaagtatttatattatgtgtgaaacccattgtgcagatgaggcagtttagaggctggaagaggcatagactttcccaggctcacacagctgggagataacggggtggatccaagatttgcagctggtgtgtgggtgatgccggaagattggcctttttcaaggacttagacaagtattgtactsatacattatttgcatttatttgtatgaatacttctgggttcctaatatgagggtacctaaaaagtacatccgctgcgcttcttgtaatctgagggagttgatgaacatgggccaaggaagctctttccttcgccttccgttccagacttccttttcgagtagtatatcgtgtatttactgttctacttcagttgcctatttgacctttcttgtcacaggctcagggaagattctttatcagataataaattattcatccccctcatagacataatcggttgctaaaatattctgagtttcctgtctccagaatacctaaaacttgtgcttggtacttatcctctaagttttccgtttcatttctcattctgaaaattttgcaccgacttagtcttgaatgttattcattgttctttgatcattgtctttgtgtcttctccttttttttttttttcctggccaccgctcgcagtcttgaaccgaatctttcaaactttatatccatgtracctttgtataatgagggctgtgattaactgcagagttttaaagagtgaaagtcaagcataggtggctggctctgaaccatcactcccaataatgtgaaacccaaagcagatgcatcctttcattaatgtggggtcccctgagttcttattaagcaattttgacatagtttgaagagacggatttcatgttcagacagtgttcagccgccaatggctgaaaggcctgcttttggccacttggcatttagactccattatttaagaggggaaaaatatgcctgagactgtttttcatatttattgtgggacatttagagaatctcagactagcaggtgttagattaaacagaggagaaacggtccttgtggtgataaaacttccctacgcaaggacaartagagaaacaactgtagatgaagcagccagtctcaggctggggcagcacgccctgcgataggttaaggtttattttagacaaatatttaaaatgcagctaatttttacatatgcagacgcaacccagtggaatagaggtagccccagctttggagtcatacagatctggggttaaatcccagtgtgaatactaactcactcggtgtccctgggcaaatctggtcatctctctctctcttttctttttttgagatagggtattgctctgtcacccaggctggtgttcagtggcacaatgatggttcactgcaaccttgacctcctgggctcaagtgatcctcccatctctgcctcctgagtagctgggactacaggcttatgccaccacacctggctaattttttttttttttttttttaatgtagaggaagggcttcaccacgttgcccaggctagtctcgaattcctctgctcaggcgatcctcctgcctgggtctcccaaagtgctgggattacaggcatgggccatcgtgcctggccttagtcatctctttgaaccttggctgatttacctgcagatgctaatatgactctcagattctggcacatagtaaagattcagtaaatggtcgttgcagggaaagctaacttgtccaatgcagatctgtaaaatatactcataaatcttgttggagcaatatttcttctttgtcttacttcgggctaataacaaaaatatcatacaatgagtggcttaaatatttattcttacagttctagaggctggaagtccgagacgagggtgccaaccttgttgagttcttagtgaggtccctcyttctggtttttaagtagcctgtttcttgctgtgtcctcatatggtggagagctgagaggaattgagagagagagagagagaggtcgcactgtctcatgtgtcttgtaagggcactaatcccttcatgaggattccactctcatctaatcacctctgaaaggccctgtctccaactaccatcacatgggcaattagggtttcaccataataattttggagggacactgtattagtccattttcatgcttctaataaagacacacccacgactgggaagaaaaagaggtttaactggacttacagttccacatggctggggaggcttcagaatcatggtaggaggcgaaaggcacttcttatatggtgtmagcaagagaaaaatgaggaagaagcaaaagcagaaactgcctgataaacccatcagatctcttgagacttattcactatcatgagaatagsatgggaaagaccggcccccatgattcaattacctccccccgggtccctcccacaacatgtgggaatcctgggagatataattcaagttgagatttcggtggggcgcagccaaaccatatcagacacaaacattcaattcacagcattctaccccagccctccaaaattcatgttyttctgacatgctaaatacatttattacatccaaatatccccaaaatcttaactcattccggcatcagctgtaaagtctatgtctttttaatttttttaaatgatcaaagcactgggaagtagccacttctttcctcagcttcccaccaatgtgtcaattaataatctgactaaggtggccgggtgtggtggctcacacctgtaatcccagcactttgggaggccaaggcgggcggattgcctgagctcagaagctggcgaccagcctgggcaatacggtgaaaccccgtctctactgaaaatacaaaaattagctgggtgtggcggcatgcgcctttagtcccagctactggggaggctgaggcaggagaattgctttaacctgggaggtggaggttgcagtgagccgagatcaggccactgcactccaatctgggtgacagagcaagactctgtctcaaaaataatagtaataataataataataatartaataatartaataataakaagaatctgactaaggttattaaccattaaggtatgctgtgctaaggagcagggggccccttccatccgtagagggcagaaaggtgcctatcatgtcttcagtgtcagtgccctggtatggagctagctggccttccacaggttctggagttaatgctggagagaagtaggggtgkcagagcctaccctgtgttcctaggggggttcatctggagctagtccctgacccttaggtggaagatgcagctatgcccaaggttctgaagaccctgtaaaaggaagccttagaagtggctgcgattgttttaaagtctgtccacaaattctttgataattctcctttcaagaagtagaggccagttctcctctcttggaatatgggctgtacttagtgactcactctccatgaatagaatttggcagaaatggccgggtatgactcctgaggtaggtcctaaaggcttcgtggcttcttcttgctcactctcttggatcactcaccagccaccatgttgtgaggaaactcaagcagacctgaggtgaggcccatgcaacaaggaattgaggccaccagccatgtatatgatcccccttggaatcctccagcccagtcaagccttcagatgactgaggccctggctgattcatgtcatgagagatcctgagtcagaaccacccagcagctaagccacttctgaatccttgacccacaaaatatggtaagataccaaatggtkactgttttaagccactatgctctgggggaatttgtgatgtagcggtagataactatcacaggatccatggcctcaaggggagaaggatccttaagagagactggacagtgagttctaaggataagacatgtatacttacccaggaagctccactgtgtgcaaggaatcctaagttcccggggttgcatccatctcccaggtcaccttgtttgacctctctccaacacttttaaaacatacctgatcaggaatcaccccgctttggcataagttcctctctccccatgctgcccatcccatttctgcacacctcttaattagtaagttctccctcatattgaaggcagaatcttcctctgagcgtcttctatgcaccggccctggtcctgccctccgagttccactggctgcattctcatcagaacccagctaaaactcacgtctctcaaattccctaaataataaatccaaagttattgaagatattgggwtactaaaagttggcagtgagactggccccactcatttctttgtaacccctgtccctctttttattattgaagcttgggatgcacttggtaaggctaggcagctggagagcgtgcagactcaggagccaagacctgccttgccttccctggagttaatgaatcagtgtgaatgaagagcacagtcttcttttaaatgrcaggggaaccrtgcacttatttaccggcaattctcagattctaattgttccgactacaatgcgtcctgtaaaccgggtagctgggagaaacttcaatgcatctttgtaatggctttgttgttgtttattgagagggactaattaactttgattattgcactaatattatggcactttgacagcccttcagatttatgactctgggaaaataaacaaatgaaatgcaggtgctggagcagaaagaataagttattactgaactttaattacttggaatgcgtagccaggagagaattagttgatgaattacaggatgcttaaaatctacatcaaattgcaagcaataagaagataaaaataaaaaggaaggggcaggaagggtgctatttttaaggcagggaaggataggatgcatttgcagtggtctccgtggtgtttcattgattaaactttgtggtctctaatgctgcagatatgtacatggtgctactcaaagcatggtccctgacctgcagcatcagtgtcacttgagagcttgttggaaatgcaaattcttgggccccaccccagacctactaggtaagaatctctggaggtagggcccagccatctgtggtttgcagttactccaggagattttgatatctgcagaagttgagaagcatggctcaacagttctcatgcagcttgctttttcttttataaaagggcgggtacacatttttatctttgcttatgaaaatcaaatgttttcccaacccagtttaccaagtagctcccaaattttcaagctattttaaaaattggctgaaatttaaaaattttgggcaattttaatttatccaacatctattacgtgctaggtggtagagtgggtgacacaagatagtctagaaggattttgctaatgaggtgatacccctaaactgtcatcgatgccagcgcctgggtagtgtggtaagagtgatactcccatgactcatgaaagatggtctccccacgtgctttaaagcaggatggttgcaggagaaagtattggtggactgtgaacagcccccatggcaagggtgcatctggagctggaggaagagcatccacagagtgtaagtagtttgtcctgggaatggagatgtcaggcttgggtgtggtgtcggggagagggcaggcagctcctctatgaggccagatcattcggggccttggattccagtcttaggagaatagactttattctctaggtcctggcagccatcactggctgagtctgagtggtggtgatacagtccatactcagtgactgagatagacagacatttgggctgaattagcgaggggagtgcggggtctggagactctgttggcctgttggccatggtcctgggcgcaaagagcagaaaaggacgagacggggactgaacagacttgcttagttcctgacattcaaggaagaactttaacgtccatccacggagcctcaaaggctaaaaataatcatccctttcaatagttcctgttgtgaggaccattaacaaattataagagaaagcattcctcacttgtagaaactccatgaaaacagacatgtgtttacttatctgcaaccctgtgttaggaggagggtgatgagacactttactgtttgaatcaggaagtgctgacagtgaagggaggagctcttcataattatacccggagagcaggcaagacagccacatgcaagtggcctggcctggctgggtttggtacagaggggattagggcagattcaaacctcactggtcccccgtcccagcacttctgtgctgtctgcagttactaagcacttttcctgtttaagttgttgctgttttcattcccgcaaaagctcagccagcctctagcccaaaattgtctctgtttattggacagttggaaatgtcactgtggccccacagaccttgttgtcaagcaggctgctacgcttttattctagagcgtctttcatctgatttcctccaccatctggaaccttctggattcttcctcttatgggtagtgatgggcactttaggagtaggaatacatgtcagtgctagaccacatcctttcatacccggaattcgcatagtgacatttaaaaatagatagcaggccaggtgcggtggctcacgcctgtaatcccagcactttgggaggccgaggcgggtggatcacttgaggttaggagttcgagaccagcctggcaaacatggtgaaactgtgtctactaaaaatacaaaaattagccagttgtcttggcgcatggctataatcccagctgctcaggaagctgaggcaggagaatcccttgaacctgggaggcagaggttgcagtgagccaaggtggtgccactgcattccagcctgggcgacagagcgagattccgtctcaaaaaaaaaaaaaaaagtaatcattttagaattgctttctcttcgggatggtttacctcgtgtttagtctgtaaacgcggataaccgagagctggtcaaatgtttacatggggctgtggaccattttgtatcattggaggagaagccagggcacttggcaggggtgttcatgatgataatcaggtggctgggtggastcrccatttgtggcatcctcaaagacttgccaacatagacatttttggggagacagaaacacagaaataattctgcagtgctttaaagaatctgttaaaaatcaagtttctttcagtcatgtatgatccattgggctttatataacttttagcctttgcyttgcagggacagcaaagatgtgagcaaatttgtgcaaacctaatagggtgaaaaattgaggtatgaattagtaaagtcatttgtccttctggaaagagttatggattaacagattacatttgggtatattgtggttgtgaaaaggtaacattctcagattggaaaggactttctgagatcatccaacttaactttccccacttgacagacaagaaaactgaggcccacagaaggtaacttaggcaattaattaattatagttaataattaattctgcctgcagaacaggaatatggcccccaacgcttcatgcttaattggatggcttattaaattcttatttttatggtagtgatgatgatgataataataataataacagtagtagctagcattgttttccagtgctaagcactttaaatgcattaattcagttcatctttatgacaacactatgagatagctaatattatgaatcctattttcagatgaaagactgagtcttagggaasaaacagccgagagatgaaatgccacagggatgtctaggttcaaacagcaacagaggtgcgtaccatagggatgtggaagccttgcttgtcttgttcctcttggtataaccccagtgagtagcatagygcctggtcaattggagggatttggtaaatatttactgagtgagtgagagggtaaaacagctgagccatgggagttataacttgggcagcagtaatcctgccattgtaggaggggacagatcggctggttagtttttggaaagcagaccagcagaagttgcaaataacttgttgtgttttcctaagtactgagctgtgtgaattggtttcatgttgatgttactgaagtctccccaattcatcatctaccttgtagcttgttgaagaaagagtccttatttacagtctattatgttaaacgtattttattccagttctttgaaaatgacccatcctgatttggaaaatctctaacttgcctggtcattctggagcagtgggagccgactgtgatgcagagtggactcataatccagcttgattttgagggacagaaacctgggcctttaggtagaatgaacagsttaaaaggctgcacctgagagtagggggcatatgggtaaatccagctgtacccaagagttgggggcatatgttagycctactgggtaaatccagctgcacccaagagtagggggtatatgttagggctagtgcgtaaacccagctgcacccgagatatggggtatacatgagtgctattgggcaaatccagctgcacaggagagtaaggggcatatgttagggctagtgggtaaacccagctgcacctgagagtaggggtrtatsttagggcttgtgggtaaatccagttgcacctggcagttggggcatatgttagggctagtgggtaaacccagccrcaccsgagagttgtgggtatatgttagggccagtgggtaaatccagctccatctgagatatggggtatacatgaatactagtgggtaaatccagctgtacacgagagtagggggcatatgttagggctagcaggtaaacccagctgcaccccagagcaggkgtatacatgagtgctagtgggtaaatccagcagacgtccggactgtgcttgagggtgtcatcgagagagagaaggttgatccgaagttagtaaaggctttaaaaattaaaaggcctgagatgatggtagggttttggaggtaagtataaaaaccttcttgttttctactacttaaagctgaaaacccagcttgggttggctttgcttctaatatccttcttcctttttgtttcrtaagtaattgtcctgaagcctgtcgagataaatgtatactgaaagagaaagacacagaggagagacaggcatacagagaaagagagacacgcagacacacgaaggggaggtggagacacggaggagggacagaaagacagagagagacagaaggagagagagagagagaacctgtctagcggtgtttttatgaggtttttagtgctgggctttgcatcgtggtgacggtgtgtgtgtgggggtgttgatcactgttttcagtgttctctgatcatttcttgcttagaaaggaggaaattagaattgttgagctatgatttgttttaatcagaaagaaattgtctaacataaatctcttcgtgagctctggaaaagcccctaaagcggccaggaaaaaaatatcaatactttgcaaaggaggaatgattgttccaattcgtggcttaattgactttaagccttaatgaaactaaggccggagcgggtggcacactccgtggctgggatccacagtgaaatctacgctgggagaggaggaatttagggtgrtaatttggttctttgctattgacgaaattttctaattgactggggttacttaataccagataatatttttttcttgctataaagagagtaaatttgtttttttctgaggaacacaggaatttattttaaattacagctttttctattggaagcattcatttatgttggattattgttccctgagtgaaatttcactgatgctgtataattaaatayagatttttttagagatagtatatattttagatgtataagtggataaactggaggtatggaaggtctttatttaaggagaataaatagcccaccccatcaacatgatggcccttggaaaggactcttttagcctccgcgagttccttttccgcaccaggctccacttacgaaggactgcaaaaacttgctaaygtcatcagtctgaaaggattgagctgtaaaatgtgttatgggggcctaagcaacgcatctggaatttagccttcccaagttcaaatccggtttatgccacttgcgaaaaccatgtgaccttcacttgttcttattgcctcagtttcctcatctgtaacttggggatgatgacagtatttggatcacaagattgttgtgaagatgaactgaagtgctaatgtgaaatgttcatgatggtacccgagtacttgcggtggtacctagcgtgtgctttccaagtgctggcaaagaaaagaaaagaawtgcttggggctctgcctacctgtctaggctcctgtctggccattctctttcttgttccaaccatatcaaactcactgctgttgctaaaccttcctgtctctctgcatcttggcacagactatgtcctctgcttggaagggtctcagctaagcttttcctccccacatctgcctctgtatcctgtgagtctctgttcaagggtatctttcccacaaagctttcctgggcttctctttcctgtctcctgccctcccttccttcttttgttcagcacatcgctgtcaaccttcttctctgggtcaggtagagcactgagcaccagtgatatggcagtgataaagaaagcaaaggttctcactgggtgtggtggctcacgcctgtaatcccagcactttgggaggccgaggtgggtggatcacgaggtcaggagatcgagaccatcctggctaacaaagtgaaagcccgtctctactaaaaatacaaaaattagcagggcatggtggcgggtacctgtagtgccagctgcttgggaggctgaggcaggagaatggcatgaacctgggaggcagagcttgcagtgagccgagattgcgccactgcacttcagcctgggtgacagagcgagaatctgtctcaaaaaaaaaaaaaaaaaraaagaaagaaagcaaaggttttttcctcccaagaactcatggtccaagttttggtttttaaatatgcatctatgacagcacggatcacatagtgcattgattgtttgcctgtaggtctccttatttagtcaacaagcatgttttgatcctttattctataccagccgtcccactggactctcagcacatataggtatgcgagacgttgtccttgccctaagtgtggagacagacacgtaaattaatagtaataataatatctaccacccactaggggtctatgtgtgtatgtgttgggggcggtgtggctggggagggaagcaaggcctgtattatggcccragctcaagaatattcgggcaagagcagatacaatgcctgtatttctcatcacttttgggtggcataggaccagttggttatgagcgtgaaaggttttctttgactttggtggtctagttagtggttgagaacatggattttggaatcagcccggtggaggttggaatcctggctgcgccgttctgtagcagtgttgtggatctcagacaaggtgttcctgcatatgcctctctatcttcctacaagaaatggaggtattgcatccccgaaccgtaggatgcttgtcaggattaaatgagataacagtgcctggttagtggcacatgctcagtaacacctgccaagtaccactcactgagccgaaatctcctgaataccaccccttcatgccttgcacatcctgggttctaactcattgaggtgcccccacctttccttcttcccatcaacaactcttgtgcccacgagggactggcctcctcagtgccacacagagcctcccctgagtagatttgtgtcattttcaaacaaagcatcctcgctgcagtgttggattttgtaggatggtgaccgtttacagaaacctctggtccgtgagccaatttggagaaaattgaatcattctctgtgcctttcggcttgcatcctaaaagcctgcacaaacactttgggcaggcttcagcaacttcacatcaagggctcaattgcagctccaatataaaaacctcccccgttgctctctgtgtgtgaagctggattccatgcttggcacagacctcggtgctcacggtaatgcttccttccaccatatcagaaggtcctcagcagccgcagccacttaacatgctcggtgcttctctgtaggaggattttkaaaaagcaggaactgtcagggtcccaaatgttcagtggcacttcagccagaggtaggatagggattttgaagtgtttggagaagtgttttcatatttgaatttacggggatggggtgggctggggtaggcaagggacagactgtagcgattcgcttggtgttttctcatgatgccagagaaaatgacctcattatcatcatgctcacattcacctttgccaggacccctgtgtagaaataatcatgaacttagtgactgacaatcataagcgttttatgatttgtggaggatttatatgtgaaggaaaatggatgaattaaaaatattaaacagcttagccggcacccacatggatgaatcaccgagatctattttttccccgtttatactataaacatatggcatgaattttctgctctcattacagatgctgagagaaggcaaagacaaatatttatattacattcatgttttacagtaaaaacactgttcggtttgtttacacagttccactgttacagtttttatggtcggtaatgcaaccaccgtaaaagcaagtctgggttatatagcagatgtgataagccctcatactcagagagatgtctgggaaagaatcgttgatgtcacatgtacaggatcaacaatggaattatgtgttgggacagtctaagttatgctgtaataacaaccaacctcaaaatctctggggcttgaaacaacaaaggtttatttcttgctcaaactgtattttcatcatgagttgcttggagggatctgtgagatggggatctcactcagccaccggggcccacagagcagcctgcactgctggatgttgtgacagaggaagagagggatgtgctgaccctcgctctggctcaaaagtgactcctgccatctctgctcacattccattggccaaagcaagtctcagggccaaggagtgggcagtagtagggtgctgtgtgtgtgtacaaacccaccatatgtgcatagagggaggccgagaactggactatcagagaatagccaaagatttctttccacggtcatgtcaagcctttttgctgttatttaattgatgttctatttttaatgcaacatggaatcagaagaatatagaacaggcgtcaaagaccctcccgcctctgtaaccgcactgtttaaaattgatgagactctgtcttcattcgaagatgatctgataggaaggattcacagctttccccaagaatacaccacagtgcatacaaatcctcgaagccgcagaactttttcaagttgaactgtgaactgtgatttttttttttttttaagtaagtttacatgtagaagctcattggtagagagctttagatatattacttcccagggtggtgcatcctgtcaccatgaagtaggcatgaaatgctggagatatgcgttcattcaaagaaaataaaaaggcgcaattatgaaaagctctcaaagtgactttttattttattttttatttttacatggagtctcgctctgttacccaggctagagtacagtggcgtgatctcagctcactgcartctccatctcccaggttcaagtgattctcccgtctcagcctccagagtagctgggattacaggcacccaccatcacgcccagctaatttttgtatttttagtagagatgggtttcaccatgttggccaggctggtcttgaactcttgacctcaagtgatccacccgcctcggcctccgaaagcgttgggattacaggtgtgagtcagagcacccggcctcaaagtgactttaacagcaacttaaaggcggtggctagctctgccccattcagtatggtagccactggccatgtgtggcagttgagtgcttgaaaggtagttagtccagattgaaatgagctgttgatataaaataacatgactcccaggtttcagacagtataaaaaaatcttaattaacatttttatattagttccatgctgaaataatatttgagacatactaggttaaataaaatatcattgaagttcatttaatctgtttctttttacctttttttttttttgacacggctcctggaaaggttaacaatatgtaggtgaccctttattttcatcagacattgccgacctagagggtaaccactggagaggaaaaaagtacaatttggtatttttgtcacaaatccttaattgctagaactcacagtttaacctgacagttgatcaattgatatcctttgacttgttggaattttattctttacattcgtcttttaaaaagctttattttatgccagatgcagtgmctcatgcctgtaatgtcagcactttgggaggctgaggcaggtggatcacttgtggtcaggagtttgagaccagcctggccaatatggcgaaaccctgtctctactcaaaatacaaaaagttagccgggygtggtggcacgtgcctgtaatcccagctactgaggaggctgaggcaggagaattgcttgaacttgggaggcagaggttgcagtgagccaagatcgtgccactgcactccagcctgggtgacaaagtgagaccctgtctcaaaagaaaaataaataaaaagctttgttttaaaataagtttagattctcatagaagttgcgaagaatagtctatagtattcttcacaagggttctgggtacccttaacccagcttccccagtgatagtcacagcataacaatcaagtctgggaaattgacactggcatgataatattaactaactacagattttatccgagttctgctagtgtttgcatgtactcatttgtgtgcggctctctctgtgtgtgtgtagttctatgaaaagttataacatatatacatttggtttaccaacatcatagtcaggatacagaactgtcccatctccccaaagaaacaccctttaccttagtttttattctttgagttatatcttaaccaggttaactgagggtaattgtcttaggcaagttagtaccaaatgatgctcttggttccttgtctgtctttttgcccatccaacccacccttcacacatggccgagttatgccaaactttgcaagaggtgccaggtgggcacaaagaaaagaggactgcactcaaggaacttagtctttgaggccaagcacggtggctcatgtctgtaatcctagcactttgggaggctgacacaggcagatcacttgaggtcgggagttctagaccaacatggtgaaaaccagtctctactaaaaatacaaaaaattagctggccgtggtggtgygcacccgtagtcccacctacttgggaggctaaggcaggagaattgcttgaaccgcggaggcagagattgcaatgagccgagatcgcgccactgcactccagcctggtccacacacagagtgagactctgagacttcgagactctgtccccaaaaaaagacgcaaaggagctcagtctttgaagggttacagaaacagtttcactagaaggtgtgacattgtgtaacagaaatcggttccttaacctgccaaagggaagaaaatagtgcrgaatcttttctccaggtttcaggacccatgtctgttgtccttcctttaccttaacttcagcagggcaagaatggttcaagccacattagaaagcagttactttctcacccaattttaaaggagaaaggtaratgcggtgggttctagggatttcagtgacgtaacaggtgtttcccaggcattaagacctagtaaggtttccatttccrttaggtattatggatgcattccaagaatttaattactataacatcacttcattcattgtaattccttactagagttatgagaacttgggattgtgtggtttcttattcaatcgattaaaagstacttgctatagttttctaactagctatttatatgaaatttagtacttgtcaatatgtattaaatcaatacagttatatttatcaaagtggtgagaagagtttacatctgaacatagaatagattgcttgccttggccgggcgygggagctcacacctgtaatcccagcactttgggaggccgaggcgggcagatcacgaggtcaggagatcgagaccatcctggctaacacggtgaaaccccgtctttactaaaaatacaaaaaattagccaatgtggtggtgggtgcctgtagtcccagctactcgggaggctgaggcaggacaatggcgtgaacccaggaggcggagattgcagtgagccgggattgtgccactgcactccagcctgggtgacagagcgagactctgtctcaaaaaaaaaaaaaaaaatagtagattgtttgcctcagttgggaaaaaataaagttttaaggctctagaattggagtgactcagctttacttgaaaaatcccagaatagtaggaccatcatttagaagtttcgagacgataatattagggaaaaataacagcaaatgttacttgatagacactaaactctggggcatatgagatgacccaggctggaaaaccactggcttacataaaggtattgacagacccatgggtgttaagatccttcatggctactggggagaaatgacaggccttttgaaatcgtatcagtggttttccctgggatcactggaaakaatacccctgtttgacaagatatgacacatgctctgttttaattctgcatttgactaacagaaaagattggtgaagatcagactctgctttaaagttattgaagcagggtacaaggaaaaggggaagggaatagaggctgcagaggagaatgggggaagggggcaggaaggtaaaatttggaggtgcaggcagagtcaaggtcatgcctgaggcccaaccttcctgttgaagctggtgtttgattcaagctgtggctgagaacgtgcagctcatctggagggtagagttgcaagacatgggttcaggtctgagccaagccagaaactggagaaagcgtggcttctcaagactaggaatacctagattccagaggtggcgtgggcatggggcacattgtgacaagttaacagcaagatcttcagagctgcagctcacctgtgccacgatggtctcctaggagccctttcctgctgtagtcccgccccgaggggtttcacttcccaytgcctcttggtagccgtgggcactttggtgctctgatgatgtaacatggagattgtccttgtctccatcgctgtctttactggtgtatgcccatgaggtatgtcaaagtctgtatgtctttgtaataatgctggatcatttgtccaccttcagagacarctgaagacagttttaagtgaaaccacacagagggcatataccattgggacaagaggtctgaagtctatttttgagaaagagaagagatcaagtagttaacagccagtggctatcataataatggcacctaaacaaatccttcttttttattttatttaattaattaacttatttatttttgagttggagtcttgctgtgtctcccaggctggagtgcaatggcgtgatcttggctcactgcaacctccgcctcccaagttcaagcgattctcctggctcaacctcctaagtagctgggattacrggcacctgccaccacgctcagctaatttttgtatgtttagtagagacgaggtttcaccatgtttgtcaggttagaccggaactcctgacctcaagtgatccacccacctcggcctcccaaagtgctgggattacaggaatgagccaccacgcccggctcaaatccttcttacttttcctcaagaactcacttcccacccaaacctttcctattgtggcagctgttatcttgtccagcacatgtgtccrcacttggtattaatagctccatcttaggaactatgaaagtgaggggggtggtggtaatttgcatgaactggtttgggccagttatggtctgttacatccttgctgaaatggttggtgctaagatgagcacttggcttaggccagaccagtccctagcctgtggagaaggggcaatctcttatctgaaggcctaggagstgcagggatgtttatatgggctgctagcgcttagtttcctgccacarggagacagtaagaaaggtgacgtcaatctgagatgagagrgagagcaaaacagttcttttgaccaccttgaccccgaccttgaaataaggtggaactaataamtcccsctttgtgctggagcaagttttggctgagtttctgtcacttgcaaccaaatcagtcctatccagtatacctagtgactctctggtctccaaaggctrtgcctgctgggtactgagtgtctccccgaccgaccccatgatggctacagtgcacatcccttccagccaactctattgtgcacacatattcgtagggtgagttgggccccaggtagagtgattggctcagatcctgcatcctttcagggtctgactgtaatcacactggcatggcagggggaaagtgtattggatttcagagtcaaaaaccacttggtatgaaacccagctcattttctatgtggatgtccaacctgagccagataattaatcttggagatgacgctgcatacttcatcaagttgtaaagttgactgctgtgataatggagaatgctggacaggctgcttttcatgtcatgggttcgctatactttagttcccattatatcatcctgccaatccccatttgttgtttttttgggacccagggtatcagtcatctgatcattgtgtgactttctcaaggacctttacttgagtcttgcacctctggtccacaatgtccacataccagcttgatggtgacttgtgtcattctccatccccttgttaagagaaaatctactttatgagccctctttccaaccgcagtgwtgaggactagaccaggcaagatgatgccgctggaccactggatccagctggaccgctagaccacagagcccctggagcctcccaaggccaagcccgccagccacacacacctttgtgagaattaagaaaagatgccccctcctcttggggcccacagctcctccacctgggcacccagcctggtgaacagggtgcaggctgggatttagccctaccttgcttttggaccattgagctactaagttggagcaacaaggcttgrgaatttttctttgatcataggtaggaaaggtaaaaaaacataaatctgccaatagaaaatagcatcgtaatgagtttctactatatttgtttgggctttgaaaaatatgccgccaaaatatatcaatgtatggtcccaacgttttaggaagttgcatttaaaaaatcttggatacctgttttgtacatattatatatagcatcccgtgtgaatatgttaattcctttttatgagtttcggtcttttttccctctcctatacatgattgctgttttatagctccagtttggtggaattaacatagatttcccacatggggaaggttttgggtgaggatttagaacaaggcaggttcttgatcctcggaagagattcttatctgagrggggatttgagaatggcattgcagagtgggaggcgctgctgtgtggaaaaatgaactggaataattattagaacagttctcagaatttacaggatatttgatcataggagtaactttcctcaggagtgatggatggaatgcctgtacttggaatatttttaaattaatctattttcattacattgaaagtrtgacacacagagaacactaaaattggatgaggcactacctggaattatataaagaatgacaaagatgcggttatccatttattttctaggcaagttagttagcctctctgtgtttctatttctttgtttataaaagagggacaaaaataggacctattactatctaggtgacaggatcattcataccccaaacctcagcataatgcaatatactcatgtaacaaatctgcataagtacccccttaatctgaaataaaagttgaaattattaaaaaagaaaacgaaggccgggtacggtggctcatgcctgtaatcccagcactttgggatgctgacgcgggtggatcacatgaggtcaggaattcgagaccagtctggccaacatggcaaaactccgtctctactaaaaattcaaaaattaggcttggtggcacgtgcctgtartcccaagctactcaggaggctgaggcaggagaatcacttgaacccagtaggcggaggttgcagtgagccgagatcgcaccactgcactccagcctaggtgacagagtgagactccgtctcaaaaaaaaaaaaaaaaaaaaagaaagaaaacaaaaacaaataggacccatatccctggattgttgaggaaatacgtgaacatatgtggcacacattatagtgtctggcatacaataaatactttgtaatgttactggtgtyttcttaccgttattgtctcactggtgaccgtttgaaatgttgaagctttattrttacagataatggtggatatagtstcttccttgtttattttttgacagaatctttttttaaaaaagtttttatttgtttggtgagaatttacttgttacaggtctagtgctgttatagttgaatgttttgaattatgtaacttaagtgaaacataaagctatgacttgaattttgtggttagaaattttctcagtygattgacaaggatggcgtattggccaccttttgccgcagtaacaaacaatcccagactctcaaggcttgcaaaaataaatgtgtgtttgtttgctcataacacatgtggctgagggttggccrtggctccacagtcacrggtgggctttcctgggctcagcttctcacagcgtctccttgcagggcccaggctgtaggagatgtcatcagggcctgcagagggcaaaacctcacagaggcttctgttcatacattgttgtacctcatgtgtgcgtcatattgtcatatatcaatggcagtagccaagaccaacagccaagaccaatgtattctgcccacaggaaagtgaggcaaaggcagggagggaatgataattgtgaacaaagaattcacttgaccaaagatggttttcttgatatggttgccacttacctttcagtaaaatagcacttcacaaatttgtttaatgttttatctcaagctcccagaagtagctaaaaccacgaacatacatgttgaaaatttcaaaagggaaaaaagaaaagaaaggcacatctgagtcaggaaaacattaactagtcttatttctgagaatcaaaccggtggtcttttcagtgatcagtcaccccattaaccacacatgaatggcacaagtaggaaatgcctgctcagagtccctggaagaggtatccagatttatggctcatcccagacttctctaatcgaggctgttttccctctagatgccttagtcaatcagtaattaatttgaaatccaaagtttcattaagtgttattgagttctcgcacactgaccatttgtagtgctatatttcttttaaaatcaccaaaccatttttcatactgtcgtttgcatattttaacagaaaagattgtggttctggtgtgaatgacccagttttctggatatatttacttgaaatgtcataaacttattatccttctcttccacttcattgcttttctgcttttctgaagtattttgaaatcatatttaaaacatcattatagcctctgaattctatctaaagcataactaaactttaccgggtgactgttttcaaaacaataccaagaagctggtcttatttagatctagtcttatatcattgaaatatcattagaattcttatggaaaatatgttttggctgtttagrggatgctaggggctggaagtgagaaggtttcaacaccatatgggtatgtgagtatagatgcttacaagaagaagggtagacttagccaaaactaatttgggatttttgtttgtttgaattgttggagggtggatgagagtgaagacatatcctttgaaacttaattaattttatttattattannnnnnnnnnnnnnnnnnnnaagtagctaaaaccacgaacatacatgttgaaaatttcaaaagggaaaaaagaaaagaaaggcacatctgagtcaggaaaacattaactagtcttatttctgagaatcaaaccggtggtcttttcagtgatcagtcaccccattaaccacacatgaatggcacaagtaggaaatgcctgccttctcttccacttcattgcttttctgcttttctgaagtattttgaaatcatatttaaaacatcattatagcctctgaattctatctaaagcataactaaactttaccgggtgactattttcaaaacaataccaagaagctggtcttatttagatctagtcttatatcattgaaatatcattagaattcttatggaaaatatgttttggctgtttagaggatgctaggggctggaagtgagaaggtttcaacaccatatgggtatgtgagtatagatgcttacaagaagaagggtagacttagccaaaactaatttgggatttttgtttgtttgaattgttggagggtggatgagagtgaagacatatccttttgaaacttaatttaatttttatttwttattattattattattttcaattttttatttttattattattattattttctattttttatttttattttttgagacggactctcgcactgtcgcccaggctggagtgcagtggcgtgatctcggctcactgcaagctccgcctcccgggttcctgccattctcttgcctcagcctcccaagtagctgggactacaggcgcccaccaccgagcccggctaatttttttgtatttttggtagagacggggtttcactgaagtagccgggatggtctcgatctcctgacctcgtgatccgtccgcctcggcctcccaaagtgctgggattacaggcgtgagcaacttaatttaattttttaaaacaatatatgtctctttggagtcagggtgtttgttacagtgatgttttgcagacaggtttattggaactgcttggtaggtgataggtttttctttctgttttttaattaaaaaataagattggccgggcgtggtgtctcacacctgtaatctctgcaatttgggaggccgaggcgggtggatcacctgaggtcaggagttcaagaccagcctggccaacatggtggaaccatgtttctactaaaaatacaaaaattagcctggcgtggtggtgggcacctgtattcccagctactcgggatgctgaggtgggagaattgcttgagcctgggaggcagaggttgcagtgagctgagatcatgctactgcactccaggctgggcgacagagtgagactccatctcaaaaaaaaaaaaaaaaaagatttatgtcaagaattcacatttctggcctctcttaaaaatattggaagacatggcaataattatctgggactgaatagcagctgcttctttttgggacaggtgatcacccccaaccccaaacccctacccttaactcttctactcctttggatgttatccctgcctggtttaaccatcaaccctctaactcccgatccttttaaacttcctctactctttttattcttagcacttagaacccactaacgctctatgtaactgtcttacgtgttccatttcttgtttctagactgtctccctccagtagaatgtgcgttctgctatacagcagtgctgtgtgacgcgatagcaggtcctttttaaacatctgttgaaggagaaaatgaaggcacacgtggccttgctgacatctgagtttgcaacttcttttatgccttctgctaactgggaccccagtgggcttccctgctacaccctctgaggttccccagwcctgccaagctgttccatccccagttccttggtgcctgctggtacttcmccctggagagcccagcccttccacttgttcagatctcagtctctcatctgggagggacagcttgagcactatgacctgtgtgaagcttttcccagtgctggcagactgactggaacctgctccttcattaaacctgacagatgcctccacctggcagttctaccctaagaccatgaacttcttgagggagggagatgtgacttttcatccctgggacccagcagctggctcacctcctactggttagtgggtgatgattggatggcttccgaatgaactcaggtgtcttaagtaccgttggtcctgacaccatggccaccttccagaaatttccacatgttaagattgcagatgcaggctggacacattagtgatttctaagtgctaagaaaaaaaaagagcggctcacacctgtaatctcagcactttgggaggctaaggtgggcgaatcaccccaggtcaggagtttgagaccagcctgagcaacatgacgaaaccctgtctctactaaaaatacaaaaattagccagacatggtgctgggcatctgtaatcccagctagttgggaggctgaggcaggagaattgcttgaactctggagacagaggttggcgtgagctgagatcgcaccactgcactccggcctgggtgacagagcaagactctgcctcaaaaaaaaaaaaaaaaaaaagaaaaaaaaaagattgaamatgtggaatatgagacaaatgaaaaagattgaattccgttccaactgggcttttgaatttattttcgcacttcctattttttgagcccgggagtgcaagatgtaagctaagaaaagataagatgaaagtattgctctaacattctggcttccttctattagagaagaatgcaaatctttgccttatctcgatgatgggccccacttaaccctttgttttactgagagcacttttctgcagatgatcaagtggaatttactatgatggcctgtcaaatcttgaaataatctacctttaaggaagaaaagtttaactagatgattgtaccttttagccatatctacaattaatttgaatgtattgcaagctgtttaaaatattccattagtgaagaaggtaagcctagcttctggtaaatacactactaagtgtttatagtacatttcatattttacatgatttcctttataattctgcttatcttttcattctaattccctgaaggacatataaaagaacccctaaagagagtaattactgctgtactctttaaccaaggctccttttgcaaagagaaatctgagctgctttttaaagaaggccgtttttaaataaaaatgcaaataagctactttgtaacyacattaattacccacctagcctcttattaccatgtttgtattgtttgcaaatactatttacagtcgtgtggaaattaacattactggtcctgaggaaagattgtgttggggaggttgtgctttggaaccaattagggcgaaccttgtctccactgagactctggggaaaagcacagccttgcaatgtcaaataatagcattagctctgactgtacaggcagagtgctgtaattatattattggccctattttgcttctgcaatgaatttcattgcctgcattgtaaaatcagcaggtagcaaagtttctgctaatgatttaatgtactctctgatcattttggacaaaagtcatggtaagatccacaaggcaattttatcatccccactgactactgcctggtttaagcattttaagtgaagacaaaacatgattctcatctccttgtttcctggtgaattccttcccacacagaagagagaattacttgtctaatatataatttcaggcataaggagaaggtgatattgcattgcaaataatagcagttagtgggagttgagagccagctctgcaccagactcgtatcagccacttgacctccattattccttattccttggtacytctgcgccatctgtgatatcagatccttttttctgcaaggaaactgaggctcggcgatactaagaaactcagccagggtccgtcagctgtcaagtggcattgctggcacccagattgagggccatctgactccaaagccacctgactctttcccatataccacagtttctaatacgatattataccaagctttaatatgagcacacctcctggatgatgctgtaaattagttgcctcccaccacaccacatsaagtataatggatataatatgatttttcagaattcagctaattacctactgagctttacattttgtaacttttttgactgtccatcaaaatgtctttgggattaaaaatttttttcatatgttttgaggtcaatttgaatctgagtttaataaacgttaccatgaaacatttctcccatctttttaggaaatatctgtgaataaactcattttgtgatagaaggctgtgtgtttatccagttttcatcctaaggagagggggagaagggaaataatacttcacgtctttattgcatgccaaacgtttatagacattatatgatttcatcctttaataaccccatgaaaaggatgtcattgtcttcacttgacaaatgagggagatggcagtgcaatcaagacatactgacaaggagaggaggtgagcgacttgcccgaggccacgctgctgataccttggcagaagcagaatttgaaaacagagcccccatatgttttaactgctcattggaaactgactaggtcacatactcctcctccttccctgtactggtagtttttcttttattttttttttaaatttcttccattttctttcctttttacagcaaatttgtagttatggtggagcaaagggcagttttcactcctcttccctaaaactgtagtttaactaaaaagtggccactgtctcctggtagcrgttggtaagccatccagtctctgcaggcatctacgctccaggtctccagtctgaggagtctsgctcctrgggcaggtgcctctgggggtctctgccaggcttgtctggtcatgcagctacttccagactgattcctagatcttgcatttttacataggacatccccagcattcaaagaagatcctgggaactggattcctaccagaggaattagaatgaaaccaacaaaactaaaaacgacaccctcccccatcccccgcatccgatacacatgcaaggtaatatttgatgtcagtaggaaaaaaatccagtgttataggagacaaaccatagcaagcaatggcctctcacccttcccttcacaccctccactctgtccacttgtttgttccttcaataaatactratggagaatgggctctatgccagtgtttctctggatgttggctgcagggatgaacaaaggcaacttctaggagaaatttctgtttttgatgctctcgtggctgcttcctgtgtcttaatattgtgcttaaactgccacttcttcagctgttgatttcaggcactatctaatgacttttgctgttacgagcatggatttagctcatttttaccatcttccctagttgtatcaccttcctcccattatgtttgtaacttcagattttgtatatttcrcatatgtcaatatgtaaacattttatatatatatatatgcatkcacacacatgcatacatatatgtaatggtatatatacatgtaagtttccatttttgctcaaattgctctggacagttctttgctctgggagttctttactccctttctcataagaagaggctgtttgtaccctgatcaatccctctacctcttcttttcccctttcacccgtaacttctgctacttatacttctgccttatcatggtccataacattcaccttccactctgtagccataattaaatctcccatgcatcccactttgggaggctgaggtggatggatcaccaggtcaggagattgagaccatcctggctaacacggtgaaaccccgtttctactaaaaatacaaaaaattagccgggcatggtggcacgtgcctgtaatccaagctactcgggaggctgaggcaggagaatcacttgaacccaggaggcggaggttgcagtgagcccagatcgcaccactgcactccagcctgggtgacagagcgagactccatctcaaacaaacaaacaaacaaacaaacaaacaaactaagaacarcaacgaaaaaactcccatgtattatctatggattgactgtaaaatatgagaagcaataaatatgttcatcactagggccatctagaaatttctaacccaagggtcaactaatctttccctgtgttgtatttcctgctctgcggatccrgcatcatgacctttgtactacccaggaaagccagtgttctcatgggctcttctcttttttatgctctaccagatgctagcactgtggcatgccattcgctcactagcagcttaaagggtacaggttctaaatctccttagtgctactcacctgttatttctgagcctgcgtagatgatcttcttttattcagacgtctgtgtcacatatacatgacatcctacccccttcccataaaaaaaatcacatttgtgaatgtctctcttaggctgagttccagactccaagatccctcttctctcttgtcagaatccagcagctgatggcatttatgtctgtagatttcactgtcaatgagtcattgacaggctaagcaggctgttggatggagtgatcaatggtatgagggaaaacactaatgtatgcaagaagagccatttcctagtaggaaaaatatttatgtatggagccacaaaggtgatcgcttcagtagaaatcaccaaggacctggtagtcaatgtgcaacctaattttctttcaaaagctgtaggaatggcaagggaggaaataaataatgcatttctttatatctcctgttttaagttactgagtgtcgccaagagatttctaaggccagacattgagtcagctgtaaaactggaaggagcaatgtttgctgactgttgcctcagccgctgaccctgatctcctctgcacgtagtaggcagcttaaaaattcctcgcccgacttctgattttcacgtgactcactgcttagttgtctgggtttgttttaattcctttccccctgctgacagttctttaagtggatgtctataaaggttggggcattcgctcttacaacaataggaaaagaaaggaggaaggaataaaaaagagagaaaaggaataaaaaaaagtttggtttagatgtctgatttctctgagcctcagtttcccagcatgtaaaatgttgtgagggctcacactggtcttgtccaggtgcttagtagagcatccattacaccataaagtatcacaaaaatttttaatatcatcattattactgtgctttcccttgagtttttttttttttaaatcagttaatccacatactggcagatctgacttccttgttttaggccctggggaatttttgttatctgtagagctggattaattttacagtgtggtgcctttgcccaaggtgaacctgtctgtttatagaaagtgtcaccaagttctgtcttgggcccgtccactcggttatatgtgctggaccctgggtggaagcactttgcacgtgtgcattcaygatgggctgtgctggaggggaaaacaggcatcactcccaaattctattcatgcaattaaaaattcctttcatttttatttgtgagagggtatgggtgcacagcagacggcaaacagaagaaaagcttttgattgaaaggtaaacatttacttctgccttttaaatagacatagcaagtctctttactctcatggaagcagttataaggaacatagagctgaagagaatatgaccatttctggtcttttactatgctcgtattaatccaccctggatagaagggactgtactatttggaaacacctaaataaaatgtttttgtcttaaggtgttaaaatgtactcattaatgtggcagtgtattccttttcttctgtgatcgttgaagtagggaaggaatttcaactaagaaccaaaatgattgtctgttaagacacttattttttgagaagacaaattaatataacattattatgtggggaatgtggaaaggctaaggttgtattgaaaacttattaagcttatgagaatattgaaagcatgaggaggcatgaccggaaggtattaatgatttgggcttgattattctaagactgtattctaagtctaaaatgttgataactaagacctgaaatgataaatgtttggcaaaaccaaataaatgagtagcaggttgaaaaaagaggcaagagagaagtagatatttatagttttctaaaacaatttagtcccttctggaagagagtcctacctcagccatgcctaccaggttgtgtttgtgggattatttctgagtcacccttaagctcatctttacccctctcccagacccccagtcccctcactgggcattccttggattatttatttatttatttatttatttatttatttatttattgtttgagacagtctcactttgtcaccaagtctggagtgcagtggtgtgaccttgrctcactgcaacctctgcctcccaggttcaagtgattctcttgcctcagccccctgagtagctgggactacaggcacgtgccaccatgcctggctaattttttgtatttttagtagagacgggattttgctatgttgcccaggctggtcacgaactcctaaactcaggcagtccacccgcctcggcctcccaaagtgtaatcctggattataggtgtgatccaccacacccagccttccttttgtttttgatttttcctctttaaactctacttgtaaccacccctttcctttcccaaacttttactagcttcttccatcctggacttgcaatctggctgaaaacctgctaaataagggaacaattttgacatggctcctgkactccccacaaacctagttgatyccagaccagtaatgtcttggggacagtgttgtcccatcttcctttctaggctgggctcagattactgacgtggaagagttgttggtcctggtgcaacatgccatgaccatgaggcctctggtagaaaggaaggaatgaagggtggttctccaaacccttggcccatgcctcatccttctgttcccttccttttccaggtacgtagctggtcaggtttcttaaattccgtcgatctggctttatccattttaagccttaggttgttggaacatagctaagttggtcaccttttcaagaattgaatctcaaaaaagccatgtagacctcggttgtaaccatcacattcattgacttggttgttgatctgtttgtcagatcagttttctgtttggggaacatttttgtaagtgcatgtatttcagcttttaacattttaaaaataaaatttcattgggaaagaaatttcattcgactggagtaccaggaacttagaatgaatccatttgtcagcagtatttataccctgtctaaaagagtgtcctcccagttctctgtctctgtactgtgtccccactttaaaaaatagctcaacctctcattatatttgcaattttttgtttttttcattgcctggtgggtttttttttttttgtctttttaaatgctccatgtagaaaagaattcctggaatagttcttggaacagcgtaggtgaataaatgagcaattattttgtcctcagcactataactgatttgagaaggtcaaaacagaaaataaaaacatgtttcagtagtaccagttcctgcacaggctgtctgccaactatggaagtaaagggaatagaattaggctgtctggattatagtgggaaaacaaaacacaatcacatcctgcctcagcctatccttgaactggtgtctttagaaaggggaggtcaagtaaaggccataaggctggatggtggggaagaaagaggcctgggaacaggtgagaaactgcagagcctggcggagttcatttaacctcactgtggttctgttggacttagtgcaaaatcaagagacccacctttgcctgcccatcctgcaatggtttggggggccccaagtagatgactggggaagatgactgggaaactgcagcactggttcatgttctgggacaaatcaatattaagcaagtttaatgatgggtaggttcattcaaaagggaaatatgtttcaatggagaagagaaatttgttaggttgtataataaatattttgagtgtatttggatagaagtttatgacggaaaaggcaaaattctctgtgtctttatggggagatattcgatatgttttttcttggcagaaataaaacatattcaataatatamttaggcaaacttgtkttasttgacaagaagaccgtatctccgtctgcaagatgaaggcaagatcaagagatgtcagttaacattcttgcgaccacaggtagggaggagaactggggaggaatttatggataggtgagagcataaaactagatgcggaagggatgggggagcaggtaaaataatgaggctcaatgttcaagaaggtcttgggcaagcgcgtgctagttattttcctcactggtgtggtcgtgacagatgaatcacattttactctcctccctttctcatagtatrattacataaaggagaccttccctggaaagagccctgtgcatggcttttgagagtgggcctgggctaacagtgagtgtggaagcttgctgccttgaattctttccaattctggagagttgatgggtaacaagtgtgtatctatagtctgcttggacatggcrgtgtggccactgacacgttgtcagccatcccctcaactccagggacaggaatggtgagaaggtggtgagggcacagtctgcccggagacgggacagtttgtactacctgtagcaagagcatgtctttgagagccatagcagctggcttcctatttggagagaacaagaatgtgaaaagctatttattaccagatgtgggcagaccctccagcctttttttgttcttttaaaccctaatctctttttaaaattttttttatttttaatgtttatgggtacatagtaggtgcttatatttgtggggtacatccgatgttttgatacaggcatgcaatgtgaaataatcacatatgaagaatggggtatccaacccctcaaacatttatcctttgtgttacaagcaatccagtcactcttttagttatataaaaatgtacagtttaagttattattgactatagtcaccctgttgtgttgtcaaatagtaggtcttatttattccttgtatttttttgtacccattgaccatccccacctcctcatcaaccccccactacccttcccagcttctggtaaccatttttgtgctctccatttctgtgagttcagttgttttgatttttagatccaagaaacacaatcttagatgcatagtaggtgcattctgttgccatctgcatcatgggactgcacaatcggagaggcaggaaggccctgagaaatacctgattacacacctgcgtgctgggatgagaaatatgaggggaggagagaaaagatgagcctcatattgcatagcaagtctgtgatggaagcaaagttagaccctgttgatttttatgtcttacctccttgccattagttaggtaaatttagaccaccatattttctaagatcagagaatagagaattttaaattctagattcttgccttgtggatgttgaaaagaacaattaaaagttatttgggatatccaatcagttaataaataattatgaatgaataaactgttttgttgaagacactcttatggcagacatgaacatggggcttaaatcagttctgacatctagaagctcaaatccaggaggcagaggagttggatattaaagaactctgtggtgagctggacaggatgacatgacaattatggaagttcagagcacatagcagtcttttccagtgatggggatggaatgtgggggtcatggaagactttgtggaagagttgcaagtagaattattactgttgaaaagagatggggagttaggtagacaaacagaaaaaatgccaccaaacaataagttaggatagaaaaactccacgtatccatatgtcagttggcccatctgttcgttcatacatcctttcattcttctatccatccaaccgtccttgcatccatctatccatccacacaaccacttattcttcattcatctgcccatctgcccacctacccatccacccttccatacattcatctagtcatccccatccatccactcatctatccacccatccatccacccatgaatctatccatccatctgccaatccacccacccttccactcacccacccatccatacacacttccatctgcctttccaattatccacccttccatccatccatctacccactcatctaccctttcatacatccatacacatccatctgttcattcatctatccatccatgcatccttccttcgttgttttcttccttctatccatctattcatctacccaccccacccacctatccttcacccatctggccatccatccttctacccacaccttccttcctaccttccttccttccttccgtccttccttccttccttccttccgtcctcccttcctcccatcctcccttccttcctcctgtcttcctttcctttccttccttctctttctttcttttgttccttcctttctttcctccctccctttctttcctccctcccttcctcccttcctgtctccattattaacttgctggtattttgtttcaccattgcattgtgtttatcaatagacgattaatggaagaagagaagaaatcaggtgaagtctttgtaggatctagaatgtctaggctaaggagtttgaaattttttatactatgttctattgggaaccatttcagggttttgagatatagtatgatataataacagctatgctaaattctttgaagttattggtrgtggaatatcaatccagaatgaaaataaataattttggaaatgagcctgtcattgaaatatactttatttctcgttaaatgtcccagcaaaagtattttggttgttaaaataaaggaacaaccattagaaaggaggaggagaagaattagaaggaaaaaaaaggtaaaggtaaagtaccttggtattttagggtttctaagattaggaactttaaatgttgaccccattttggtctttaccttcaaaagacgggagaaagactgagagaagtttctaagctgatgctgctctactacctggagtaggaatgagaaaccatctataaatattacctttggtgtttccatcaaaaatttagaatttcaccctattctatttttaattctggtttaagactgaaggggttcttggtgaatacttttgtagatacaattaatagttatgaaaatcattactgattacctccagggttcagatattgggctgaatgtcttctctcaccatcagaactaccttttgactagagtgttaattattaacatattttagattagtcagacaactgcaatatttaaggaatacgtccaaggtcacacaactaaaagaagtgacaaagtacggtttcagacccttttagtcttttctgtgttgcaaaattgagataatgataatagctaatgatacctctcccttactgataattgaatgttttatgtgaattaaaaagtttaatctgcatagtgtttcatcaagatagattccttgttatcctcattttggagatgaagagactcaggcatgcaaaggtgaagtaattttcccagggccagagggctaaggaaagggagaattgggattaattctacattgtctactggtaatacctattgctcatttttaccagttaaaactatttaatgagcatttgcccactttctaaaaatatgatggtcttagttacccacatggacctactctatcccaggcagatgccacaaattattttgttttctttttgtatatatttatgctgtttcctcatttttaaatagtgggctttgatgactattcttctacataaattattacatatctgtatcatagaatcttaaaaattatttgattcaaatgtatacataattttcatatccctgatagatattgccaaatatttaccagaagtgaatcaagtagtttttctaccaacattatctaagagggcttgtcttattacatctttgtcagcactaagtattatctcccttacttttttttttttttggtaatctttgttactttgttaggattaaagtagcttctcattttaattttcactcctttaattgagaagcagaacgtattcttttttggtgacttgtttcagagtctctttagtttgaagatacaatagatgtagcatctgctatatccggtaacaggataacagtgcattgctgggatgatgaggctgcagtgggctgtgattgtgccactgcattttcagcctgggtgacagaggaagaccctattacaaaaaaaaaaaaaaaaagggtctgttatcaaccatgcttttttattttattttattttattttcctgtttctgagttagagtctcttttgctcaggctggagtacagtggcgtgatcttggttcactgcagcatcaacctcctgggctcaagcaatcctcctagctcagcctcctgagtacctgggattgcaggtatttgccaccacgcccagctaatttttgtatttttagtagagacagggtttcgccatgttggccaggctggtctcggactcctgacctcaggtcatccgcccgccttggcttcccaaaatgctggtattacaggcatgagcctctccatctggcctcagcagtgctcttctggctagcttgatcatatgccaatgttttattccttcgtggagctcagagtaagcttgttttactggacgttttctataataaagctaggggatggcgaatcattctaattaccaaaaagctgtctttgataacaatgtaggagataacgaaggcagaaataacatttgagtaattctttgccattctgtctctgaatcttgaaataaatactcttgaatttatatgttcttggtcctttaggagtcataaaaacataccgttacatatgtatatgaaacggtgagaaactgcgtatttattaagagtcacgacccttaggactagacaaatcaaattaaatctcataaaaacctgttatggaatatgaatacgtggcactattttttcttttagggtgtctttattaattttgtcatgtttaatatgttgcagttgcaaacaaaggcataaatgcatgcgttcattcctaattaatttatgtaattgggttttataaatttagctgtttaggaagctgtgcataacacactccatttactgtgtgctgtagccaataaaagcataatagaaagaaatatagtttgaagctcacttcaatggtaaatatagattagttgtaaatgatatctttgtaatgtttattttaaattttgcagtgctgcagattttctgaacataccaattaatgttcttatttgaaataatgactagttaattactataaattctaagtgctccatctctgacaattaaaaattgtcttacagctttttatttatttatttattttttttagttctttccaaattatattaagtgcagcatctggggaaagaagaatgggaatggaaggagtgtgtttaaaatgtgggtggttttgtcaattcctattgggaatgcttgtatttgaatgtatatacatatgcatatttatgtgtaatgtctatttcatgctaaatagggagtgatcaagttgaaaaataagaaatgctgtttgaatttttaaaataggttataaattataacatgaaaatcaaatacaatgggtaaaaccagtaaattttaaataagtttacatttgttgtcgtgatgtgactgtgacgttacctgagatctcagcaaggagctctgcagcccgaaaagaccaactggaatgatttgatcagaaagggaatgggtattaggctgctccactgatactttatccacttcgggagagagagccctgttccttcttcatctagctcaagccaactgtcagaaatgcatgtcagagctacacaattctatccaaggcattaactgttgtcaagtctgttttttatgaatatgtttcaatataagaaattgtcttaggyccaaagtgaaacgtcttcctccttgactcatagcaagctcatgcaggtatttgaacattgttctgtataatatgtgcacctttgagaaatcccatgattcttgctattctttgtaaatctaataccttccatccagagagagagtatacatgtggagtcaattgggagtaccttttgtatcctctagtctgagccttacaggttaaaggagaatgttggatttgcttttgaaagtatgggcttgcggagattaaaaaaaaaaaaaagaaaccttgaataatcatgtacaaatataaatactgtatgtagaataagtgtaatggatcacatttatgatgaaatatgtatgtctttccaagggtaagaccttcataattcatttataagttaccttctttctcttacatgtaagtagcagaatagtaattttcttcgttctttctgaagaattgccacacagggaatgaaaagaagaaaggataaacttttcttaaacagcagaatgttattcagagataactggaaaaaagtacgagaaaagccaaaaagaaaaaaaaaaattgtgggtcctggtgatgttggaaaaatgacgtgtgagctgaagttccagacgccgagcttcatctattttgtcatgttatgacagaaatcattacaagggtgataggtttatttataaagacttgcttcaatattcaaagtacatctattctagcattcctcattttgagccaggctgtggatcaagatgaaagaaaaattaaattgtatattgaagagctcttaattgagccatgctgtatttaacagggaagcatcggcttcaggcagtcgataccactgaggatttttaatgccctgcatcatgagactgtcagtttgctttggagaatgcaaacaggctaatgacaaagccctgcaaacttttgtagttgctgctggtctctttggaaggcaagtgctaatttacccacagttgaaacctgacacacacacgcgcgtgcacacacacagacacacastctctctctctttctctgtctctctctctttctctgtctctcataaggaactaaatcctgcgttttctcaccagagggctaatgacacactgcttagtcacccaaaacctgtttcctaaggagccactttggggcttgtttaaagtttttaatgtaaggcattatataatattagatttcccctgtttttccttaatcaatgtaaattcaattgcatttcagagggtggccaagtggcatttcatcatctctaatatccatttaaaaatgttaggtctacccagttataattctccaaagtagcctatctgtggtttaatatgttatctacattctctaaggcagtgttaatttccttttgtagttaatctatcctactaccaaatttagtatatttatagttaaagattctgttaagagctaagtgatttaagtacatctgggataaagtggccttggctttaactatgaaacaaattttctttatttcattctcttcactgataaatccatagtaactggaggcatttttagaattgtgggcaatttcagcctctaaagtttgattaaagatacttcagatattcctactgagaggctagagggctgaaaggaatttattttgggttctggccctagtgcagctcagtggaagagaacagacattgtgagtttaattcccacgctgccaatttcccacgagtctagggtgggtgttacttctcaagaaggcgatggtagaaccgctggagacttcttatggctgtggcaggggactcacacgtcacaaggagtccagaggcatggctttgaagagctcttttcattcattcttccttttgttcacttgtacatcaaatacatgctgtgggcctactgtgtgctgagcactgatcttgtcaggttcttggggaagacttcattgctgaggtgacctttgagctgagtgtatgagtgcaagagagagcgatcacacctgggaactgcttaataaagtccccggcatcttgaagccacttgcagaccttggcagttgctgttgctcctgctgctgctgctgctgctgcattgtcaagactacattgatgtcttggaaatatagaaaaaagaggmtgctggactgtgtgcttagaatcwgtgtgctaactctgttaccaacaccgtagagaagtggttccagaaggaagagttcagggtgagaatgaataacggagtggctttgcagtgggaacctggctttgcagcacagctaggattggagaagatcttcccagcagggagaagaactcaaagaacatgcatgaagggaggaaggttgcaccagtgggagggaccagaatatggtgtggaaagaacgaggttcaaatccaggctctgtcattaactgcccctaccctctctgagctgagtttgttttggacactggagataatgcatgttaacatcctggtagctctatttatttgctaccatggtacataatcatgggagctctatttatttgaacatcttcttttgttattatttggtgtayttgggaaaggcatgtgggagcagcaagcaggtgagcatcctgtttggaatgcagggccgggaactgccctgcccagtccagcctcattccagaggctagcacctggcctcagctgtagagctgctgggagcatttcagctctctgcttctttggcagtctagtgctgtcacagaaggaaagctcactccatggaaaaggggggattgatttcttctctgagggcagaggctgatcartctaggctggtaggaatagatgtaacctcagaggaaacaatttgcattggcgaaagcaagtcaatggccatccccaaattcaaaaggacagggaagtgtaatcctactgtgatccctaaagcatccaggccccaggaatggtggtgatttgccagggggaaatggaggaacaaccccttctttgactacctctgtagtttatattggattctgcaaagtcccatgaggactgatagatgggctgtgtctgcatttgaattttgtagctgaaatgtgggtgagttcacctaggtccccttcatgacaaggtggtgagaaacattttcttgttctacaaatctgaattaggtccacgaaagagggtatgcagcatagagaggaaccaaaaaggacgcaagatttaggatagatattgccccttgggaggcctgcctggtctgcccttgataactcatgaacagtctggtaatgctggaaggcaaagtaaaagccaacctcttgagaaagacatggaacacaggatggaacttgaactgcttaaaatggcttttctcaggccagctgcactggagtgtgctgctgtaacaaacacgcccggatctcagtggcttagcatggtgaattcatttcccattcgtgatatctgaccacagatgggaggtaaggggctgtgctttaaagtcattcatggatctggctgggcccgatgcctcacacctgtaatcccagcaacttgggaggtgggcggatcactttaggtcagaagttcgagaccagcctggccaatatggtgaaactccatgtctactaataacacagattagtcaggtatggtgacgtgcacctgtaatcccagctactcgggagactgaggcacaaggattgcttgaaccgtggaggcagaggctgcagagagctgagatcatgccactgtactctagcctgggtgacagagcgagactgtatctcaaaaaaaaaaaaaaaaaaaaatctttcagggatccaggctgacctcagcaccatctcttacatgtgcctctgttctttccctaatataagggagcatgggggattagtgtctggcttaagcacttccactcagaaatcttgcttctccccacaatccattggtgaaagcaaggcaatggtcatgccccaattcgaaagataagtgcagtcctactgtgtgccctaaagaattgaagatcaggatacttatgagcagcgctcacaactgccatagtggcaatgcgaatggcatctatttttaatgtgactgagaaaataattggtcagatattgcaggatttttgtgggggagagggtggaaaagaacttacagattaaaaaaagaactggcatagcacctagattttaaacagaaggaaaagatgacattggggaccagagacagaaatttcacttctgtgccatgacaaataccagggagatgtaattgcaaaatgaagctgcaaatgtcttacccagggaactaggtgacaacctgcttggcttcatgaagaaggaataatatccaattaggctaagtgtattcggtgcctgagtgacaagccctggagacctgagggcttctggggcccccagggcggtttcaggaggctgtctccagacctgtccggggtgtgagcatgtcacgctgtgrcccgcgcctcccctgtacagctgcctctgctcttctaagcactgaaatgagaggtgtaacctgtgttccagagtctgcgcctcccagccactggggcaggggcacctggcccatcagacttaccttgcctcccctgctgcccatgccctgctgcctagggctgggctcatgactgggtccacatcagctccacattgcagactgaccccctggaccctcacgtctcaggatccctatctccctgtcagtgctttgtcacccaaagtcaccgcagctcctcttgagtgctttcaagatcagaccgaggggtcctagttcaagctaattcctacctgtgcgatcactagccaagtactgaacctctctgaacttcaattatctcatctgtaaaaggtggttggtttgtaattgttcctaccycttagggcttttgtgagagtttagatgataaaccaccaagcaacagtggctggcattctgtgcacaatcgawgtctgctgctgtcagctctgtggtcgctgtctgcactcccacccctgtcatcctccaagtctgatctcctcccgaagtctcttcctggacctcagccctcagggattgcacctccctctgaatatgctgtcccttctaatcatgccatttagccacactgcctagcactttcttttttgaatattcgtgtcccaggtccctgaaaaagttgctaagcctgctaaaagcaaggcaaggcctttctttctttgtaaccttaatgcccagcaacgctccattcagtttgaccctcagttggcttcatactttgattttatgtctttatttgtttcttaatgagctactttatcattgtgaaaacagttaaatatcaatagtcaatgaataaatattaccaaaaaaaaaaaaaggtttgtcgtttaaaaatttggagctgggctggaaactagggatactacttggtatattttagttctactgatatgacagtatttgatacttaatcatattcaagcagctttacagagactaccatgagaatgggttaaattaagaggattgtctttgctgtttagccaatatgggccaaagttcagtggtttgagacatggcggggtttggtagtagatgtaggatattgctggggaaagagtgttagaggatggaagattgcatgatatttctggctttgctctttgactgtgtgctgtttgtaaaatcacttaagtcccatgggtcattttcttccccatatcaagcacctgctatgtatcaggtgttgtgctcacgtggtgttttatgcacagtgtttcctctttgttaatcctcatgatgattggtatggtttggctgtgtccccacccaaatctcattttgaactgtaatctccataatccctacgtgccaggtagggacctggtaggaggtgattggcccgtggtggcagtttccctcatgctgttctcgtgatagcacgtgagttctcgtgagatctgatagttttataaatggaagtttcccctggccttcattctctttcctgctgctttgcgaagaaggtgcttgcttctgctttgccttctgccrtgattgtaagtttcctgaggcctccctagccatgcggaactgtgagtcaataaacctctttcctttatacattacccagtctcgggtagtatcttcatagcagtgcaaaaacggactaatacaggttgggcacggtggctcatgcctgtaatcccagcactttaggaggccgaggcagatggatcacttgaggtcaagagtttgagaccatcctggccaacatggtgaaaccctgcctctactaaaaatacaaaacagccgggtatggtggtgtgtgcctgtaatcccagctatttgggaccctgaggcaggagaatcgcttgaacctggaaggtggaggtttcagtgagccgagatcatgccactgcactctagcctgggtgattccatctcaaaaaaaaaaaaagagaaagaaaacagattaatacaatgatctgtgagatattgggactgttcttattcccatttcacagatgagccactaactggctcctggcaggacagtgaataaggggcacaacagagacacaaacacatsgctaaccaatggtctcatccgtcagccacactgcctgtctcagcatgggccctgtgtggaccattccatctcaatttgtttctgattcttgtcaattcaataagaacagctgaaaagtaaaataataaatatatacataaaaacaatggggggagtaataatgataatagatacaattttttggtctttataatccccagagcctggcttaattattttaaagtaaatcaacactttgaacacttgcaggttagaaaaccagtggactgatggatgcgttacagccattgtttccaagtgtattagtttctgctggccgctgtaacacattatcaccagtgtagcacctaaacaacacaaatgtattgtctttcagttctgtaagatagaagtcctacagggttctccttgggctaaaatgtagttgttggcatttctttctggaggctctgggggaaggtcgttccttggccttttcccatgacgtagaggctgacacattcctctkctatggcctcttcatttttcaaagccagcaagattgcatctctctgtctttcttttgtggtcacattttaccaggactcttctcctgcttttttttttctacctttagggatctttgtgatttcatttggcccacctagataaccagggtcctctccctatttatttttattttatttgtgagacagagctttgctttgttgcccagactggagtgcagtggcttgatcttggctcactgcaacttccgcctccagggttcaagcgattctcctgcctcagcctcctgagtacctgggaccacaggcacatgccaccatgccagctaatttttagtagagatggggtttcaccatgttggccaggctggtctcaaactcctgacctcaagtgatctgcctgccttggcctcctaaactgccgggattacaggtgtgagccaccacacccagcccctctccctattttaatgcgaggtaattaacaaccttaatttcaccggtaacctgaattctcctttgccacgcagtctaccatattcacgggtttcagggattaggacctggacatctttggttgggaaatgggcatcattttgtctaccacaacgtgagagcccattgccctgcatccacagtcataaaagtctgttcccttcctccctgattcttcctaacttctcctgcctgccttgcaggatatgtggagttatcagttcctagcaccactggccaaagcgaggatagctgattgcactcctactttcctgctggtggaaacagcatgtatataggtacaactctggtgtggggaaaatgctaaagatataaagtagaaatagcctttgtgtgatgtgagcagcagaacaaaaatcgagggtgccaaataatcgtatgaagtggtgaactgcctaagatggaatattgctgttcctaaatcctggctgtgttgagacatgtgatcctgccgatgagatgagagctgaaccactctcttctcccagatgctgggcttccgaccttaatagagaccgagaaacttaacagagggctcagaagagaaatctattgaaagttactaggtgccaggtgtctcggaaagtgtttaacacatgcctgagacgttaaaggcaagattcatgcattctttcagcagacagtttcttcacttaccggggaagggggtgtaatatatgggggtatagggataaataattctgtgtgctgtgcaggccgtggagactcatcttctgcacaggtcaagttctgaagtcagcatataagctggaagtggagtgaagtcaaatgaccctcaaagatccttccagacttcatgcccttggcaactcagtttggacactcatatgctggtttcttccttgtatttatgcagcagcctccttttccacaaaaagcagaggccaacgtatctcaccccctcaatttttttactttccctctccctccctgtgcttgcctttcttttcttttcttttttctttttaagacaggctctcactcttgtcacccaggctagaatgcagtggtgcaatcacagctcactgcagcctgtaactcccagactgaagcgatcctcctgcctcagcctcccgagtagcttgtactgcagatgtgtgtcaccatacctggctgatttatacttayatttatgtatgtgcatgtgtgtttatatatatatatttgtagaaatgggattttgccatgtttcccaggctgggctcaaactcctgggtttaagcagtcctcctccagcctcccaaagtgctgggattacaagcctgagccaccatgcctggcctttgcttgcctttcttaatgtctttgacaattcatgtaaatgtgtgtatgatgtaactctataggactaagggtgtgtgaggatgccaggaggctgttggttgacaggagtcatgatttgactatatgaggtcacagaaaatgctttttaaaatttaccgccaacccacaggaaaactattctccttcttctaaggaaaaaaaaaatgtcacgataaagcagctacattaatgacaggcacatcaaggttttaacgtgttctctagatttatgatgtgtagcgtggtctccattctagaaagcaaagtagggaaagcacgactttggggccagggccctttctggttcagaatgtccctggccagtgtgcgccgtgcagtgtggaagcacgcttcggtgcgcrtgtaagtttacgtgctatctgtagggacagtgatttttattcattagagtttttgagtctaattgtttttaaactgccacttttgtttgttaaagatacagatgtctggccatagaggaaagcaaggtggatttatcgttgcaattagatgcttcacaatttgaaaacttatcacttaaattggtgaaatgtcacttttatgcaacttgatgtttagaagtccttggcgtccaggactaaagtcatgtgcaatttaacaagatcttggtgagataaaggaagttgcgcttgaggaaacattgaaacacaccagatggaattttccarttccctcctacatgatagagactaggtgaagggagatagaccacaaattgattttgtgtaactcttaaattaagtggagcagagttaaaaaaaaaaaatcactggatttgaagttggcctatgttagattactccaaggaagttagttaatatgttaatatgaatctagatgaacattgagtgttttrctcttcttgttaatttgcgccatctactaatctctggacaatggagaaaaagtcgtaggttatgagttttttatttatggacattaagcaatatctttaaaatgtaaaatgaagccgacaaaatgcacagccrgataacaacaacaaatctaatctaaagtgacaggaagagactctcccagacatttttctctttaatgtaacatgactttaaattgatgcaaccccacagtgattgaaaaactctcagagcttgtctcctatgattacatttctgatctgtacaacttaattttttaactcggtgagtctcagttttgcgaatgaacagttctcttttgctttctctctcatattatttgggaagacattatttggcaaccaggcagataaagctctgttaccacgacgaatactgagaagtcctaaaacaataaagaccccaagaactcaccctggaatatgtacctccaaatctcttctcttttccttctctccttctctttgtttttctttctcttcctgttctcttgttttatcttgacttctctcgactgtggtgacggtttgcatatatctgcgattgtactgaaacttaccaaacattgtacgttttaaatgggcaaaatgtatttgaactatatatatcacaataaagctataatactcttttaaagtgtctcctgaatcattaccagtataattattctgtgaactgtattttgatgaattcagaattaatttaaaatggattatccccctgtagaatgggaggtaatgctgaatgattgtgaatgattgtgaatgtttgtttattcggggtactccctcaaatttcttatccagtggtgtctagaacatgttgggattttgtgtgatagtttcttgagttggaaattgcgtttctttggcctcccatgtgggtatcaatgagttttacatggtttaaaggccagttatgtgatggatacttctattaccttatgtctttctgatttcatacacttaaatgtacagtttttatcttccttcaaaaccttatttttccragcaagttttatttattcactttcagtcattactgaagtgaataacaaacatataacagatgctattttgggtcatagctgttttgctaagtaatacttaaaggctttctgactatatttttaatttctcgacagtctcccatggttattttctgatcataacttgaaaatcaaagctttctgttcagtttaaccatcttttaaaacccagtggttttagcttgggtattaacctttaacatagctagcgaaaattgaacatttttatttgaaatatgcttaatgttgtcttgtgtaagacaaaaagtttagggacaagtgaaccatttacttttcttttaatgtggaaagcagtttacaaatgctggtatgactaacaagaatgaaaggaccagaatggcagttctgagctagaatgtgatgagtaagtaccaccatagttagcggctagggaagggaggttgttctacagagaaacatgcccatcatttcttctgttacctggtattcactctggcaatttctttttggactcattctaaaatcaggattaaggatatccactgagaagcttgcatttattactctaagcaagaaacttctatttaattttttaaccatttgattcatatgtatttagattttaaaatttcattttctcttatccaaatgtatcatatatctttaagtaggtgaatcttggagtagattttattatatatcacatcacagagttaagctcggttcatctggattttaaaaatctctacagctttgagaatgactttgaaacactctttactgttggagcttaaagaaaataaatctctaatgtcctctgtattaattcacctgcttggaaagttagagattaaaaggtttagtaggatttttatattttctataatttctatttgtattggagtaaactgttcgttgtatggagtggcttagctttcataaaacagaaagattcctatattgagaaaagaggaagaaggaaaaagtgtaatataaatacataaaacttcctctagctttcttgtgttatgtgtaaaggagttagtacgttactttaattgtgtactttgaagaaagcaatctcctatttccattaatggtggactctgtgggtagagacatggatatttttccttttataagaaaggtcttgtctttcctcagaaggcattgtgagcaaaataagggaagaaaaagagaagtagataagaaaaacaaatcacaatattgaagcaggacccgagtactatagccttcctcatattttggtatctggaaccgaggttgctaattaatgacccaagagctaagccttgtttgatgaaatgcaagatgtaatacacagattgccttggagtgatgtgtgattattaccatccattcatgtgtaatcccgtatttggaaggtttgtaatttgtttttgacacatttctctctgattttatacactcatgcatacaggtctcacctccctccaaaaccttatttccaaagcagactttgtttgtttggtttgggtaattcattgggccctatttgtcttccttatacataatctattttcttactgctgcctctgtcttccaaaccaagaatataaagaatgaagcctggggactggaacttaaaacttctgccgagaaaagaaagtcaaggcctgtgggctcctaaaacatcctgtggaattcgcctcagatgcccctccatttgcactggtatatggaggatgtttgaaaaccaccagaacctattgtgtactttggaacaatggcattttcctgcttgattgtgaagatggccgctggaaaagaagccaactcccagggggcacgaggggctaagctgtctcctgggaagtttgagggaggccaagtgttttccagttcatttccaaygcgtatttcttcagggccaagggcccagctgtgcctcattaggggtgagagtttggctgtgacacgacttaatagaaaaaaaaaaaaaaaaaggagaagtccaactagctgagtggcaacagaacttgggacaacctgtgcccacagcctttcatgtcctgtaatgagtgtgccatttgctcactgggaggagaaaaaaatgacagtatgcaacagtcaactttttcctgaagaaagagagaaaaaaatacatattttgcagccgagacatcggggtacctgttaactttaggcacagcgctagtgtcagccctggaaagagactccctgtgaacagcactttttaccatttaatcagcctgtacttcttcgtatttatagccctggcgaggctggcccattgttacaagaggaaattgtgatgttcagcagtttataccttgggagctggaagcgtttctccatggtgaatttgtaatattaattggccatgtcagttcatgacaaatgtagtracatctatttcaagtatttcagttttatggtgctgaagaagtgacacgcgctccagataagtaatctcacaaaagatcttcccgctcgctgtggagcgcctccagaacatgctctcagaggagatgcaaataggctcagggttcagggggctgtccccttccttttgctcaaggctcagaggggagccagaggaatgcagggagggacgcactccctgtcattcccctttcagtctcaggagattctggttgaagctctggcatggactttcctgcccaagaagtgtccttgcggtgatcatttatgtgatttgggtacctgctgcttgtaggctgtgactgtcagtagcagaaataaatatattgcctttctcactgtgtacagtggtgctgtaccaagggtgactctgcccatcaagggacacttgtctggagatatttgggttgtcatatcttggaggagaataggctgctattagcatctagtgggtaagagcaagggatgctgtagaacttcctacaatgcacaggcgcatcctacaacagagaattgtctggccccaaaagtcaatagtgctgaggctgagaaaccctgcacttgtgtggaccatgcccttttatgcttttcaaccttgaagcactaataggtcagagaagaatgccagggatgtgttgatgggtctgcaagaggttgatgggggatgcttgagctcctaccaagtggaaggtggtgtaggcaaagagaaggatgcataggcacattggacggtggaaggcaggggctgctgaatgatgtggcaggaaacatgcaaagtgctcagcgtccctgggcggtgcagagtcttgggaagcaagaggatggagccatcctttcagtttccagcctgggtttcccaaaggagagggtgtttgagttcagtggcagagagagtggggaagagtgttggagcccagctgagtggccacctttgtcaaatggagctgagaaatgattttcacatggctggcgtaatggcggagtttccaaaacagcagcacaacaaaatagccatttacatgtcaagactatattcatagaatccatatgtctaaggtggggaagttgtcattattcctgttttatagatraggaaacagaggcccagatggagtaagtgactgctgaagtacacatgatttgtcagtagaaaggaagagaccaaaggtggcatcaactttatctttccttcttttttttgagactggagtcttgctctgttgcccaggcaggaatgcagtggggtgatctcagctcattgcaagctccgtctcctgggttcacaccattctcctgcctcagcctcccaagtagctgggactacaggcacccgccaccaagcccagctaattttttgtaattttagtagagatggggtttcaccatgttagccaggatggtctctatctcctgacctcgtgatccgcctgcctcggcctcccaaagtgctgggattacaggtgtgagccaccacgtccggcctgtttttccttctttgttaagtggaacaagtcatttttttggtggtcatttccaatatgtaattcctgataacacacgtatatattatctctttaaaaattaaaaaaaaaaaagccagccaaaaaaagaaaatggaagtgttcaagaaactgccttttttcatgtaatagtatttctgtgtcactaaatccttcaacagcattatttttaatagctgcccaatgtcctaatggatgggtgagtcatgatttacttaaccaatcccctgttgttggacatacaggttattcacagcttttctctattgtaagtggaattgcaatgaatgtttttgtagtacacaccagtgagtgattccttggtgcgcttggaagtgctggttccaagaataagataaggctttgagattaattgccaaattgctttcttgaaatattgaggctactattttccagtatcttcactaggaataagtaacgtttttctaaagctgagtagtaagagaaaggtagaatctaattttactgtgcattttcttgattattagtgaagctaaacattattttttattgatgtgttaacaatttctttcttttgcaaatgatctattmatgttctgtgactgatttctatcttggtgtctttacgtttgtgaatggtaagaatttttatgtgttcaggaactatttaaatgttcaagacattaacctgtggttatgtatatcacaggtacagtcacatcgcttaacaagggagatacattctgaaaaatgtattgtcggaattctgtcattgcatgaagatcatagagtgtatttacacgagcctagatggatagcctactacacatccaggctatatggtatagcctcttcctccagggctatgaacctgtatagtatattactgtaatgaatagtgtaagcagttgtaatacaatgggacatatttgtgcatctaaacacacctaaacatagaaaaggtacagtgaaaatatggtattataatctgatgggatcggcattgtgtacatagttcgttattgactgaaatgttggtatgaggtgtatgactatgttttctcatgacctctgctttttttgtctttaagtttttaatttttgttttacttttgtcttttaattttaattctattgcaaccaaatctatcagcctgtcttctatgatctctgcttttaattgttacsctttaaaaatccttctccatggtaacattatattgactcatatgtcttactggttgaacgtgcctatgtttgactttgaaatcattaaattcattgaggatttgttttgccatgaggaattgggtaaggatccagctgattttctccagatgagtagttcattgtcccaacaccagttattgcaataagttattccttccccaggaaatatacctgggctaattaagaaaactgtgcttcaatgtaattattccaccttaatgcatgaaatattaggttaacatggaaaaaacatggcatcccatgttttagtattttttccttatttccaagcagcacctctctttgaattatattctgttctstgtttttataatttgactcccttctattctacatctaaatagtgcattgtctgttttcactcaggactttaaaaatagttctagtactaattgtatttttattctaatactgctattccttttactggtacttctgcatcttaaaaaaacaaaacaaaacaacgaaaacttggcatgttggctcacttggtgaatgaaagcatatactgttcagttgtttattcttcagcaacatctgagtatcctcgagaaatgagtggaatgaaccgctagagatgaatagccttaagccctcaaagctgagccctttggggtaacttgctctaattctgccctctccagtttgagtttaggttaaattcagcttgcagattgcaccaagcctgatgcctcccagccatcaaggaaaagggtacctaacattttgaatctccattaatcttacagctcagatcctgtgtattaaatctcagcattttcagggatgtatactctggcagaaaaactttaatgattttttttttctgatgctgcctagaaaatattagaaagaagacccttctttcctttcctttcttgtcctgtcctgtcctgtcctgtcctgtcttccctccctccctccctccctcccttccttccttccttctctccttctcctcctcctcctctccttttcttttcttttcctttccttcttcttcctttcttcctttatttctttcttcctgtattattttcttgtatagctcaggtctcactgctttgctgccattcttgtggagaataataggtaacagaggtgtgcacctggcctcatttattgtcacactggataggtaatagacgccggcatggctatgctgtggttcctgctgatgggcacactattacaggtgcatgataagtgtgtcgtacgcaggaagtacrtttcccccagccttccctacctgctgagggctgctcccagcstaaggatttcatccagatagattcatagcgcttccagtaaatgcaccccttgcctttcaaagttgaaaaagaaattactttggacacaaagaggtgtttcttttgacacagcaggcatgtgaaaaaataagcaaaaaaacaagagggatttctgttaccattggcatgtgcttctcttttacttctttagttcacaatgccagtggttcagcttcccgttctgatcctcactgctctaatctcttcatctgtgcttgcaatcacagccacgcgggctcgcaatattaccacgaaatcattttatctgttggaatctctttcctgttcattactcttttttatccccaggtagacaaacaccctaagtttacctcttgcgaattgtacgctttaaggttaaggaattcgtagttgaataagaatgacttttcacataaatttaatggagttttatcttctgagccaaggctttatttaaggagtcttgggaggtaatcatgtgttacctgagactctccgcccataggatgtagttcctttccattggaacacatggggaccgagggaataaagaatgttttcatctctgaaaatayctctcattcttccaatcaatgctgctcttttcttgcatactgtatactgggaagcatttgtttcgatttgtggttaaatgtatgtgtccactggacttcagtatccaccctttgaaggaccgcaggagaagttgttcaggtagaaacatacaagggccggatgyggtggctcacacctgtaatcccagcactttgggaggcctaggcgggtggatcacttgaggcctggagtttgagaccagcctggcyaacatggtgaaaccctgtctctactaaaaatacaaaaattagccaggtgcggtggcgcaaacctgtaatcccagctacttgggaggctgaggcaggagaatcgcttgaactcgggaggcggaggttgcagtgagtcgagtcgtgtcartgcactccagcctgggtgacagagcgaaactctgtctcaaaaaacaaacaaaaagaaacataccgggagatctggttctattgaaccccagtgcagccatgggtagaattttaggcttatttatattccatttcaccacaagatgtcaccagggcaccacaccaacatggtctatggaccctctctctggcaaatagagttatggtcatcaaacagcacctgcccagggctatggggagaggaagctggttggctttgtcacaaatgccttgatgtctctttcctcccctggggcccatctcttccagcctttgcatagagagagaaggcaggcaacaggacacaagaagattttcccagagtccagggtgttctcttacccctgaaatcgtttcttcactggatgggaaggcaggcacccagggggagatggcatcagctgcataaacaatttttctcctcagtagacatttacatgagtcaataggaatcatattctctctttttttttttttttttttggagatggtctcactctgttacccaggctggaatgcagtggtgtgatctcagctcactgcagccttgacctcctgggttcaagagatcctcccacctcagcctcctgagcagctgggaccacaggtgcttgccacyatgcccaactaacttttgtattttttgtagagacagggtttcaccacattgcccaggcaggtctcaaactcccgggctcaagcgatcctcccaccttggcctcccaaagtgctgggattacaggtgtgagccactgtatctggcctaggaatcatattctcttcactgaaacatttcagatgacttaaaaattcaccttgtagaacttttaaaattgaaactttctggtgaacatcattagttgacagatrtrtcattgaagtttcatccttcttcatttcagagtctgctrgaagacccttcatttaccactctctccttcctggaggtgtggaaatactctacctgggtgaggctctcgtggctttttgtgccaagtgtccgtaaacttcaacttaattgttttaaatcctttgtggtgattatgcggaaggtcaaatctaacaggaagctccatgtccacttgatgtgtacttacttctatttttgcaccttgtgttgtttgttatcctgaattatgccagggctggtttgtgctaagatacttgttatttgacctcataataccagcatgtcccgtttgtataaccctctctgtagcttcttccagcatgtgatcatacatctacctaacctctcccattggttgaatttaatatactagtgaattttccattgcaaagatgaggttacraatcatagtgttcatactcagaaggactttataaatattttgcctttttgaagtatatacaagaaatgaaaaaaaaaacaggaataaataaaaagaataaaaagagccaggactagaacctacaattcctgactcttgatcaaattgcttttctttttaactctagttaaatattttccattctttttaactcaagaagcctttgtttttgttgtcatcgttttatgattaacttatatctggtcctttagacatttagattttttctgttttatctctctctctctatatgtatatctrtatatatatttatctatatctrtatagatatatatatatatatataaaataatgaatgaaatggactgtttgcaacctcagatgtatttctaggacttagagtgattagcttgaggcgatggtagtttctgtttttggagtctctgtaggtctcagactcacagtctgtacttcttgttttgggggctaattaagtggacagtttcagtgttggtagctcatttaagccataaacatgcagaccatgtggaatcccattagtcaaaccttagcagagtgccttgatgagtacctccttttctttctgaattctattagttgatgctttgttctttctccccaagagccatatctcagctatttcttttcatttcttgtgtatagttcaacatctttctttctttttttttctaaacaggatctcactctgtcacccaggctggagtgcagtggcatgaccatggctcactgcagcctcgacctctggggctcaagcgatccttctgcaacagcctccctagtagctgggactayaggtgcatgccaccacacccagctaatttttatattttttgtrgagatggggttttaccatgttgcctaggctggtctcgatctcctgggctctagcaatcctcccacctcggcctcccaaagtgttgggattacaggcgtgagctaccrtgcccggccttacgtttcagcatctttcaatccatctaatacgcagtgccagggaaggtttgtgaaaacatttgaatcacagagtcacaaacagtgagaatakctgcagttatgtttgtgatgctctaatgaacttacaaaaggccaggcctagtatttcagctgtgtccatgatgtctctgatggaaatggacaggtaacatgatgtacacaagcatttgactgttgcatcctttgattgggccatgttcatgcagccagcctgggaaagcaattagtagttttaagcatgggaaatcatataaaagtaaactaaaattgcatttgaattaattgatgaacatgtttgcttgaccatatcctgctgttaggcgtcttcaagttaacttaagtggttgataaaactttccaaaaagaatactatcaactgctgagcacctgttgtcagagttgtgggtaattcgcaaaggttttcaaatggaaaagttgttttctcctgctaggaagcatggtctcagatccacttctaaggtcagtgtgaaagggaaggcaaattcactttgagcaggggaggcatgatctggaagataaagcagctaggagtatagactagggggctgatggaggggaacacctatcacaatatgtgttctcacaccaatgatatatattttccacacatttagattctccatgccactccttatctctttagtgcagaaaacggagaggaggttcagtattcttaagaaactcccatgattgctttgaggcaatggatttaacrggtatctttatcccttatttacgcactgactgtggtactgagtcatccctggtgtttctggattttattggcaatgccaagagagcaggaagactgggacgtgaactgacaacatttatgattctggcagcttgacatcacccaactgttctctttgtttggttttgcttcagacttagtttagttttgttttttaagggctggggtggaggagagggatttgctcttgcagttttcctttcaaaccaaactctttcaaagccttttgcaaactcttttatggattttactcactggttgagcaagagttacttatgagatgtggcttcggcattttcacagtgtccataaaaaaatgtatattactatgcattgcacatttgccacttagaatttctgaatgcaaattaatcaacttgcagctgtgactaacaataaaacacaggataatgtacctacagaaatgagggcattggaaatccgctctcaggtggccatcgaaaatagtcagcctgagtgttgctacctgttttccataattgtgtagctttgcctttccttarttaatctgttcaataaactcctctgcagaatccaaatgcttaaattcagtttctttttgtctttatggtgtttwtcattgttaacgtggcatcggagtagctcgacttttgcatcatgataaattcataacccaagagaaggcagaaaacataattrttrtcaattgcctctctcctggaattgccattggctgagtggaacaaaatacgaacttaaggagtagctgattcagagaaatccagggtaggaacgggtcccatcttgatttcaatgtcttttttgaggaggccttcccattgcacttctcttcaagtttgcccagatagtaagttctactagacatgtcaattttttctgaggtctaatcttgattttttttttcctgcacaatatggaattcagtgtttttatttaatcattcagtaagtcttgactgcctgctatggaggttaagccctttactaagttccaaggatgtacctgtgaataaggcaagttcctttttatcattgtctttgcagtctattaggggctacacaatttaaacagagaatatatataaaatggtagaaagtacaagtaagtataccttatttttttaaaaaaaatgaatgtggtatttcacccacagcctcaagaatcactttccttaaaattgccagagtaggaaaacttacaattgaagaatttcaggtatttatgggaaaaatagtattagggcaattgcggtcaaacacattcgtctgttcgttcaattacagcagtaaggatggaagtctaaagagagtttctacgtgatcttatttatcctgcatttataaatacacaaattcttgtacaattaactcagtttttcactcctttcttgcttgcaacttgtcaggtcgttccctccccastagttgtgaacttctttatgctagcttcttccatcaggggctcacaaccagggactgtagaggtttgcagaggtaaatcttggtagataaggattttatgaaaagggagctcactgttggtgaaaaatccttgtttctacagattttgggtcaagataagaaaaattaacttttaaaatctgaggaatttggagattatctccaggggctgaatatatttttatgggagaaataaaatggatagttttaaacttgaatttagtttttcctaatggaggcccttttgaagatcaaatgggatctgtaaaaactctttgaaaaatgtagactgcttcttatgtgattcttactggtctattatttatcaagaaattaaamaggaatgaatatctgtagctgtttttctttttctttcttttcttttcttttctttttttttaagatggagtctcgctctgtcaccgggctggagtgcagtggtgctatttcggctaactgcaatctctgcctccygggttcaagcaattctcctgcctcagcctcccaagttgctgrgactacaggcgtgcgccaccatgcccagctaatttgtaattgtttgtttctaaaaggatattcagtgcttccactgtcttttagaagtctgtagaaggaaggccaagaaagaaatacccattattttggctgaagatgatcactttagctgaaaccagttcaggttcaaactcagacattggtgctattttcatatatctgaaatgttctgaaaagattactgacgatcaacatgctgaactgacatttcacagatatgcagatttattcatctctgttcaaggtatgccttttccaatcataatagccaygtagaggacattaaacaaatattttattgtggtaaaaacacttaacatgagacctacccttttaacaaatttttaaatatataatttattattattgttgactataggtaaaacaggacatttttaacgtgctgtggtggcctattggactttcagcctccctgggtgtatttcgctgtatatgtgtaccatgtcagcttaccctagaatttgaaacattttcctttgatgattaaattttttttttttttttttgagatggattcttgctcttttgcccaggctggagtgcactatcgcgatctcggctcattgcaagctccgcctcccgggttcatgccattcttctgcctcagcctcccgagtagctgggactacaggcgcctgccactacacctgkctaatttttttgtagttttagtagrgatggggtttcaccgtgttagccaggatggtctagatctcctgacctggtgatccgcctgtcttggcctcccaaagtgctaggattacaggcgtgagccaccgtgcctggcctgatgattcagtttttaccccaagatgcagtatgcctcmgtctcactaaaatatgccaatatgttcttcttcttgaggatcagggctgatttcttctactgggaaaatgtatcccctgtgtttggccccagaggcatcagggtaacctgctctcttccattctcaaagcagaaacagtgttcctaacattctaagcctgggaataggatggcaggtcgtgggaccagcattttaattacctaaagggaacttattgattttagtccagaacacggtggggaggagttcatattcwttttttttttgagtctggattttagaataaattcactgtgtacatagctattccatctttaaaaacctttgtgaatgytaatatacagcctttataaatttgaggtataatgttcaaaatgctctaatccctaaattttccagtctaggttattatacttttatgactattaattttgatgtaggccttttaaaatcaattcctccctgtaattacaatgctgctttatggtatttgtgatatatcatgtgaatatacttgagggtcatgagaagttcatatgtgtgtgtgtagtgtgggccccagactttcgccacactgctggctaaagtggccatgtttttgtacgtctctgcagagcttacaagttattcaacagccagatttctattctgatatgcccttttagttttcaaagcatcgaaaaagggtaatctttagaaccgaagtatttgcaaaactcctagacttgaataaggtatttttgaatttgaagagctaagaacccatcaaatcaaaatgctaataattcttccaagtcaaaaggtaactctcattttattatgcattgaccaccattcactttctgttggactgcttttggaaaaagaaccacaagtctctatttttaaaatagaggtacaatgataaaacaaaacaaaacaaaacaaaaaaacaacaaaaaaaaaacccacacaggtctcatcagccaagggatttaaaaatcaaatttaacttcaaaaaactgaagttgatatagcaggatcttggagatgcagtttcttcacttttcttttttttctaactgagggattaaggatataaacccaacttcaaatttctttctgggtggtcttgaaaacttaacagtaggtcctgtaaagaggtgggggaraggaaaaagaaatcctttactctcatctgctggttttaaaatgagaaaaatacacacacacacgtaatgatgttcgtgatgttaatggagggaaatatcataaataattaagaatttaaaattattataaaatatttagtattattgttgttactgttattagtaggaaggggccttgccatgcttcctttcttcaaacagctcagtactttaaaatcgagtgtggctgtgtttgtcagtcgtggtttgtgttctttgatttgttctgcatgttcttcttttggagaggatgtgtcactttgccaatcttggtccttgctgttgtctggtggagggaaacaagcctgccaggccggctcatctgacccctggtggcagggagtggaggtgcactcaggatgctcttggggaatcataaaggaggttaaagaaagggacagcagaaccctgacaatccttgcccctaagcatggaaaagcctccggaccgggtctggagtgcaacagaggcccctgaccttgtctctagctctctgtctgcatcttcagcgtggcttcactggtttctaagtctctggtgtcttttttcttttgcagccggcttgcaattgcctccttctaactctcaaaaggatgcatgggatgggttcagtgtagtcactgttgtgccttttggacaaggctttccagccaggccaccctgtttacaaggctgtcctcacgtcatgggcgctcatattgtccagactagatggtcaaggtgattgggggaaggaagtcacagagccaccaattactaaggaactgcccagagatcctgcctcactgggaacctgtgagtgggctggtttcccccagcagaggggctgtagcatagcaggtacccacaggagcctgggcatggcctttttctctaaagggctggatagtcaatatttttagctttgtgggctttatggtctctgttgcaacttctcaactctcctgttacagcaggaaagcagccacagataatatataaatggacggatgtgttccaataaaactttatttataggaacaggcagtgggccagattcagcccgtgggccataggttgccagcctctgactctggtgttcagatcacagactttggatgtctcatatctgaatctttctaatctcgtgatagggcaaggtaattaaaatgttaatacgttagttttctcactgtcaatgtgttctatgacatcatttatgcaaagcatacaaagctgagaataaagtctcagcaaatgctagtttcctggcctccttatacatacttacaaaggatggtgggagatagtttgagatttgaggcctctgaagaataggtgtttttgtgatgattttggcttttcagtttgacagttggctttgcttttttgacagacacmttaagagcttcaagggtcatttcatggtttgtcctttccatgtcagggacacctttcacgtggccattttaagcacaggaattgccttcaagtagtttactcgtacgaacttgtctgtaatcatctttccccatttggatggtgggttgcccattttaattcaaggtttgtctaatgtgttagtgcatattcttggctcaagcaggataagacactagtaaccatgaacctgtatatcaaaaagcgtgactagagtttcatagttaaacatgtgctgaaatccacagtggacaccagagagggtcatggaatctgrgaatggatgacttgtcccatgatgataatatctgtgttcctacggctgggcccggtggctcacacctgtaatcccagcactttgggaggccgagatgggaggatcacgaggtcaggagttgaagaccaccttgatcaatatggtgaaacsctatctctactaaaaatacaaaarttagccggtgtggtggtgcatgcctgtaatcccagctactcaggaggctgaggcaggagaatcacttgaacccaggaggcggaggttgcagtgagccgagatcacgccattgcactccagcctgggtgacagagtgagactccgtctcaaaaaaaaaaaaaaaaaaaaaaatctgtgttcttgcctggcttattgagctccatggtaaatgttcagaggctgcaggaatgattcaaagtctgactgatttatgtgcattgggcattttgttgatrtcattcagattaatgatggcactgaaaatgtgtaayggaaatgagaagtttgtatcctgcctgctataccatgattccaatttaagagggggtaaaaatattgcactttttaatctattgttttttgaaagagactgtttaaaacacgtaattttgctaagttatggctcatatcgtatttgttattttggttttgaaaaattgagtaggaagcaattgcrttcttaaatgacttgaacatcaaaggcaagtagtgtcttgttttaggagcagccaggctcctatccctctgatccagccaagtgctttcacttggtcccactctggggaatcaccagtggttctcactctgggagaggcccctggttgacctggaatgacctagaccagcagtcacaagctcctgcccatggacaaaatacagccggtacctctttggctatggcctgcaggctcagaayagttyttacattttcaatcatctgcaaaaaagaataaagaggagaatattatttcttgaaggaggaaaatgatatggaattctgatttcagtgtcataaagttttgaatttcatcaataaaaaatttgcagaaatttgtttttctctcctgttatgtaaatacctctgtaatagcctcggttttgcctcttggctcacaaagcctaagttgtttactatttagccctttacaaaaaaagtttgccagcatctgatgtccaacaacaattttcagtcttttttgtagctcccaaattctctcattaaaccagatcccttgagggaagcctggtttacaaaatagattaagtgatgtggctgtttggagcaggaggctgtggtctgagtcttgctggcctcaaccctcaactcacttccacaccttacctcctggggataaggctgccttcgtctagaaagtgcctcggttccagcttggaaatatccatgtacagtcccttttttgttattccaaaacccaaagagatctgaaaagcaaaaacaaatttattgtatatttatagcaaatttatttggtggtgaaatttgacttcagctttagcgtccctgtttctcstttctagtgtgaatgttcattttgttttgtttgtttttttgaggcaaggtctcacttcatcacccaggctggagtgcagtagtgtgttcacagctcagagaagcctcgacctcccgggctcaggcgatcttcctgctgtagcctcccaagtagctgggactccaggcatgtgccaccatacccagccaatttttgtgtctttgtagagatgcggtttctctaccatgttggccaggctgaataatcatattttcactgaagaaatagaaatgtcattgttataggatgttgccccaaaccccgcaaaggtattttgtaatatgcagtatatgtgctaaattactttttttgttgttgttgagatggagtttcgctcttgttgcccaggctggagtgcagtggtgtgatcttggctygccgtgatctctacctcccaggttcaagcgattctcctgccgcagcctcccgagtagctgggattacagacatgtgccaccacacccggctaattttgtatttttagtagagatggggcttctccattttggtcaggctggtctcgaactccggacctcaggtgatctgcccaccttggcctcccaaagtgctgggattacagtacctggcccaaaatacctttctaacatggaggaattaggaatactgaaggcatcggcccccaagggtttgatgtgctcttgtccccaaggcctgcagatttgcatcacctctccacttcgtggactcctcgtacctgcctgattccaggatgctctaacctggccacgcatcccccgtggattctcagctgttgtgtgtttcctcctcaggtggccactgtgtctggtgctcacctacattttggttcatcctgactttgcctcagcctccccattctgcatttctcccacggcttctcccagccctggcccagtgacactgtaatgtggactgtggcatcccctgagtctaagctgttgaccagctcttgatggacagatgctggcagagatggggaaggtgctgttcccttcctcctgggaagggcaaagaaagcagggtggtcctcccatccccgtgaggaaggaagagcctcattcatgctgagaccctgatggagaactgggtccagggataatgttttgtgttcctgctcatgggactggtgtgttattgtcaagggatcttacaggccttgcttcccaggcccctctatcccctctgttcttgcttaggcattagtgatttggttcttctagctttttttctttttttgagacagggtctcgctttgtcatacaggctggagtgcagcagcgcgatcttggctcactgcaacctccgcctcctgggttcaagcaattctcctgtctcagtctcctgagtaggtgggtctacagtcacatgccaccacgtctggctagtttttgtattttttagtagagatagggtttcacttgttggccaggctggtctcgaactcctgacctcaggtgatccgccagtctcaacctcccaaaatgccgggattatagatgtgagccaccacaccaggctggctcttctagtttttgaagctcacttttcttttttcctcaagactcacagggaatgggaccaggcacctgtctttatacattctcaaagtccatggtgacgatgccatgctccggttctaagccagttggacagacacaggcaagggaagctgtcagtgtgggtgagttgcagtgtaagggtagtgggtggaatagcgtctccccaaaatccacacccacacagaatcacagatgtaacgttatatggaaacagggtctttgcagatgtaattagctaagaatctcaaggttaaatcattcaggctttagagtgggccctaaatccaatgacggttatcctcatgagaagaggaaagcagggggcacagtggtgggtgtgcctgcaatcccagctactcgggaggctgcggagggggcatcacttgagcccaggagttcattgccagcctgggcaatatagcaagaccccatctcttaaaaaaaaaataacaccaaaagacaaaacagaaaaaggaggagaggacacagaggagaaggctctgtgaagtcagaggcagagattggagtgatgcgtctacaagccaagagatgccacggtcatgggcagcccccagaaacgaggagagaaacctggcacggtttccacaaggagtcacccctgccaacaccttggtttcagacttctggtctcctgaactgtgagagtcagtttctgttgagcttgtgctgatacgctagggcagccctagcacactgccacatctggtttcccggaggaacttcacagggtctttgttctttatctacagtctctggaagtctcagcagcctcctgtgttcgcaactgtcattccagagcagccgtctcgtgttatgcatttgcttactcataagcaaatatttcacaagaacctgcgagggccaggctgggccaggcaggtattgcaggtgcaaggatctatataagacagtgccctttagaagatccctgtctcattgagaagcgttgagtaaatgggtctctctggtcattctctccagaacatgaagccaaagggcygagagggagagactccaagaatgaattagtgtccagcaaggtatcgcttgtctcaggatgacaacttgcaatttggggatctctcaacgtcctgacctccatctcagtgggcatgttcctcacctggctggctgcccctgcttactgatgcagcctcctgtcacacggtactcacctctattcactgtattccaccaacactggccttgggagccagcagtacccccattgtacagatgaaagtcttgtgactgtcaacattaaaatgagaatgatattgacccatgatacttacccacctgttcagtggattcggtgtgccgtcagcatggttcccagcacatagtaagtgctccgtaaatgtcagcatctattattatcatttgtgtttttttttccccttctctgccttcctttctctccctccttggtctgcttcctcctgttgctatcagagcctgcctgcctcatccttgttccagccttgatggtgatgatgattrtggttgctgttgctatttgtttttttggtttgtttgtttgttttgagagggagttttactcttgtcacccaggctggagtgcagtggcgccatctcggctcactgcagactcttcctcttgaagctggggaagttcaagcaattctcctgccttaggctcctgagtggctgggactacaggcatgtgctaccatgcctggctaattctttgtagttttagtagagatggggtttcagcatgttgtccaggctggtcttgaactcctcagctcaaatgatctgcccacctcrgcttcccaaagtgttgggattacaggcgtgaaccaccacgcccctcacgcgcagccactgttgctattgatgattattatgacatcattgctcagattcacttggctcagagagggcggagtcagagtgacccaggtggtcactgctccccttcttgtccatcaaatcagctgcctccaacagcattgcctggcagcgtcacgtagtagccctctccctcacaaggcttttgaggcagacaaatgccactgataaagcaaaagcaaatgttttgggtgaattccccatagctacactagatttgaggctgagaaatggaatgcctgtcattgttgactgaaaaatacagctctcctaatagagtcttggtgcaggagctgttagccttgccgccctgcagacttgaagaattgcgacgtcggcctaacataattttggtaactttgtctgcttctgcctcgggtagaaataattcagatttcactctccattttctttaatgggctaaacagccactttgtaatacctgtattttattagacataattctggatattgtttctgcagcgtttttgaaaagacaaacctgagagagcccagctatttaacttaagcaattttaaagttatttgtaaaatgatatgctgtcttttttgacccagttactttataaagctacattctttggcaaacattaacacaacttctccgtgtgtgggctaaataaatattcgggcaacactgattgagcactgccttgggtaaataattctctctccacacatttcctagttyataatgaggagttttcttcgtggtctgaccaaatgtaacattccattgaaaatgagacataaatccttgagtgagggagacgtggaaccagggtttgaggagggttattaaaaaggtgagggtagcagggtgacctcctgagtcccctgctctcccgagccttctctcctctctggaacccatggctaataggggacaggagagagcggaagcagaaagaataagagatatgaaagccagccgggcacagtggctcacgcctgtaatcctagcactttgggaggccgaggcaggcagatcacttgaggtcaggagttcgagaccagcctrgccaacatggtgaaaccctatctctactaaaaataacaaaattagctgggtatggtggtgtgcgcctgtaattccagctacttgggaggctgaggcatgagaattgcttgaacctgggaggtggaggttgcagtgaactgagatcgcaccactgcactccagcttgggcaacagagggagactgtctcaaaaaaaaccaaaaacaaaaaaagagacatgtgagccttcccttccctctccccatcctagcctcctctcacccaggtccattcttccactgtcatcccatgatgctctcttgcattttaaagtttggaagcccttattcctttgttttgtttttgaaatacaaatatcaacatttttattgttctatagtaatacacgtttcttctatagtacattaaatcacaagaggtaatagtgtatctactaacacctatacttttgagtagtgttgagtgtaaatgatattttgaaatatctgcagtaactgatgtgatatgcaaacatctgtgatttcttttaatttttattaattttcattttttaaaaaactttagtttctggggtactcgtgcagggctgttaaataggtaaatgacatgtcatgggggtttggtatacagattcttttgtcacccaggtcagaagcatggtacccaataggtgctttttcggtcctctccctccttccaccctctaccctccagtaggccccagtgtctattgtttccttctttttttgagacagagtctcactctgtcttccaggctggaatgcagtggcaccatcttggctcactgcaacctccacctcctgggttcaagcgattcttgtgcctcagcctccggagtagctgggactacaggtgtgcaccaccatgcccggctaagttttgtattttgcgtagaggcagtgtttctccatgttggccaggctggtcacgaactcctgacctcgagtgatctgcctgcctcggcctcccaaggtgctgagatcacaggcgtgagccaccgcacctggcctattgttcccttctttatgtgcatgtgtactcaatgctcagtttccacttacaaatgagaacatgtggtagttggttttctcttcccgcattaattcatttaagataatgaagctcctgtccttgacccaatctccactctaccgtttgatgtccagtgtggactgcccctctgaaagcccttcactgcggctcagcctgtggtggaaggtgtccaaggtggctggaacacctcctgctgggggtgtcagtcttggctctcctgtkttctgcctgtgcaatggtgggtaggtcccttgatacctcgtaacctcagcatccctgtgggtgataaggagatgataatagtctcttcccgatgggggttaaataaaataattctcggagtatgtgaagcagtacatgtgaagtgctcagctttgtgtctggcacataaggaagtggtcagtgtttaatgttagggatcatagatgctgataaattgccgtttatggcatatttcatgtattgcctcatttaaacctccttgcaatctgttatgactcctgctgatgatggggaatttgagactgtgagaggcttggcaaaagatctaagctgtgaagtatctggaataggattccaccttcagccctgccttaatgaagaccatggtcttgccacattgcatctccccaagatttttatggttctatttttagtcacgttggcctgcgttggtaaatttacctttcctggtccttttgagtaactatctctggaaaggattaagtgcagtgatcaatcagcagcaaagtcctggaagaaacccatttgttagtctctgggcctccccaggccttatcagggcttagccttcgagcagtagcaacacttgcacctgcagttactaattcctgtggaatgaagtaggcgggcccgaaatgtacagcccttatccagtgaattctcataggagcaaaaaaaagtgttttctttcccccttggagttctgtttcttcttaaaattagctatttctcatacacaatagggacatattcataaaaaagggaaaatactccaaagttgaaaaaaagattgaaaaagaaaatcctccaatatatatctactcttagcattttggcacatattcttacagtagtttcaaatgcccaggccattttgttttattttgttttgttacaattgtggcatatgtactcgtgatggatttgcttgttatctctaaattaattctcctcctgcaattcaaatattccagagatatgtatatttttaacacattgttaattatcccatatggataatagtttcttttctctcttaacattttaaaagcatgcctccaggttgttctagacggtcctgaacagtgctttgaatggggacatgttagtaaaccaatgagaggaaccacggtttagttcatcattctccttctaactgtatttttaggttgtcactaactcttttcagtcgtcatttccatggccacgaacatctttggttctaaagcatttttcccatttaaaattatttctatgggattgatttgccagaagtagaatttctaggtcaaaggtacaaacgcttgagaagtcctgatacatattaacttgggccagaaatctaccatgtaattgagagcaccttgagcttggcttcagagccaggatgaggacaggaataagtgggccttttgatttgaaatgttgagatacgaatgtattctagatgggccaaataaccagcttattttattttaaagtcgagtgaattttctgcctcactaatgtgcatgtcttcaaagacaagtagtgggaacggagtggggatttgtcatcccatagaatgccaccacatggaatcggtcctgaggcttctgaaagcagttccaaatttgaatgtttcctaagttagttcttgcggtacagcgcagacaatattcttcctcgacaatagctgagacccaagtgcctgggcgcttccaggtcataattaacctcttcaaaataagagcaaagaaaggcaggaaaaggtcctctccattccagaaaggagaacaaagagggggaattctaaccctcttgccacctctgttctcgtccgttccatattaagaagcattcaaagactaggatgccattttgcaaacgtctcattctccctgaatggtaaggctccacgctttagcacaagtggtacaaatctgccttccctcattcttttttgcagatcatcccgctccccacccctttctttatcatggctcatttggagcatctgtgcattttttaaaggctggattttctttctgttgccattgaaacattgcatttgtacaggagaactacttaatggcacagtttgttattacatggaattaaatacaacctatttaaatcatgtaccgtgaaaccaaagagctgtgtatggaaaaagcctcatataacccagtttgccaggtcctaactcccttcatacatatactaacatgcaaaagacctcctaccttttttttccccttctgtttctctcttggtataacactaccctgtttttgaaagtacttgtactgctaatatattctttaaagaagaggggggaaacctgttggtcccctcataaaacagttaacaggaagcccaaggcatctttcagtgccatttttggctgatgtttggaatggttccatcaatcaccgctgttcatgtatagctggtttttatgtcagttaaaccatcttccatcaagttggtgaagcagagtcagggaacaagatgaatagcaaaacgtcttctgtggcatggaaaaggctttgcttttaaatgcccgtgttgatttcttaatattttcaacttcctcttctgaagccagttccccccgaccatcagtcatgagtccgttcttttaacctygttcaggtggcgtggggcggtgtgtttggtggggagtgmtgggtgcttgcctggaagtgcgagcaattgatcagctgatgaggggtatttattatctgtccctgactcccgagagaggaaataaatccttggaccccagagtgattttcggagccacaagaatgcaagatgtcctgtttccagtcagaccatagcagtatcagtctgtgcagttggaatcttgcatggggaggtgtttttatttcacacaagaaagaatggcacatctttccttgaaagatgtattttgtatatcttaatgtcagttatgtttacgtgtttgctgctcagaaatcaacaggatttctgcccttccccagccccctttttttcagcccttcagagaatatttgttgagtgcagtgtgtaaaatcatggcggtgccaagagggggtgtgatgggtgtggccgcccccctgccagcaggaggaatctgttttcactgacattgtttggaatcaccaagcatggtgatgataaaaagcagttaaactttggtcacttttattaatacttttaagtccttagcgaacaatgcacccgttattacttgcacctagtggacatggttctcattgctgctgcccacctttcttttttttgccatgggtgcaaaagatgcctctggggatcccagaggactcagcattggtaaggatgcagtcctaatcctgaaggagggtacagctgaccagggaggtaacacatgaatgcagctgatagggccagttggacccagatttcaactgcaatctctatttccttcggatctgttgcatctgctcaaacactagttctgcaatttcccaacacctgccccctgccccttataaaagctcatggttccatgtgactttccactcctgcgtctctggccttggggcaggtcagtccgtggatcacctcactgtcctagggatgctcttctggtccacactgtgcctaccttggatatggagttccacttgttcccttacctttcacccacctgtgctcctcacccaagcaggcattgatggaggtctcatactttactgaagatgtgaggaaagaggacacttatgtagaacccaactgcaggtggagccttggcgatccatagccctctgtaaagtggggattgaagcacatatcttgcaaggcttgggcattgattgcagggagtaatgtgtatatgaatcatcagctatgcaacataatgctgatgctaagtactaacattgatggagtgttggcatgagctgggcagagtgctccatcctctatgtgtgtattagttcattcttgcactgctataaagaaatacctgagactgggtaatttatttaaaagacacctttaattggctcacagttccacaggctgtacaggaagcatgatgctagcatcctgcttggcttctggggaggcctcaggaaacttacaatcatggtggaaggcaaaggggaaggaaagcatctcacatggtgcaaacaggagcaagagagggagcaagggggcaggtgcaaaacacttttcaacaaccagatctcaggagagccaactcaccacacagcatacgtgctaaaccatgcatgagaaatctgtccgcatgatctaatcaccttccaccaggccccacctccaacgttagggattacatttggacatgaaggctgggtgcggtggcacactctgtaatcccagcactttgggaggccgaggcaggtggattgcttgagctcagtcgtttgagaccatcctgcacaatacggtgaaacctcatctctactaaaatacaaaaatgtagccaggcgtggcggcacatacctgtagtcacagctactcaggaggctgaggcaggagaattgcttgaacccgggaggtggaggttgcagtgaggtgagatcgcaccactgtactccagcctgtgtaacagagcgagaccccatttcaaaaaataaataaataaatttgacacgaaatttggtggggacacagattcaaaccatatcaatgtgaattaaatgacatcattcagtcctcaggacaaccctctgaggaagtacttatgccccccggcctttttttttttttttttttttgaggcagagtcttgctccatcaccaggctggcacgatcttggctcactgcaagcttcacctcctgggctcaggtgattctcctgcctcagcctccggagcagctgggactacaggcacgtgccaccatgcccagctaatttttttgtacttttagtagagatggagtttcaccaggccagactggtcttgatctcctgaccttgtgatcctcccacctcgacctcccaaagtgctgagattacaggcgtgagccaccgtgtctggcgtcatgccccgttttatagatgacaaggcatggaatggttaaatgtctttcccaagctcatggagtggtggcggtggaggtgttgtgaatgtgaacccaggaagtccgcctccagagctgcaggcattaatgcaaagctgcactgcctcacgaggtcgctgatgcactctcattccttttcctccagggactcctgcactttgccaggcgtggrccagaatgccactcgtattgtttatcttaatgcttagtgatagtagctacctccagtgcacgccgcattagcctctccaatgagtttctcctttattttaaatgtaaatctagagttcccttaatccccttaatttttagtacgtggctctgagggcagaaacattttcaggagcagcctgggctgagtttttaatgtggcagcagcctcggctggtttcagcatgcaggtgagaaggccgttcatctggaacttgggctacccaacagtgcaagtggggagatcagagcatggaaaatgtttttgtataaacttaggtggaccaaaatgatcatttcaacaacatttcggacttgattttttgtatttatatggcccctttcttcccaagaattgaaagcctcaaactagaacgtggcttttgaacggtgaacattccacaaacatttaatacagagatggctgtggggtgggggctgggggctgggggcctggaagrggagaaggggcaccagaaggagaaatgggaggaaagggcgagtgagatagcaaagagaactcagaaagtaataaagccctgcagtartcagagggctgaggccaggtccccagtgagcggctgaacacacagtgattcaaacccactccagacctgtgttcttaatcattaccttcacctggagggacagacctggccttgggcaagccacccccactccctggctctgtgaccttggcagctgactggccctctccaagatcagtttcctcatttgtgtaacagtagtaatctccaatttagggggctgtatggatattaaatgagaaaacacacacagatcatttctttagcacaacgtctatctggcacattagcgagagctccggaaatacccatgccagggtcacaagctcggttctggagctggatggccggggtttgattcttaactctgctcctttctagctgtgtaactttaggcaaataatgtaacctccatctgcctttgttttttcctctgtaatagaaggaacaacaacgaacaacattttttttttkgcaagattaagtgagatcttccatttgacatgcctggctaattggcagtgcccaacagatagaaactattggtattgtaaggactgcttattgggtacatatgctgtgccatgggaggtggaggtgctgtcatgctgaacccctattaacctcaataggaaaggcaccaggttcaagagctgaagaagacactcagagccaacagatagacatggggttttattaggaggttacatataggggagagagtccagtgatggcgggctggatagtacaactgcccaccttacatacagaaatggtccagtggcagtaggctggacaggatatccacctccctacagtccagtggtggcggtgggctgggcaggaaaaccataaccacctgcaaatgtcatgtggtttatatcacaccttcacttaacaccctccccctaacaacctctacctggcaatcttcatttaactccaaactcaggacctcaatcctctgtttggcctgtgttccacgggacaggcatggggcacagatgtctgttatatataagggacaaatctctgggttggtcactcctggattccccagcccggaccacacattcaggtgcatctcccacacaggatcattctaagggtatgcttacgttaccgctattggggtgtgttcaccctgcaggtgcagagatggcaaccgaggcagctgaggatcagggagtggaataacttgcctagttctggctcttcccatctaatgtggctgcactagatgctgttaggaggaggaggaagcctacttttgttttttacccagtttctgttcaaaggtcgtatttcatggtgcctcatcacagtatgttcttatatgccctggcaaacagaaggtgctcaataaatgctagttcatctggtcccttaatgaatactctggcttcgtcatcttccctaggctttggttaatttggtgccctcttttgccatttctgcaacccttattcattgctgtcaactgctcgttacacagcattgcctgtttcactctgtacaggtgccaggcgtctctcagcttctcctctctttcccatccaactgagcagcaccaataaatagataagaaacctgaaggtctacatcaaatcagcttctattgctgcaaaaytcttctagctaacttcattctaaaagctgtctgaaatatatttacttacacccgagaagattcaaaaacattaccgctgaaccccgatgctttgggaacacatggtgtccttggccacttccttgcttgttaccttgtccaacagctgattggcatagtacagatgtagacatcaagtaattctatcgttaaaggattagtcagcctctccctactccccacccacttatctcagtaaggtttagtcaagaagttggaaattaatggggaaggaaggttttgggttatgtgtggatttcatttatccatgctatctcttccctccattagcatggttaattaagagttgtcaatacatctttgttggagtatttgattattttttcaacagggaagattagaatgaagtcttcagatctggcaagtgtcatgggacttgtaaagtaaattgcaggttaagccctcattttgatctctgggatgagagcaagcaccgtttcattgacatgtcatcagctatgatctgagggagcacacagaggtgccctttggggaaagaggggcatcttgcacttgtctcccacattgaaagggtttattgcacagtgagtgtgtgcaagtgaacaaatagcagatgggttagaatggacagaagctagctctgagcacctcctgatttatgctttatttaaaaaaaatcatatgtatgtatatgtgcatacacatacattgttttgtatatatttgtcagatggaggtgtgtgtaaacaaataacagaaatgagttaaaattgacaagttagcttggtaaacatcttgatttataatttattaaaaactacgtgggtatgtatatacatacagacacacacacttcttcaccacctgaacaaaaatcccttttgaatcatccttcttgccttccaaacaagtacactagcaaacacttttcccagatggcaaatgactatgcccgttaggcatttcttttagcatttgtgttgacaatggcctttatttttccttctacttaagggctctcacgttctagaatacatcttaccagcgattaattatgccttgagattgccaggagacgtagacgagcttttattgttttagccactgaatatacctctagataacacaatacatatttacagtgacaagctttgtattatttataggattatagcaaatcatcaaaaaacaacccaaaaagggccacttagaccaacatccttatttctccctcggcttcagcattgaattatgcatgcattacaaatggcaataaggagtaaaggtcggtttagaacaacacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaagtgatcctccccacctcagcctcccaagtagctgggaccacagcctcctgagcacccgggtgcatgccactgccaccatgcctggctaatttttatattttttggtagagatggggtttcactctgttgcccaggctggtctcgaactcgcaagttcaagcgatctgcctgcctcatcttcccaaagtgctcggattacaggtgtgaaccaccacatctggccaacttccctttctaagagccctcttggggctctgatatgcacctctcatacctcagccccagtcagggttgttgaaaacccactgtctgcccagaggctgggagcacatcttggtctgcctggtatggagggctgggaggaggattgcaggaactgcttaagaggcctcactttgcaagagcagttcaggatgtgtttccagcacagtttccaacatgtgccacccatggcttcccctttcatgttcctggcctttatgctaagttctcacattgttatttttacaagtcttttccaaggcctctgattttctagaccatttaatgtttgccataacccataagggtataactgtcttggcacattcagatcccccgtccccctgctgtccttctagtcagtttctggcacactatgtttatgagcttacagaacagctcctaggttttcttacttccaaaacagtgggcaagaacagctaccttttagaagcaggaaaaaggaacataatgaataaacctaaaggatttaaaaacktggaagacactaagaaactatattgccgagaaagagaaatgtaaattccgctggataaattagcgtttgcggttacttctctctttgttgcttaagcagaggagaaacagaagtcatagcaaagagagaggtagctgcaaaagctaatttatccaaaagaatttacatttttctctcttggcactatagggggcatgtttactctcctgatgtcttttggggaaggcgaggcacaaaagaagggcatcttcttccttcacacacacaccccacttaggaaaatacgtacacttgagatgccagagacacacccaagtagaacacatcccaagaacagtcaataataataatacccatcatttattgaacatccacaatagccagacatttttctagttcttataaatccatgtactcctcccagtagctttatgaggtcttattattctcattttattgatgaagaacttaaagttcaaagaaaggagtaaatcacgaccaggcacagtggctcgcgcctgtaatctcataatctcagcactttgagaggctgaggtaggtggatcacaaggtaaggggtttgagaccagcctggccaacatggtgaaaccccatctctattaaaaatacataaattagtcgggcatggtggcatgtgcctgtagtcccagctgctcaggaggctgaggcaggagaatcactcgaaccygggaggcagaggttgcagtgagcctagactgcaccattgtactccatcctgggcgacagagcaagactccatctcaaaaaaaaaaaaaaaaaaaaaaaagtaactcattcaaggctacacatttactccatgaagtgagcacacttcagacttccagtcttgtgtggcctgtctaccacaccatgagacttcatgtctctcctaaatgaggagaaccaaagctggaaattgtcacyccctgtcagcccacagcactggtttctaaacctactggcctctaccgcttcacttctcactgtaatctctctgaccctaccttccagcttctcttgagaacttgactcttaaattcattggtgagaaaggaaatttttgctccaataaactgggtagctcagtccaggagagaaatgtactggactcagacttggaggacagagctttgtgaccctcctaggcaatgtaatgaccctctcctggcctcaattaactgaggccaggagagggtcattagcaaactgtcctttgctaaatgggactaatgggaagaatagtgtctgccaaataaggtggttgaaggattggatgagactgacatttcatttgcatttagtgaatacttgttgaatgactgaatgaatggttgatgtacagaaacatgaacagagagtagagcagaacattggtgaatggtagtagattgcctcagacgcccccctttagaatcacacaagctgtcatctgtgattgcatacctgtagaagtctctatcatttcgtagtctatgtaaatgttgaccaactgagttgttcagtgtacagactgaacaaccatacagggaatccctaatctcctgcactgtgagtcaaagagtcagacaggtctagatgcatttgcttcaggtgaggccaaggcagtctactcttaatggcacattaggctttggacttgaggccgtgtcttttacatttcgcagcaatcagaaggaatggggtcgccccatgaacttcttaaccacatacaggctcgtggcgtggggtcttcatctggctactagattgtttaaagaaggatttttgtgattcttctaggctgacacattgcctgtcatctgttgtttttctaatcttctagtaaacatttggaaagtgaaggtttaggcatgtatgtttctcttatgtaggaaggggaaataaggccwtgagattgcatgagttttctttccaagtttgtgcagatctgcacaatgattgaaatatttgcaacctgtagagcagcagggtatttatttggcagcaaacagtattgatggattcggggaatgccatttgacagttacaggctcccgtgaggcggtgcaggctcctccgagccagggatggagctggggattgagtgacacaagactctttgggtatstctcaaacaatataaatcaccagcaaaatctcactcctacaaggagaacctgcagggagctccgtgggaggcactgctgtttactctcctcattccccactgcaaccacgcaattaaaaccaaggaatggaatctgatgtctaccgcagcggttttttccatctccattccttctgcattgggaggcttaaaaaaaagaaaaattagatcccagattctttattcttttggaaggatttgaaacgattatcactcatgctctgctgctttgaatggaaaagtgatttgataactttcaaaactcttagccttctaagacttagattctggtactatctcatttatgtgacgtgggacaaatagccactctcttgcataggattttcttttctttctagaaacaggaactgagtatgtttccaatatttttttatttctcctaaaaaacatcagagactatatatataaaatctcacaaactttgtttcccagaaaaacaactatatttaaatgcagctcatactgtatgtaagtatgatgtaggaaaatctgttaattgtgtgacaattatgacttgctgagctgctcatttattaaaatattctccctataattaaaaatattttatttccggagacatggctccattaattgcacatttcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggcatggtggcaggtgcctgtaatcccacctacttgggaggctgaggcaggagtaatcacttgaacctgggaggtggaggttgcagtgagccgagattgcaccactgcactccagcctgggtgacaaagctatactccatctaaaaaaaaaaattagttatctctgccctttgggaggctgaggcaggtggatcacttgaggtcaggagtttgaacctagcctgggcaacatggtgaaaccccgtctgtascaaacatacaaaaattagctgggtgtggtggcgtgcctgtaatcccagctattggggaggctgaggcaggagaatcactcgaacccgggaggtggaggttgcagtgagycgagatcacaccactgcactccagcttgggaaacagagtaagactccatctcaaaaaaaaaaaaaaaaaaaagttattgattaaaatttaaatataaattacaagtaataatgaaagtatgaaatttttattgattcataaatatttggttttaatcaaatatgatgtgaagctttaagtgaaattattgatattcgaagtttttttttgaatgtttaaatcatttcacattcacattttttaagtaaaatgaaacaacttgacattttagcatagaatgtttatatggtggccaaaaaagcagattggtatcatgctttatgtgtgttcattctagtcctgcacgtgtagaaatgtaagattttaatgtrtggtaaggtagatagatagatasatacatacatacatacatacatacatacatacatataaaattaggtaagaggatacttttaatgtatggtaagctatgattgcaccactgcattctagcctaggcgacagagcaagaccctgtctctaaaaataaataaataaataaataaataaatattttgtaaaaggtatcatagctgtataaaaagaaaagactaaaaagaaagccactcaaattccatttctcttctgcagatttttttttagttttgtatttcatctgtgattgactgtgtatgtatttttgcatatatacctgcaagcatttgtccttttaaccttaggaaaaaaagtctgattgcaactacgtgtttgggaatcagggagactatggaagaacaatctcagatctcagcgtgaggctccacttgcaatatcacaatttctaaaacatgttgtatgtgggcccatttgccatgtgtgtgtgtgtgtctgtctatctatctatctatgtatctatatatatatatatatatatatatatatatatatatatatatagttataatgtggtgggttctcgaatcacagttgtaattcacatttttctccaccaattctgataacttgcattaagaaattgactgtgtaagttaaattttagatcaataatgcaaattggaagacctagtacaggccaaggcctcattatatctgagtagggctttaagaaagcaagaaagaatcgcttgaacctgggaagcggaggttgcagtgagttgagagcatgccattgcgctctgctccagcctgggcaaaaagagtgaatgaaactctgtcaaaaaaaaaaaaaaaaaaaaaaaaaaaagaaggaaagagggaaatatacatcctcctatccagggtgaattacaaatagtaccagttggttgtaagtggatttaaaattactttttactgctaatggggcatctgtcttcattcaacaaatatatttcggtctctgttagatacagtgtatctctgttagatacagagcattctgttagatacagagaatctctggtagatacaaagtattctgctattctgatcttcctgttagaagatcagatttacagaagtctacatttgctctcaagggaccttcagtctgtttggagcaatctctttattaatttatttattcagtaaattttattcagaaccagctatatggcaaaccctagtccttatgctgaggtttcagagatgataatgggggcagatgcagccattcagttgacttcctgtggacaccagagatgacaggcccctgtccccagcttaccatccagcatataaggcatatatgcccctttccatgaagtataatctaatgagaacagttggagaaggtcaggcaaaggggacaggacaggaactcaggaggaggggatatttagacttacagacctgccctacctaaggtcccacagatggtctgtgatgacagatagcccctggactgctaagactcggatctttaaatataggcccatctgggctgtggggaggtgacagcctgagaaaaagtcattcttagatgcccttactctgttgatcataaaagtaggagctgaaattctcatagcctgagaagctatttgcagcattccctgagggctttgaaacactatcaaacaacaaggagagacaaaacagtttttagccctgctcaactctcatgggcttgccttattttttcagggcatgctctgtctccatcccttggctctgctttccttacattggtcttcttgggcatccgtcttccattccatagtgtagcaagccagaagctgggggaaacatggtgcgtgcctgtaatctcagctactcgagaggctgaggcaggagaatcacttgaacccaggagatggaggttgcagtgagccaagattgcacctctgcacttcagagcgagacttcctctcaaagaaataaatacactgtgtcctctcagcaagaccaggacaacagtgattctctttcctcaaagttccaatcagtgcccagggcttcatgcatattggacagacctgagtcatgaggccatctccgattggtccatccagggccatgtgctcaccccttaattcaggatgtggggtccggctcccctgaagtgcacagagaagaggggttgcccaaaggtgaatggggagaaggggatataagtgcaggacaggtaagaacagcaaatgctcattaacaccatgcagtgatgaaacgcctcttaatcaacccttgctggctgcagttgatttgttacttaccgtgaggttatcatagctttgcagagactttgtgatggggctgtcaacagagagagagagagagaaagaaaagaaagaagtgccaccagtccattttgttccactcaaatgtagatcgtaatttttaggtttgtaattactgatgagaagaatgcctgagccagaacttcccagagatttatctgccacttacctggagtaagtagaaaggatatcagttttccccagtacacctgcctccaatgaagccaactctcaggctctagaagtctctgccttgggatggattcaccagtgtgcttctcaggctggccagtgtggaagcagccttgctgtatttcatcctttaaaaatacagcctgcttgccatctcacgacttttcccttaatgcaacaaagaaatatgtgtttggctgtgaaatcttttttttttttttttttttttttttttgctgtggagcgcaaaatgttcatttatctctggatggtttgtttctggccacctgccctaagtgtatctgaatattgtaacggtgatcacttcttgagtcttggtcattacgaagtgacatttggcatgaatttgctcatcaccacagagggccccagggacccacttgggagaaggtgagttatagcccacaagataacatttctcctggtgactgtcctgaaagcctactttgggccaccacatcagtgtgttgggagatgagttaagaggttttattcttatacatgcggaagaattatgccttcttgagccatgctcaggagatgtcagccttttccattgtctccccgcycccaccgccagccctgcttaaattatcccctctttttaaacaraatatcctaatcttgcaagtggcatatcatgttccttcttttttaagagagaaggagaaattcctgcagatcatcagggactgaggctaactgaaactttggaatggatacagtgctactctcagctgaaagcacaaatcacttccatcacgtatatgagagacctccatgcagcactgcagaggggtgataagcaagagttgatcgatgacagaacacccacccaatttcttgactcattcttcaacgggcagggtctatacatgtggtatggctgcaatgtttgttgataacccctacattcacaaaacgggcgcatgggaacttgtttgctgccttctgccatgtgaggacacagcaagaaagcacatacaggaagtagagatggagccctcattagacgccagatctgctggtgccatgatcttggacttcccagcctctagaactgtaagaaatcagtcagtatctttgtttctttcctttctttttctttttctcctttcctttcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttcctcccctcccctcccttgcccttgccctttctttctttctttcttttttttttttttttcagacagaaatctcactccgtcgtccaggttggagtgcagtggcacgatctcagctcactccaacctctgcctgccgggttcaagtgattctccttcttcagcctcccaagttgctgggattacaggtgcatggcaccatgcctagctaatttttgtatttttggtagaaacggggtttcatcatgtaggccaggctggtcttgaactcctgaccctgaggcccaccttggcctcccaaaatgctggaattacaggcataagccacctcacccagccaagaaattaatttctgttgaatgtatgttgttatagcagcctggatggactaagaatcatgatgaaaagttgggttgctttcatatttagaaatatcttggaacgggcaggcgtggtggcacacgcctgtaatcccagcactttgggaggctgaggcaggtggatcatgaggtcaggagttcgagaccagcctgaccaacatggagaaaccccgtctctactaaaaatacaaaattagccgggcgtggtggtgcatgcctgtaatcccaagctacttgggaggctgaggcaggagaattgcttgagtctgggaggcggaggttgcagtcagctgagattgtgctgttgcactccagcctgggcaacaagagcgaaactccatgtcaaaaaaaaaaaaacaacaaaaaacacgaatatctttttttgtcagctccatgagggcacaaagttgtatcagcttttttttttcacagctgtgtcttcatcctaaaatagtttctagcacagaacaggactcagtaagttatttgtcaagtaaatagactccttaataaattgtctatcctgtatccagtacaatgcttggcctaatatacatccagtttcatttaatcctcaaaacacattgatgaagtgggtgttaatccctattttacagatgtgggaattgaggtgtagagctgttgaagaacttgcccagggttgcagagctctttcacaggggcagagcatgggctgaacaccagacctgtctcacactaaaggtgaaacaatttcccctgcatcaaactgtctctgatatgaagggtctacacactgtggtttgaaggtcagatgtggcctgtcatgtttttgtacagcccgagagctaagaatggtttttacatttgtaattgtttgggggaaaaaaccaatagaataatgttttattacatgtaaaaattgtatgaaattcaaatttcagtgttcataactaaattttaaaaacttttattgaarttccagagagatctgaagtagttttattggaacacagccctacacaccttcatttataagctatctgtggctacttttgcactatgccagcaaagttgagtagttgggatggagactrtatggcccataaagcctaaaatactctctgctcctttccagaaagcttggcaacccctactatcatctccacgtctgcctttgttcttcttatttgtcccttccctctgaaggcaggatagcatagggtgaccataagactctctggaactagcctgcttgagtctagtcttggctctgtgctgactacctgtagggatgtaggtgagcttttttatttttctcaacctcagattcctcatcaaatggaagaaataatgagtatccactaccttgggttgtatggaatgaaccaagttaacttagctaaactcatcgcttccaacatcgcctcctatgtaataagtgcttgataaatgcaagttctattcttctattctctctctctctctctctctgtctccctctctccccctctctctcatagtgatatggtttggctgtgtccccatccaaatctcaacttgaattgcatctcccagaattcccatgtgttgtgggagggacccaaggtgaggtaactgaatcatgggccccagtctttcccatgctattctcatgatagtgaataagtctcacaagatctgatgggtttatcagagggttttgcttttgcttcttcctcattttctcttgccaccagcatgtaagaagtgcctttgcctcctgccatgattctgaggcctcctcagccatgtggaactgtaagtccaattaaatctctttttcttccatgtcttgggtatgtctttttcaacagtgtgaaaatgaactaatacacatagacacatacacacatgtacccacacacacgtaatttttgtatctaagaaaggggagaaatactttttagttgttctttctgcttcatttatgtgtggagtgcttaatgtggtcacacggatattaattgcatgttttcttgttttataattaagaaataaaaatgaatcactctgacttttcgcttcattttctgcatttgcacaatttggatattttattttgtagtctattaaaatgtgaaagtcagtgtaaagtgtcagtagctttcatgagtgttcttaaaggaaggccatctgattggaatgcattgtatctgtccttccctcttgctggggtcagcccaggactcgaggggaatgagcccctgaggaaggctcagtccttggcagcgaaatccaggcatggaaaccaagcctgagacatgagctgcaggacatctgacactgtcttttaagagacctgcctgtgaggtcctcatcctgctccctacactgcttcagatccacttgtccacttgtagtgagggatagtatctgttccacctgattgattgattgattgattgattgattgtgaggcagggtctcactctcattgcccaggctcatctctgcctgccgggttcaagtgattctccttcttcagcctcccaggagtgccatggtgcaatctcaagtcactgcagccttgactttccaggctcaagtgatcctcccacctcagcctcctgagtagctgggactataggtgcgtgcccccacgcctggctaagtttttgtacttttagtagagacagggttttgccatgttgcccaggctcatctcgaaccccttgactcaagcgatctgcctgccttgtcatcccaaagtgctaggattacaggcgtgagccgccgtgtctggcttgctccacgattttcctctatgaattccacctttcccatggtgggaccaaggctggaagtacttcacaaaggctccatttgaaaagtggctacaaataaaagggaaaatatagtattccttaaaaaaaaagtagcattctatttttccccattggtaagtagtacaaatttgagaaagtgtaaatttgaattccttaataatcagatctctgcaatgtgttttgcttttatcatcctgggttgccatcttggccaagtgtagattattctgctcagggtagccatactgagatcctggtgtgcacaggaaaagagctaacctttgtggatgaaattgtagagtcactacctgcatttgctgtagctcttacaattattttattcttggaagacatcgagagcatggtccaaagctgcataggttgcaagtgggtagaggcagaatttctctccaggcctggtggattctaaagctgtttactcttcacccaccatttcctaggtctggtttcttggttaaatacgtggaagagtggatggacagaaagacagattgatcagttctccacaggcttccccaaactggccaggtagaaataagctaagcaaataaatgacttccccattttataattttctgcaagtcacataagccttcatgttgtttatttcttggttttagatttttttaattataaaagaacattattatacattatttgaataattttttaaaattatagagctgtctaaaggaggcattaaaaaaaccctttctattccttcatctaattctatccctctgaggcaaccatgattagtattttgtacttcttgtacatcctccttcatgttaatatagatgtacacatatataagattttgttctcattttctgaaataagtggacacatactccaccatccccaggtagtgtacagtgtgtgccctttcaggctagtatgtacagctttaaatcattcctttacagagctgtgtaatattccacaacccagaggagcagcttgaagccagctaaagtatgtatatccaagtggaattaagagcttcatgcgtagtttcttgattttgattaagaatctttcttaatagatatgtcagacgtgactttatgctgcaagacatagcataggtagaaatttttatgtcacaggtgggcctaattaaccttgattaatgttctgcaaacccggatagactggagactcagaaagggacgcaaaagctagyctggttcccatgttagtccctgctctgtgagcagctgccacacagtcatgctgatggctcctgcagcagccattctggtttgactgtgctcgtgctgccctgtgacatattgtttaacacagtgagttatgacacagggagcgaaatcaagacttcagccaccgatttaacaaactggtgactcggagatcagcagtccggcattgccatcctcatcaaaagctctatctttatctaaaatttattagccaacttcaaacctgtttgccagctcactaatggaagccttttgaatcaatttgctcctctaatttaaacagcatttcaatgtatattgtcgaagcagaaaggagttgcagcttctggccagtagaattaattatttattatccttttcataaatactttccgaggccgacataactgaaaattgctcgggctgtttgaaaacacacacacacagttttccagtggctaatttgaaaaatgtcaccgtattagttttcatttacatctgtcaggaaacatatctatacataaggaagtttttttttttttttttttttttttactttcaccaggtatttttttgtggagtatgcatttaattcacatttacaaattggtttctgtttttaactaaaggtactttttcagcagaaatgatgtgtatgatgtcatatctaacttktgatctcactggtatttgatgttaagcctcaaaatcatcaaattttttttacggcactgaaaaaaatacataaatctgcttgattggttcatagaaaaagacccctgtgattaaggtaatgctagtttttgcattttctcctagctgtcattggttggacacagtgatcctcgggtctcttgtgttttcacatgtcttgggaacagaagtgctggcagctttggtttcaggccatctttccaaggaacgttgtctagcaaagaaacttgcaaggtacagatagtgtctccctcaggagcagaggacaggatggctttctttccagtataataaagacagtgcctccttccaggacaacggtttggcagatttgcttgataaaggttggggtttstaagcttggggctcytcagccatgactgaaacgtacyatgagcacggcatctaccgggctgttccacatcctccctgtgkgactaggggccagggcaatgggaatcagtgcagaaataaagctcatgctgtttgctstgccatgagtaacgaagtcctctrtatctgatcctgggtctcctgttttctgctagcttcctcaaaacttggtagctaactcattaacttacaaggaagaggktgaacgtgtagacccttcacagtttgaaaaatcacctgatcaataactgagattatgaaaaggtaggaatgaaccaattatggcccaaaggctaactccagccagtagccttttatttatgacccgttaaaaaaaacaaaaatgaacaaaaaatccaaagaaggctgtgtgccagagacgatacgtggcccgaagatgaaggtacttaactatctggcccttcacagagaaaatgtgtcaaccctttcctgtttgcgttcaggtcaaatagttgcattgaaaggcctcatcttacaaatgaatcaatatttagtggtttgaaaatatgttgtttaatttggggcgattcaatatcaaattaagatttttaggtttatttatcgatctytagaattacatcaacattaagctaattactttaaattgtgtttttaagtaaccaagaatacatctgtggacgctgttctgtgccatcttgagtcacgtttttaaaacaattacctttgatgatttcgtatgttatcccattcacagatggtttttttcgtccacctgagtttcaaatctgttgtagtcctggaaattttgcttaggttgaaggaatgagtgcgtgtatcttgtcaaaggaaatcacaagcccatgtaaactcgctcttgcttccgtcacctcgtgctttgaaacataaccacaatgtgctgaggtttcacattgttacatcctacaagcgtgcttacctgcatcaccttgctgggctgtttcagcattggaatatcactgggaatctcaagttcccaggagccaaccacaagagcttcacagctcagaattttcaagatgtggatgtaggcagggagcctatgtagtaattcaagtaaacatctcttcttcttgttttccttataggatgatagaaggtcagtgcttgttcaccccagtgaggtggagcctctgaggtgggaggttttctctcatccttgagtttatctttacttcctggtcattatgcaagttaatttttctagcagtgaaaacagtcacatgggactctgcccagcgagggcgttgggaggcctggcggagaagcagttgtagcatcgtccagccttctctacctaacaagggaatatgtgaggtagggtaggacattttggtagcagtcacacagcccaaagagcatggtgaatttaattagtctgccacacctgtatggccttaygttttccgggataacttaacaagcattgtgtgcagccaggtcaggcagatggaggttctaatccaggctgcacacctcatcagccaggagactacagataagtcagccaaacttttggagtaacaagtagctcatctgtaaaacgtggatgttccaatttatgtatagccgcataatacattaccccaaaacttagaggcttaaaacaacaaccattttgttttatcttgtgatttctstaagttrgggctcagtggagtgactcttctgccccttgtggtgttgactggggtcagtcagtggtgctatgctggaggatgaattggactggcacttcagctggtccaggatggtcacccatgggtctggcactttcacgaggatgactgggatgcttggctcagctgagggactcttrcccagagccctacacatggcctttcctgcatggcagatatagggccatcagatttcttacatggtggctcagggctcccagaggattccaaaagaaagtaacaggaagctgccagtttcttatggcctggcttaggggttggcacagcatgactgctgtggactaagcagttacaaaacccactcagattcaaggggagcagacatacacctcactttcttctggtagaagtgacaaagaatttgcagccatctttattccaccacagcaggtaataatagcatctccctcattacctatagaataactccaaactttctgatgattaagtgagatatcatgtaaagtaccaagcaccttggataggcaatgggaaatgttcacaacgttcccatttttacctataacagcagtagcaataatgctaatagtaatgatactagtaataaaatcaggataatgctgtttttaattcaccacactgtatgccatttgcttaaaatcagaaaggactcatcggtaaggagtagggtggtagtatcattttggtctgcctttcacccccacaagacaacatccttaacagcagctatgttgaaggtttaggagtgcttgtcattagggtctcatttccaaaatctgggacataataatagatggttactgattacagggatttttgtttgtttatttgtttgtttgtttcttcttgataatctctttcattcatcattccttcatttccactcttctaattctgggcattatatctttgtcagagatagagtcttttagctgtttcttcacctcccaaatccttctcaagtctgttctccgcctgctgtgccttcctatagtgtagctccaattgccttcatccttagaagacctttaatgatatcctatgccaaacttcctagcctccacctgtaccctgaattggccctagcctagttktccaaactttatccccaggtggttgaactttctaagtttccccaagctgatcagtgttttggggtggtatggaactcagaatagatcactttttttattgactaactctgaccataagtatgcttctgtgcgagcctgacctccacggtaccaggcagagaacaacatgtatgcagagaactcattcactcaataaacatttattaaatccaagccatggggatccataggaggaatttagagcagagttgtcgaatggtcagatttgcctttcagaagaccgttctggcagccatgtgagaaaggagggtggggagacctgctgggaaacaactctagtcacccaggcacgaaatgatgagcccttgagcaaaagtgattgcagtgagtacagggaggaagaggaaacattttgatagatacttggtaaaatcaacaagatttggccaacagctctgaaggggatgacaggcgtggtgaatggagaaggaaggacagaaggctagtttgggacttctggcttggacagtgtattgtgtagtggaaccatcgctgaagataggaggagtccttttcagtcatactgaattcatgacgcctgtggggcacccaagtggaagtcatccattggcacctggatttagatctggcactcaggagggatggacaggatagacattgaccagacacaattatattggcatatttggactggagaacccagcatctgacttaaagagtctgcttctcttcaaaattgcttaggtgttttcaaactacaaacaaatacactcccaaaacctcaatagattctcccagtataccctatattttggccaaactggaatcacatcctggtctccccaaacactgcttgctttttgttcctttcttgctcttccttctgattgcaatgaactccccatttccagtccccatcctccaatcccttcatgtccagctcctgctcatcctttgaaacccactggattttaagattccatctgacaagaatgatcactgttccttccagttcttcaagcactttttctgtttttgatgggatttatcacttgaaaatgcatattatagtaatttctgaattcatcctgattctcctactggtttctaaactcttcagkttagaattcctgttgratatccctctggccygaaattcctgaatgagttaagcaggacacctagaactatgcagaggtaataccttccttgacctgtcccttttctgggtcagtttgcccttcatgatttcggcaggagtgtgtctccttccattctggtgaacacatccaatgttcaatgttgctcatcagggtaagagttctaagtccctatgtcttagagacaggggttatctagctttgtcttctgcattggcttcaggcttcacatccttcctggacatgttcaatgctgctttcgtttcttgggcgagggccctagaatcaccttagacaccttgctctagacatggccccatcgtggtattcccttttgagaagacaaagattttaaaaattctttctcccttaatgcctcatgaatgcccaagcagcacttcatggaagtacactgagtctctactgcttgcagggattaaacataacattctcaacagtggtaagagagcctttcccttctctttggctcgttttcagtttttattaatttcctgtgcttctggttcatgaatcccaagtcatgatgtgaatcagttcagttcagcaagcactgagctcccacgatataacaggtttttttcttttccgagctgtggcccatgcagagtttactgagacttggctcttgcctttatgctttaaggatcctaaagagaagatgtaattataagatctaaaacgtggaggggggtggtgaattcagcctgcaggcatgtgtttgctgcccccacccccacatccyctttttttaaagttcgcataaaaacctggattcttggtttctcttaaaaaactggaaggtctggcacctttgctcccacatttcccgggcgcagcccttgactcaccctgtacggtggccgccccagttggatgatggggcttgtgcccaccgggtcagctcacaccaaccagcccctattaatttatacctggcccgctttccaaattgacattacctggctggtccgtacgcatcccctgcagtaactggctttctggaggtatgtgctgaggatctctttggcttctgcatctcaaaggatgagtgatttagccaggtggagaggttggggcggtatcctgaatgaaagaatagcgcagacaaaagtagtgagttgaaaacagaacagcatggcaggctcccagtaatcccatgagtcacgtgttctgcccacatggaatggatggtggagaagggaggagggaggaggttgggccagattaagcagattgtccccattggtccatttttaaatcttccttttggtatttgtcccttaaggcaacactttcagtctcagaaaaaatccagtaaagggcaaaccagtttgggtgaatttctttgtttttgcagcatgtctggtcccaaagtgggacctggagtccttccgacgaggaagtgcagcctcttgtcgaggagtgcactgggaggggaggctggacttctgggctctgctctgcctctaatctgctgcccagcatcagccttagcccagacccccaaagttcctgggcttcattctgctttgcattcatctcaaagttaagccttctggctggcaggggtttctgagacagactgacagtattagcgtgctgcagtttcatgatggcaagaaggaggttaccaaagccgttttcatacaccttaactcatgagtggtagtgagtggccccaggtgggaagcacaggtgatttggagctggctaacctccttcctttggctcttactctcaccagctcttagacttggggtaggttagttagctcctcccagcctcagtttccctgtttgtcaaatggggtcatagagggtgagaatcagagtttatgcagggcatagcactagtgtaatgctgggcagagagtgagcatccagcaagtggttttgacaatgataataattataacccaagcgacacatacaatttaatcaggcactgtgtgtccacagcgatgtcaaggaacaatgcacaaagcagagtttttccagtctcctgatgtttgagccctgcgcgagccccactcttctcccttttctcataactgctgtgagcaacctcaaatccttctggaagtaggttggttatgaattatgaataattaaagaaataaactctggctctgcagctgaaattgggatcgcatggagaaaatagaaagtccagtgtttgtagctgtgatctctcagttgcttgcatgaattgtgctttaagaytgtaaaattttagcccattaaaaataaaatctgttgctttccacccacacctggcaatttggtgagggacgggggctaggatatttaatgtctgaaagttttagggaggcttttatgaactgggccatctctccttgtccccatttttctttgcatctccgaactctcattaatttttcacaggcttgtgatggatagtttttatttattcacgtctgagattccgttgtgtgaaaaggactcattttataacattacatattcatggcttgggatggatgggataaggaacttattattaatgtgtcactgtgggaaacttactctagttcatttgcgaaccttgttaaattcggtgtggtcagcagacccggtgaagttttggatacattctcttaacagagggcaaagagtttgctgttgcttttccttgattcagtaaaacaagtttaaatcttatttaaatcgtttgaagtagcaatttgaaaggggaggaaaaaaagggggatggcagagattaagtagagagagaagctccgattttcttgttgaatagccgtgtttcctcagcattctgtagatttttggccaggtttgtgtaagggatgaacgactctctataaaatgatgtmaggatcctttctttcctgcccattgccatttctagcattctctccttgagggaagttgcagttttctccctctgtgtattcatccttctgacctgtgctccggattccagggagttctcaatttggagctcataccgacatcacagaattccttgcctgggacaaatagagggaatattaacatagcatcttgtaaatcaaagctgggcagggggtgggggagggcacagtggggaacctggcccaatctgcttcagtgtgagcttggtaagaaggaagcatatgttgcatttagttctctgcaaagacaggcgctgctctctggcagggacagcgtgtagggtttgcatgatttgtggggccgtttcatgtttgcacggtttggcttggcttgggactctgccagtggtcactgcagtttaacaaactccccccgggtgtgaaggaaagcgagataaatgcaggaaaaaggatacatttgtgaaatctggaaattttacataacaggcatcagatttgaagaatgtccaaaatattacgagtcatagcacaaccctttgctaacaccatggaaatttttaaacatggaatttgttaatgctgacttggcccaccatggggttaaaaaaagtgaatttctttttgataaccaaggtgatgatcttatgaagttgatgatggggtgtgaacggtgtgagtgggggacaaagcaatgaaatatcccttaaaatgcatcctctgatgatgtttccataatgccaaacatttgtttctctccaggatctcattggcggtttgctggtattatattgccatttatattggaaaggcaggcagtgcgaaaactgtagtctattaagagtttgtgagtgtgtgtatgtgtatacagtgaaataatatctagtgtaatgtgaagtgacagtcaaaattacagcttttctcttgccgcaagggtacttctctgccaagtatagtaatattgttgtagcagtgttcaaggttgtcagcaattctggcttactctgcagagagccataatagtgtgtggaaggaaggagcttcctgtcaggggaaatactataattttgatatatatttgttggtgccaaactgcaattaaataggaggtgttggaagaaggttttatttaaccagcttgaatttgttaattaattagcaaaaacttatctttggaatgcttcaagaaacagttctatgttgttctcataacttaattttacacaactgtcttttgtttgtatcttacagaaaacaaaataccaccctccgccagaaaagtgcagaataaaaattttccactagcaaaagaaggaaaaaataaaagatcttgaatagtctcatcaattacatcttcttttgtgggtatttcctggtcttttcatgttttgacttctatctcggtgatctgacagacatgtacgatttgcaacaacatctattatatgatttaatttatacctttatcagtttgcagttatgctttacgactcttcaggtgactaaagaaaaagagggtgttttaaagtgtgtgtgtttgtgtgtgcgtgtacgtgtatacatgtgtttttctgtgtacataagtgtgtgtgttttaaattgtttgaaaaacactagtccatctctattgtattatctgagggatgctagctcgttacttgggatagtaacaagtttcttggtgacaactcctcctcccattgtcaaggaagactgaggatgtcaccagagttcgctgtcaatggctattcagatgaaaaataccttctttttgaataagtagaaaaaccatgggggattgaaatagcaataatatattaaaagctccaaggcagttatgtgtgaagaaataaagaacagaacagagagattgtgttgttttaaaaagggctatttaagagtcttgaaaagagtgtgtgtgtgtagggggacacctccctctcatattaagtattttgcaaattaaatgagtttcattctcctataaaatatgagtctaatcacattttatatgattgtaaaatgtgtctacttttgtctctatctttcatggaaaaaagaaatattcccaaagtatattataaaaaataattaataagcaacttttcatcattattttctgaggttaattattaccctaagaaatcaatttcaatttcttcagtttgaaagactcatttgtgatggggtgtttccaaaaagagagttagttaaatgctatatggaagccttcattccctaaagaaaatgcctctgctgctggcagtgatttatccagagctgtctcacccatttatgccccatgccaggagaatgtatggaaaatgtaatagagctattagaatccagtgtagtagattggtaatagtaaggaacaacagttgtcttcacattgttaaaataaaagtgagataccctttaatcttcgcaaagggaaataactcttctgctaaccctcctgcccaacctgagatgaagtatcaggggatgcagtatggatgtattttcctgacgattggtcctkctgtcctgggacccaggtgtgagtgcatagggaaaagggaggagaaatttaatcctgtaactatctccttatggaaaacaggaaaccacaaatgaatcaaatgaatccgtttcccctctttctgatcctctgcaaaagtcatcaaaatcactctgttctcaccaggcaactggagtttcgtcagctgagtctagagtgttccaggcagttacagctaatcatggcaggctctacccaactgggggaacaatttagctgttgtgggatttccctttaaattaaatatgttcttcaggtacagttttttaaaaccagtttttctcccccacttttaacctactttatcgtccattgctgggcctagaattgcatgtccattggcatggctgacgttatatataaatatttggaattgtagttgtaatgatagatattatatatatttcacatgttttaagattaacatattaacagtttgtgatattcaacaaagaatgcaataacttctgcgaaacaggtaagagaaacaaccagtcacttgatctggatattgagacgttacctgtaggatatgtattaggctgttcttgcactgctgtaaagaaatgcttgagactgggtaatttataagaaaagaggtttaattggctcacagttttgtaagtggtacaggaagcatagcggcttctgcttctggggaggcctcaggaaacttacaatcatggcagaaggcaaagagagagcagcaggtgacatggtgacagtgggaagtgacagagcgtggggtgggggtgggaggtgccccacttttaacccttttcctgtttaggaaaaaaaaagcgcagctcactgccagcgctcatttaattttacataaacatgctctttgaagctgaagcaaatgtgaccgattttcaaagtgataataaaatataaaaacagttcttggaattatttctgaacagaactaacatcagaatcatctgaatcatcagaattgtgtattttggaaaaatcggattcatcaaatgaatcttcagccaacaactgttcgagaatgatgttaacatcacatgcaggaatgctacattttctcggatttgacattttcagtgatggagaactattatattttgtaaatggaaataccactactaaaaacagaaggctataaatagaatgatatccttcgtttccaaagtcgatatgctagagtgatgtgaaaaaaataataaaagcgagatatttcatggcaaagcgatctcagggtaaacactgcacaccagtaagtattcttggggcaaatgggaaaagggttaaaatgaccagatctccagagatctcactcactatggtgaagacagcgccaagccatgagggctcygccccagtgattcaaatacctcccattacggacatgtttcaacatgagatttgrgcrgggacaaatatccaaactatatcaggatcccagcagactgggtgggtggaggttcagggatatctgggaaggactaagaatagctttttcttttagtagatcaggagtttcctcttacacacaaaaagctccaaattyaaactagcttaagaggaaagggtcattactggctgacaaaatgcgaagttttgtgcaagagtcagcaaagtttctctgtgatgggatatttaataaatattttggggccttgtagtgtttgttgccaactactcaactctgccctcatagtgcraaaacaggcataaacgayatgtaaaggagcaggcatggctgcgagaaactttatttatggatactggaatttgaatttcatatacattttcatgtgtcacaaaatattattctttcccccccgcccccaaccatttaaaaatgtgaagcatttttagcctgtgtgctgtataagaacacagccgtgtttggcccagcggttatagtttgccaacccctgcttagagtctagctttattcagagcttaaatatgtcatcgaggtcccctctttatttawtcccttagttttgatgatcttttatgggttatattcttcaaagggaaaattctctccraatggggctgccactggcagrcgagcactgtcccatcttggcttgttcccccagtgacaagaagctgttttccccactacccttggcccaaaagccacagggagaaccaggattggcctagttttaggcagacacctatccctgaatcagtcatgtccccggatgatgcggttctctgcagcctgggcagtcaaggctggagataattctctgcttctccacrgagtctgagaggccccgttccctaatggwaaaatgaggtccaattttgcaaaaggaggcacctggggaaacattctggacacacaaatctatagcttctaccgtcaatctgctatgatccttttatggttctgacgttgcarttttatttttgcatgtttctagagacatcaggaggggatcttttcgggatgtggcttcagaaaggagcctgttggatggtctcttactagtggtcagcaaagaacagttcttttgtaaattgcactgcattaagagcattcctgtttccatctcattgatacctgccttgcgttctgttacctggaagcacaggtcaaggtagtcttcttgttccactgatttgatgggggtcaggatgctttcagaaaggaaatgagaagagtggcttagaacagggaaaatgtggccgggcgcagtggctcacgcctgtaatctcagcactttgggaggcctaggtgcgcagattacgaggtcaggcgattgaggccaggctggccaatatgatgtgagaccccatgtctactaaaaatacaaaaaattagccgggagtggtggtgttcgcctgtagtcccagttactcaggaggctgagccaggagaatcgcttgaacctgggaggtggaggttgtagtgagccgagatcgtgccgttgcactccagcctgagtgacaagagcaacactccatctcaaaaaaaaaaaaaaaaaaaaaaggacagggaaaatgtccaggaaggatgtggcttagctgaagatcagcttcagcttgatcccacgggaagctctggagggtgaattctacagcagagttggtcctgactgagaccagggcctggctgacctatggcagtcagcgatgagccagtgtctgctggggaagagggcggcgtggacatannnnnnnnnnnnnnnnnnnntggggcaggaaggggtagctgtgagatactagctaattcttacagcttctgggttcaccagcccggcaggagaatctgggttgaggaggcaacatgacaacgtgcctaccttcaccagagagactgctgtcaaaaatcactccatccatgcaaggaggaacgatgcagacacagaaattctctgctgtgagggccagcactgtagtatttactgacctgctccccactccacacctccaagtgcaggtgtacagactgacatcaaacctttcatcccgccctcggcctcatacctgctttccactctgtgacctatttacttcgatggagtcattttcaaataacttttgtttagtgaaactcaaggcttttcaggatgctgtgctaatgtcttccttttttaattgagtaaatatattatacacagctgggtaggttgtttccttgctggccttactgctacaatttgaaaacggatacagttttctttaactcacataggatgaatgtggcatttattcctggtttcctgtggctctcctcctttagaaaacgtatttacatggacgtttttgaagcacttcttaagacatcgaaaaattaaaaaagaaaaaaaaaaagaagaaaaatctcttttccctcccccaaacaatggttacatagtgacaacagtgggttgagctaaattcagctacgtcaaggaagagcaataaaaggagatggattgttctctaagcttcactttattggatattgtaattgacatatagttgtcatttataatcatctgtccattcctgtgaggtgggagcagtaaagttaattgtggcagctcatttgcattaatctcacctctgaagggtacagtaacccattaatatcacgtcatgatgaattatcacaaataacattgaacatattgattaatgatctctgagatttgtatctcgttaaaacattttgttagctctttaaacttttaagccaacaaccattgcgtgtaggaggggtttagagatcatctgagaggtggtggtgggtggtggtgtactttgtagggtcactggtttaaggggttggacaacccgttcccatctgattttcctcttcttcgggagccaagtactttttgttggtaacttccgtctactttttgcaggatagtggtttcttcaaaacagtggcttctttgattgtaaggtggctccgattctcaaatggaatgattttcttaagatttttaaaaattaccccttcaacaccttaagtgctggctttctgaacctcttgcccacctaggcatgcctgctactttgaagtggcaagagttatctttgtctattacatcagcattcccaaacttacatgttaacataaacatggagctcagaggaaatgtgttgtttgagatgaaccatcgtttcaaatgtcacttacttcttgttttataaagtatcattactcttttcttggacacagtctcatctttgaggagtttgcagattttatctcctgtggacatttctacaaaatcaatcaacaaacttgagcagagaaatcatcatactagccacacacactctgcaggcattaataaaataatagtaaattctctttaaccaagtcctttgcagaatttcctggtagaagtttaaatgcaatagatgcagtaaagaaaagggttggcttaagagttgacttacaaagcttggtcctaacagctttttcctttatctgtttcaagagtcatacgatatttgatctttcaaacttacgtatttcttccattatgtttagtattagtttcgttttctcaagatacatatttaacaactagcaaaatgttggaagcggtctcctctgctgtctatttagggaaaatggaactgatctttctgaaataggcatgcatgtaatgatgatgtcattaatgcttggctagctggtggacttaaacccagagggcacttctgaaaaggggcaaagtgcatctgcttctgctttgtttatagactgtcagccttggatctgtcactccctcagaagggaaggattgaggccaggcaaggtggctcacatctataatcccagaactttgggaggcgaggtgggaggatcacttgaggccaggagttcgagactaccctgggcaacacagtgagaccctgtctctactaaaaaaagagaaaacaaaattaaccgggctgggtggcacccacctgtagtcctttggaggactacttgggaggctgaggcaggaggatcacttgagcccagaagttcaacattatagtgagccactgtactccagctgggtaacagagtgagaccctgtctctgaaaaataaaaaywaaaaaaaaaattaagttagaagggagggattacgaccctcatgtgtatcaagaaacaagctccatgaagccccrtaggatggctcagcaccagaacgaggtctgactgttaagcaaagtcaagtgcatgatggctgaacattgctgggggaagattttgcaattatgcattgtttgtgcctttagccagtaggtaaggacagtggtaccattctgacggactctcggatgcttggttttatggagggatcttaaaacagtaatcggcccatatgtgcagcaacctttgcacctaaatagctgaggacaaagtaggttgcttacttcaagagcccttccctttctcttctttgtcaggcctgtaatgttcctcacccactgagtatttaatatctgtgttttcacatcaaagaacaagctttctgtctcccaggatagtatcttgtaaagccagcctctttattacttcaccagttttaaggctttattacttgcgacctaaagcctgctagtgaattatgcatgttagaactcacagcaccgtctctgcccactcttttgccacctttttgggggtccaaaaagtacaaggcgagatcgacgtgtgttcattcccatccatggtattaatccttattcatttaaaaaaatctgctaacggaaatatttccattcagctcattaatcaattgtgattttcattcccttgttttgtaaaagctgttgcaataaatacttttttcacaaggcgaaaatccaagagatggatgcagccagcgtaattaattgcacccagttacaggagatcagcaagtttgtgagattcacatgctgctgtaccatatggttgcccagtgggcgaaaaatttgattaatgttttgaagtagatttttttcagcaaatattgcagccccagatgaggtgggggttgtcccccccttttactttctagtattgttagacttagctgaaggaaacaatcctctgatttaaagcttaataatactgtgattcagtgaaaacttaacatgcgataaaaattacatttctctcatctcttgtggatacagaaaaataatacatgatgtcttcgtttgtaattaaggaaaatgtgatcgttggattctaaaacttgattcttgattttttttttcccctaagaaatggaactgtggttttcactgatgcacttttggtatgatttataagtagtatatttgggcagactcttcatactcaaagcagtaaaaaataaaataaaataaaatacaatgaatccacaaacagcttcttcttcattatgtaccctatacctattagagcatcataaaatataactatatgagtatcatagaaaagttaaagctgtctctactctgttatgctaagatatattagtttcataaccactcaatatattcatagttaatttatcctttattttaaaaaaatgtcctgcagattttaaaatcaattttatagtttcttttctgtttttagttagaaagttcattttatcttagcagctccttgtcatactgggcacccattctcttaggatgctgcccttctgacttttttctccaatacctgggagggaattagccatttggtaatacaacgggacaagcttatggtaggtctgacctcagcattcagaaaaacaatgtgaaatttgtaatatgtgtcagaactggcaatcaacgccataaggacaataaaataaaatacatttctccactttagtaaatgaggcttcatgcttcctatggcataacttttttgttgttgttgttttttcttttctttgaaacggttttaaatttctaattgcctaagcaatctatgacactccttcaatcttaatgtctgttgaaatgaactagcatctcaagcagttggagcatcatctttaactagacatcaacctggttttgaatcctttgagttttggcaaatagaaaattcatccagggccacaaaaaatatctataattttgacccagttgtagtctagagagatacttagttcaaaaagaattgtgttatcgtcatcaagcaaaacaacagtatatgctatcatctctgagatgtcacacgattattgctttttttttccttttaaattttttctttgtgtctaaagcagtttaagagctctaagtgtgctctgttttctgatggcttaacaagggactggctcaatcaaaatagagaaggaaaggacggagaccaggccaaaacggccatctcctctgattttcgattcatgatataaatttttaaacaaaaaagttacagtgtttttggtactttcactaggcttctaattttttttcctaaacttaaaaaaatttttttaagatcaattatgtaataattagccacaaaggcacaagaactgtttcagtagtggcctgttttaatgttccattctgaagaaactggtacagcctttctttcctgagtttgagctgaaactctctctttcccttttatcaggtcgctcaaaacagatttttagagtgaagcagttttagggacaacatttaggagaaacatttccctaagattccctaacatttttttctttaatttagccatttctaatgaatattttttaactgtgcaatttaagtaatgatttttttaatgcctgctaccttcaagacacttcgtgtggtcacctccaattatagactaggtttttaaatgaaaaacggaaacacttttaaatttttatttaatatggccggtgaaacatgaacaatatatgatcagttggcaggagacagtgtgatgaattatttatgagtttacttttttttttttttttgctttaacagcacatacatatatgaaattcattaccaagtgataggacgggtaacccagaggttctgatgagggccaggacctcatggtcataaaagtaacattagacctattcctagtaatttgatctaggttggcctgatttttgttgtggtggcagtggtggctrtggttgtcaatttaatggaatgtatttggaaagagcaagcttcttcccaatgcagtgttttccctgcaaaggagaagaaatatatttcttgcctctctttccttagtcctgtgtgcttccccttgatttcaccaggacaattttataccmatcccttgtattttagaagagcctgatacatttgcaaggwctctctttatattcctgaattttgcatccctagacatcatcctttttgagagagaaaattccgagtgtcagttttcctttatcggaacctccttttatttgaactaaccacaatgggtcrtaatttataggcccagtcagcgcatcattgctcagatagagtcatttacctacaagtatccatcagttaggtgggggctgctagattttttaagtggaaaaaaatccaaacaggttcaggaagaagaagaaaaaatcatcctgggggcagaagaacaacaacaaaaaattttccttggggccttccaatttgagattgttgagtgttgccaagcaaaactaacacgcagtgggaaggttctgcttttctcacaaattctcggttaacacaaggcgtgccaacagctggtagagcgagagtcagggtgccaggctgaaatggagtggaaggcagccctggctggaagtcttgctgggaacctggagcgctgggaggtaaaactttacttggtgctggcagcgtcactatgccagtctgtttcttcccgagcttcaggccatgctgatgttcaagttgaataaatgagagctaatgattttttaaggcgtttttagtgaattgccgtgggaatgctaagttggcaagaataaaacctaggcgaggagagttgatttttgatgacccaaagaaggcatgtcctagagtggtttagtagagctcgaatagtctaagattgttccacatcaggaaaagtgtacagttatcagaattacttactaatgaaaaaaaggggaaaaaaagattattaggctgcagggtagtgggaaggaacagggtagcaactctacagtgacttggtctgagaaaccctgtaacttggatccagccagggaagtacttttcccaacaatcggttccgctgtcctgctgtgaccagtaacaggggaaaaaaataaaactcccctaaaggtaaatgattcacctcatgaacgaagggaagaataagagacctaagtttatatacacagattccaattgtaaaatcaaacctattttgttttctaaataaacaatatttgaaaatacaacattgcagtcttgttttcttttatactggctaggatggtctggtcctttagaggaggtcctgaataaaataatatgggctgtagagagaaacgccgtttgcttgataggtgtttttgtaaaggttttactggcctacagtgtcagtacattgcaaatttaagaatgttcactgacatttttagtagccacttaaaaaatttttctaagcaatgatgtcattgtattttacttataatcagaagtacatcagcccgtgaatttagttaaaggtttttaatgtcacttttattacatttttactgtgcattcatgtgcacacacacacttttaagcatttttgatttatatatccctctgcatattttgtgccttgtgatgtgtttaacgaatgacagtgtctttagtgcattgctrcttggggtttctacactggaagtgtaatccgaggccttggaattggtcaaacaaaactcacttggcaacatttacttagagagcactctgcgagcactctgcgagcggacatgtcgatatcagctccctcctcgttcccccccccaccccccatcccatgtttatttgtaattaaagttaagatgcttgagaatggctttaccattaatctagaaacatagagttgtttcctggtgaatgatgtatgacagttttctttgtgcttcctctgaatagagagtagtttttgtggcattgttacagagaacagctttcctgtagggctcacaggctcaactgtttcaaactcctgttgttcggtaaatctgtcagaagggtctgcaagggaccgtatttatgaagagagtgtagagtggtcagtctaaaaagctccttagtgtagtactttgaattttaaattacacacataattcaaaggtaatgtaacttgccgtgtcggactttagtccattccgttaaatggagaaaaatgactgacgtgaagaatgacttattgattctyggtgggaaaatgacttctgtaatatgggaagtatggtaaaaggaatagcttaattatttagggagcacttttcaaaatgtgcttttacagcagtacaaattgtacgtatacaaatggtatgactaggttctttttttaaaaattctttcataggagaaagttatgagaaggcttatattatttcgttgctaaggcaaagtttaattttgcttaaattcctgtaagactaactaagaaaggtaggaggagtgatgagcagtttcttaaccctttaagaaatatgacttgttctaattgccttttcttatttacattatacttaggctggtgttaggatgccgtggctgccaagtttacacartgcactttctctctctctttcttcttttggtttatgatgtttttcartagtgtcatggaactcacttaatctgatttcatcaagtaaatatatgggaagttgagatgacatatttttatctgacatttgaagaaatattcataaaatagcagataaaatatttattttggccttttcattctgatctctcttttgactcgatgtgtattctttgcttaaggaccacagcctaatgttattttgactgcatttcacagtgttggcggcctttcagataaacagcatatttgtggttaattggctgaacatgttctataattataattatattaaaaccttaatgttcttgaacgtttgcccgcgaaggccactcacgtgaactaagttatgtttctgtcgttataactgagctggctggcggctgccattcagcaatccaggcaggactgggaacctgggaaaactgcagaggtttcttattatttcggtctgaaaccgctgtttggatagttttagaagttgaccatgaaaattgccttctggttgtaacttggatccccaggtttcaatctgtgggctaccgtttcttgggattttcagaaaggattggcttggctttttatcaaagttacacaacggctgtaaaaaataaataaaaaaaaagcaaaattagcactttatcaagtttggggcatatttccaaggccaccagggagcagggaargtcaccaaaagaccgctccttgaaaccaggcaagaagccatctttgcagtgagctgagaggtctgatggccgccagctgagggagggaattccccttttgtgccttcgggattgatagagaagcccagtggacttagcatctgggaatcccagattgatcttttctggatattgggtcaaccataagatggtacctttccctgtgtaacaaagtcagattctgtgaaacacctgttttttgtatggctyatgagatgaggatgatttttacctttttttttttttttttcccttgagacagtgtcattctattgtccaggctggagtgcagtggtgcaatctcagctcattaacctcaggtttttttacagaaaaagtttgccaccctctgatctacatgatgtccttcagtttctgtctctcaccagactgatggtgccatgagggcaggggcaactcctatcctaaggcgtggcccatagtaaggggtattggttagaagaatgaaagattgaatacrtcaaagtgatgagtacagagctgtctgtcattttcttatctttggcctaacaactgaacacattttatgaaatttgcaaatctgtttccaaacatgtttgaatggatttttatggtcttttaattaacccaataaaaatggtaacaacacagcaattttaagaaaataacagagccaagtattttttatagctatgcatgcaatccacattacacccacatgcagtatttctatggtccaaataagtatctgtcggacttagaatatttaaattaggatttagttgaaagattatgttctatatcttttttttttaaaaaaaaggaagaaaaataaagctcttcctaaatttatttacatgttggagcaattctggcactgctaaataaggcaggaaattccattaagtttaaatgtgctgcccttaccctaaagtgtttggagggcttcgtagaagagccaaatagattcacacagatyttatttgtagagctgaatgtgcacttcattaaaatactttgtaaggtattcaaggatgggctaggagggtgaggattccaaatcagaatcttcaagccagtgatccaggccaaaggtattctgccagagtgtgaggaaatttcacagcctcatggagacacctcccctccccacccttgttgaacagactctggaaaagtcaccatttcttgttggtcctttgctcttggagcattcttggcctgacctgtcaaccactttagcctccaaggtatctgagcctttctttcgcctctctacttagatcatattcttcctggattttggaatcaggctgggacacaagccacctcctcctccattctagctgtgtggctccaggcaagtggccacacctctttgagccactagttaactcagctgccaaacagggattatacatttacctcttggtgttgcaagaattaacaaggaggatatttgtaaatctccctgggagctggatggtgcttaataagcaggcattaagggttgattatctttgcactctctcctgccagattttgtaactgagtccaggcatctttagaaacagaaatggtccctgctcttctgtatcccctgggataacctagcatcatttcgctgggttacacatcctctcttctctcctgtatgtcgtccctctttcttacggtggttctaagctctatggatcacttgtcttctcctctgagcgggaactgggcaattggaggttctttcccctcccgtgctggtgggagaattgtttagtaggtcataaagtggaatctccattycagtctgatccggtcaattctggtaggacttcatccaagcacaaagaaacctttgttttcattcaagacttccctaaaaggtggctgggtgcggtgctcaggcctgtaatcccagcactttgagaggccgaggctggcagatcacgaggtcaggagttccagaccagactggccaacatggtgaaaccctgtctctactaaaaatacaaaaattagccaggtgtgttgtcacgtgactttaatcccagctgctcaggaggctgaggcaggagaattgcttgaaccctggtaggcagaggttgcagtgagccgatgtcatatcactgcactctagcctgggcgacagagtgagactctgtctcagaaaaaacaaaaaaaaaaaaaaaaaaaaaaaaaaggctttcctgaaaggtgattcacaggcctcttcggatcccttcgtgtttagcaatttggatttccacacagccttgctgtgccttctgcccatttgtcctctgctgctggtccctgggtgggacagctcccctttctccttgtctgggttgctcagatagagccataaggattctccctgcctcaagagctgacttccttccacgagttcctaaccacctgtccagttgattcttctctggacctgccttgacatctctgtgccaagcccagtgccggggttgcagatgcagaggcactggtgcatatttcttgagttgaagagcttgcaactgatgagccccttccactcagaaaaatgttgttcctggtcttgccactgcctggaacccaccaacacctcctctttccaatattgctggcttctacttgttctataagagccatgttctacaagttctgtattgtgtgtgagtccctctcaacaaaacaatttccctagtcatctcttatttatactccttgatgcagatttccattttactcttacctcattctatcataattatctatttgtgtgtgtatgtatgtccccactaggctgtgaggtctgtaaaaggatagtctaaatacagctatctattgcaaatcttataatgtgactccatgatgagatagttggatatagccttatgttcccagcaggaaggaagaaaggaaaggagggagggaggtaagggtgagagagagacaagaaaggaaaggaggaaggaaggacgggaaggagggaagaagagagtttggtcaacatttgttgattgtgaatgaacaaactaatgaacactaaatgaacaaatgaatgaatgaatggacaaatgaatgaatgtatgagtgggtcaagaacaagattcggccccaaggagatacgcgactttctactttgttttctatttggatttcacacaaaggctckaaggtctcctggtaggccatgctcagaagtctgggttgtcccctgcccaggacaggctcaccctggcctgtgtcctaggtattgtggggccgctgtaggaggatggtggttaaatcttggaggaaatccaggagtctcatgtccccttggcttctgtcagaaccagtacctctcatttattttgaggtcttggctgaagatgtatcatctacaaccctgcagatcagatgtgttagagcagagagagtggcgaggattaatctagactgaaatgtgctaatcaagctgtctcagatgccattttctggatagggaggaacagcagttggcgagtttaagagcaatatggaggaaccactggggattctatgcatgatcttaggggaagtagcattattatctccaacactggctgtttacattatcagaataagaatggttctccaaggccaggtgtggtggctcacgcctgtaatcctagcacttttggaggatgaggtgggtggatcacctgaagtcaggagttcaagaccagcctggccaacatggtgaaaccctgtctctactaaaatacaaaaattagccggacatgatggcaagtgcctgtaatctcagctactcaggaggctgagatgggagaatcgcttgaacccaggagatggtggttgcagtgagccaagatcgcaccactggactccggcctgggtggctgagaaagactcagtcttaaaaaacaaacaaacaaacaaacaaacaaacaaacaaacaaaaacttgtctccaaatgagcagacaccagaatctcatggagggatttttcgaacacgtagcacagggcttcgcccccagcatttttattttcgaacttctggagtgcagcccaaagatctgcatttctagcaagttcccagatgatgttgatgatgatgcctgtttgggtatcacattagatgaagggctttgctaatttcagctgcagagtattgactcatggggtaggattcctgccatctgcagcttctttgggtcatcactagggtagaatcttattttctgagtatgaaaagcatcaaagttattttagtaaaatgcttttgctgtcattgctttaaaactagctcttcgaagtgggaaaaccaaaagttttattgaagcaatttgttgtaaatatgagttctgtatcacatttgggaaatttgtaaagccttactttgaatgtctttttcttcactctatctgtattgtttggtgctttctatataaatttataaattggatgtacckccacagatgtcggttttctggtaataatacttttttacattaaaaaaaactcctgaaatgaaaatgtaacttagtcttattattgtaatctccccttgcctttttgcatggatcatttgtttgtgaactggttatttcaggaagggctcaaaggtaatttcatggtttatagcatttatattggcgccttcgatgagcaaaacatattgttttctaatacatgaaaccaggaattcatatatatatgtatatatattattattattattttcattttctaaaattacatgtagtacatgtatatcaacttcaagacattgagaacaaccatgtacagaaattatactctgtacacaggggaaatatgaaagttttgtaatgcaaaaaaataaaaaaaaatcaacatttgcaagcttatgagatgattttatttttaatgaatccaaatggtagcagggagctgctgttgtgtttgtgcattgtacagcaattcatatctaaaaataaagtaacatatggctttgttattatttagtttaggaattgatgcacctaaaggagttttgagagctctgggtctcgttcggttgttgtacatggcaaccaaataagagtagctggagcagagactttctcttcttcagattattaagatttgagcaattcattttttttggatggtgtttattaaagtmaagaaatcttttgcttatttgctaatgattctctcccctttctcttcttatatttttgaaggctgaattggtaaaattatctggcccaataaaaatatgtcctgggttggaaaagagcacaagtttctttttctagccctggagtgaggtggctctctggcctctgggttcgtttggtrtcctggggagtcattgacacccacacactcctagtcacaagacctttccctcccatccagattgtgtttattttacggctctcgcacggagcatgcagctgtgtaaacctgagaatggtttctgcacagctttgatctttgcatggatcaacagttgcccttagtccctgaaccctgttccatggccccatatttcttggatttttccattttctagtaattatggcatcatgtagggagccttccaacagcatcccccacagctttgggtggagaatttggaaaaaatgccttaagtctgccatttgtagaaccatattaagtagtgatttccatttgatgccaaaaaaatttgccatttagtttcttcctaagaggcaatctgacaatttcgagtagactgctggagtctgacaaatttgaatgtattatggactgaataaatgtttattgaacaaatgccatttttttaactcttaaaatgttcagttcttccaccaaacatagatgacacaactgttggagacggagcaccggactgatgcagtgtagcattattttgtaatctacgaactgggagcctatggagacctatgcatggtggaatacaaaagtcatgacctgtctttatatcctagtatgggcaataaaaccctccctttaatagccttaaacatggtacaaggaaactgtgcaggagttccagggaaggtgccatttttccatatggagttgatatggtctgactgtgtgtccccacccaaatctcatcttgaattctaattgtaatccccatgtgctagggggagggacctcgtgggaggtgattgaatcatggagaccgttcccccgtgctgtgagtgagttctcatgagatctgatggttttgtgcggggcttttccccactttgctctgtacttgtctgtttcttctccttcttgccaccaggtgaggaaggacatatttgcttctccttccatcatgaatgtaagttttctgaggcctctgcagccctgtagaactgtgaatcaattaaacctctttcctttataaaccacccagtcttgggtatttcttcttagcagcatgagaagggactaatacaggggtgatcacaaacagcctgcagactgggccatckttcttaggcaggatctcgagctaggagatgagaagagctctataggcaaaaagaatgacttggaaggccacatatggcagagtagctaagactttggggtttccagtttcagatagacatgggtttgtatcctggctctgcccctcaatgcctgtgtgatcctgggtagtttgcttaatccttatgagtcccggttttctcctgtaaattgggattaataatagtcacagctagctgggtgcagtggctcacacctgtaatccccgcagtttgggaggccgaggcgggcagatcacctgaggtcaggagttcgagaccagcctgaccaacatggagaaaccttgcctctactaaaaatataaaatttgccacgcttagtggcacatgcctgtaattccagctacttaggaggctgaggcaggagaatcgcttaaacctgggaggcggaggttgtggtgagccaagatcgcaccattgcactccagcctgggcaacaagagcgaaactctgtctcaaaaaaaaaaaaaaaaattatgtccttctagattgtgaggattaagcaagaccatgcatttacattgtttaacactgtccctgagacatagtaaggcctcagtaactgttagctctcttattgctaccggacaagtgttcttattttcccttttcttcttcttccttttcctgttccttgcccttcctctttcgaagaaagtttacgccaaaaaggatgagctgggttgcagccagcattctggtttcacaggagcctaggagatacatggagaatattctgaggctaggttaaatagtttgtctccagtgtgggtgttagtcatattcttatcagtatctgaagaacccagaagactgactctcagaacggaaaactcttggctagaggattccgaaagctagcgtgaagtggaggctattactcagtgggtgccgtaacatgtctgtgtcacctggcacctttttattctctaatctcaggagtgagtgcttcctcctgccgtgcctggccacttctcaccttcagagtctttggtatgcataaattcttcatcacttcagtagagtgaaccctgattacctacatttattaatgaaaacaaccaagaatagttgagcccaaaagtacaaatcaatgtgctgaatcagtttatgatgtctccctaatttctgcacatctgttgagctgtgatttcaaattccattccatttcttttcttttcttttcttttttttttttttggagacagtgtcttgctctgtcacccagcctggagtgcagtggcgagattggcaagatcgtagctcactgcagcctccacttcctaagctcaagtgatcctcccacctcagcctcccaagtagctgggactacaaggttgtgccaccatgcccgcctaattttttgtatatttagtagagatggggttttgccatgttgcccaggctgttctcgaactcctgggctcaagtgttgtgccctgtttggcctcccaaagtgctgggattacaggtgtcagttaccgcactggcctggaaatcctatttcttgtcaagcaggacatcaaagttgagatctaagaatttggactaaaatttggggcaggttgtttccactactgtgtattgagagatggcagggaccatcttgccgagtccaagagattgtgaagtctaaaaggcttggccgcagtgttggttcatctgtaacagctgcctacaagggaatctttgagaaatacagattgctgcatcttataagaaggacagtgcttaaaacagaaagaattgagtagaaattaagacatagcttgatttttttccaacagaatcatgaagtctgttcaattttctttttaaaaagtaatttaatcttctagaagatatctacgtttattcaataatttcctaaggtagtcttcaaaacctaggagcctaggagatacatggagaatattctgaggctaggttaaatagtttgtctccaatatgggtgttagtcatattgtcatccgtatctgaagaacccagaagagtgaccctcggaaaggaaaattcttggctagaggattccgaaagctagcgtgaagtggaggccgttactcagtgggtgccataacatgtctgtgtcacctgccacctttttattctctaatctcaggagtgagtgattcctcctgccatgcctgtcctccctccctccctccttccctctcccctctcccttctcccctcttctctttcccctgtctccttctctccctcccttccctctcttcctttcgcatctgacatctccaaatagtttttcatgcaatggcattactaatggcttgactttttcgggaaatgattcattactttatgatttcaattcagtaaccattttcagctatgccataaatttaaatcctttaccatcaagataacgtttttttctcctgtcactgaaatattatgattggaaactatttttaaaagttgactctgtttgggacagctcttagggatttgtcctttataccagcatataacttgtaggttgtcagtgtctccaggggccatatgttcaccacctagactcaacagttgctaatgttttgccatgttttgtcagttcatctatctgtccatctctttgtccatccatccaactacccacttacccatccatccatacrtttatccatccatctacccacccatccrtccatccatccatccatgcatccatccatccatccatcatccatccatgcatgtaagttgcagacatcaacaaactttacccttaaggactttggctggcatctcctaaaactaaaggcattgctgtacgtaatcacaactatcatcattatcatgtctatgaaattggtaataatttgctaacataaaataatacctagtccataacaagatttactgaattattcacaaattgtcttttatagctttttgttttcaatcaggctgtaaagttcacacattacatttggtattgtatcttattagtctgtttattaaagagtttttttcagggatcagggttagagggaaggctcctttctggatactgtgtatactactaattttctttatcggctaccaaggttttctttatttttttcatacttttctttcattgaggaaacttattgttttgtacattttgttgtacctttatgaatctggttttgacttctggcccagctaagaagctggtttcctttggtgaaacatgggagaagagggaggaaaaatctgttaattagaattgtgggcgtgcactctgtttatctctaacagaataggcttcccacggctctgagctggaaaggaagattcaagtctcaggttaaaaaacaaaccctccaagacctcagggctgtttgcctgtgattagagtctaagaaagactgagaattggaaatcaggactgtctctggtcactgatggttcaactacagcacagatgcactgggtaacagacacaccgccaggcctcaggattacgttacctagggttaggactgagcctttcttccaccttcttggggttggagggcaggaatttaacatatcttagatcacagagtaaggcctcttctacccataagtttggtttatacatcaaagtaacattctaaaattagatgagggtgttttttttttttttctttttgagacagggtctcactctgttgcccaggctggagtgcgatggcacaatctcagctgattgtaacctccacctcccgggttcaagcgattctcctgcctcagcctctctagcagctgggactacaggcgcctgccaccatgcccggctaacttttgtatttttagtagagaaggggtatcgccatgttggccaggctggtctcgaactcctgacctcaggtgatctgcctgccttggcctcccaaagtgctggggttacagatgtgagccactgtgcccggccttagatgaggtttgtagatgtgtttttcatattcccaaagccatgaaatttgacaggtaaatatatcagttataaaagttttagsattaattatcaactaactcccagaagttgcctcagcctctctttttcagccttgtcttgccccagcccagagacaagccacagctataggttttatttctgaaggagaaaactcagtggaccattccactgcctcaggagatattgcctacctgcagacatgttttgtcttatccacacatgatgtaaaaacaaaataaaaatgctgagagaaatgccaattcagaggtttcatataaaaatatagctttcccattagacttgaaaattggaagaggaggtaacaattggccagtgctgagtagagggcatgtggtctctactttgccacaatctccaccataccttattgtctcccttctcagtcgaagcagctttacacactcctgctacttgccaagacactgtacacatttaagtttgctacctgttacttggcatatctcttggttcctaagagttttaggtattatgcaatttgccagctccctcagcccctttcctggctccaaacctttggctttggtttgatgttactgggttgctgcaggaaatttccctgtggacctcactactttatcaactgtaatggtcttgttgaagacaaggcttagaacatcatcagacccagagcctttctcagaggacctgggagaactctccatatggattttcatttgggaagatagatgctcttattggaacagctggttttccctttaaaacagggagtccagcagcttctaggatgcttagaatcagaattgttgctcactttttaaggtatagagtakttgtcttattcttaactacattttatatctttgcccttttttcccctactttaaataaaatctatctctaatttatgttacttaagcaatgacaaattctttttctgatagacaaagtaaagtataaataaataagacatccaagtaataatcagaagtattttttatgttggtctcattgtggtctttttaatcccaggcctgatgcgctttaggtaccagccttggttgaagaggagcttgaacagcctacacagacatgaaacttgagcaactgagctcatggacgttgcttttaatcaggatccagaactagggagttgagtgagcttggatttgagctccacttttcaaattttcaccacctgtgctctttcgtttttgttttttgtttttgtttgttggttggttttttgtttttttgagatggtgtttcgctctcgttgcccagtctggagtgcaatggcacaatctcggctcactgcaacctccacctcccggtttcaagcgattctcatgcctcagactcctgagtagctgggattacaggcatgcgccaccatgcccagctaattgtgtatttttagtagaracgggatttctgcatgttggtcaggctggcctcaaactcccgacctgagatgattcacttggccttggcctcccaaagtgctgggattacaggtgtgagccaccgtgcccggccagacccgtgctctttctcccaccactgccctgtgccaaccaccacccccactcctattctggaaagagccaagccgtcagctattgcttttgaatctatacgcaattctagcagcttcttttagagcccttttaaattagcatgaaatagttttactagccctgaggtttcagccaaggagctttaaaggagccagccctttgtttacttatttttcctcttctgaacatttggaaacatagcttcggtgctccttctccaagaaacctgagtcatgacctccccaaagtgtttccttcccgtggcctcttctcccgatcagctgtttgttatctgagggattcgttaataaccaggacatctgattctcatcattactcatcctctgctcactctcctttctaatgcataggcctttagccttttactttctacctttttgaatgctatacttttttgtaaaattttaattaggttaatgcattgacattgttcaacattcaaacgatggaaagggtgagtgtggaggtttggtttccccactttttccagccatgctgttgccttctgcagaggcttctagaattttcagatgaatgagaatcctttcagaaatagtctctgcaaactccagcacacccatagtgctagggtgggtcttagtaaaatgtctgcagggtaagcacactgttttgcactccacacaattcacttcacaatatttcatagagactttttcatattaatatataaagagatatatacgcgtgctgcttcacgataatccattgcagagctggtctgtaatttattcaagcattctttgttgatggatgttagggttgtatccattattttgctattatgaacaacaccataatgggcaaccttgtacacatttcctgtcaacatgtatcactgaatggaaaggatctattcctagaaaggatccattcctagaagaggaattctgtacaatatggccaactttctctctgttgaggttgaaccatttgacacatytcgctagcattgggaaaatccccattttcctcactatccatttttcttcctctctttccttcctcttttcccttcttcctcttttttttcttttctttccttccctttttccttttctttccttctttccttgccatttaaaacatactgataacttggcagcacagggcagtgattaaactcaggcactcaycccaccctacctgggaatctgaattctgtcttttctgctgctgtggattctcagtccccaagttgtgtaaatcaaagcttctcctgccacactagtgtgtattaggccaggacttcatagtgtgattcaaatcaccaactgaatttttttttcctttycttcccctttctgggggactacgtttttcatggagaccggggccctccagctgctgtgatgatcctcccttgccagggaggtgctgttaatagcaaatgccaagtgagctggtgttctgtccctccggcctccttgctcacaatagccaggaggaaaaagccatgtaacctctggatgagtcccttggccatttagaagtgaaatgaacatccaagaagaagcatagacaatgtggaggaagaactcttccaaatgatggcagggatatttggaatctttccccctgagttccctctggaagttaaagcccagatcccgtgaactgattaaaaagcyscagaccattcccgttccagtcatcttgaaactgagcaagaccgtgtcatccatggagcttgaacataggagcactttaaaaaaaaaaagaatgaaaagcccctttcttgttttggtaatgatttaatgacagaaagtcacccacccaccacttgggtaccacgcagcccacattaaacaattagcccttgacagtggatagttcaagttagtttgaaatgagaaattgccggtgacctgaaacccatcattattaaccttgtggcacaacattgccataaccagtagccaactctcattttttctttttcttttttttggttggaagaaaggctcattgaggaaagttggctcagttcttttttgagtgaagtggtcagaccaccaagaattactttcctttgattgggaacaggttctaatacagatgtcctttacatgggcaatccacttttctcattgattccacaatcaattcgagctgtgtttatatatagacacctgcccacagagaccatgtggagaagcatttgcgtctcgctgcctgtcttccaaaggatttgccttctagtaattcatgtttttatagcttaactacatttatagtgaacgggtggcttcttcatccaaagaaagaacaaatgacaaaaagaaaaattttgatgatttgggaaccgcatttatggaataataacattcatgatacctctggataatgacaataattacagtatacgattctagaagggtgagtctagctgttcccagtgtgtttccatgggttgttatgtgttactggtcaggcgatcagggatttgctgaagattttctttcccatgtggcagtagatatttcagaaccctgcatcatggtgtccacagaagtccccagagttgtatgagagttcatctgggcacctttcccaaaggcaggccccctgtgcagcttcaactattcactctatttataatgttgttcctggatattgggcttgcttccacttgtggccaggagaggatatttcttactccagatcaaagagttgagacattgccttcccacaattcccagtgagcccaactccttaccacaattcccaccccatgccttccccaaattcctgatgagccctatgccttcccacaattccctgtraattttgctccttcccacaaccccagtgagccccactctgtcccataattccctgtaaatctcactccttcccacaatccccactgagtcccattccttcccacaattccctgtaaatctcactccttcccacaatccccactgagccccactccttcccacaattcccagtgaaccccacttgtgtagtgtgtctgtgagtagtctgcccactctccttatgacaggtttccagtattatctgtttcmtaacccatttccaaccttctgggttttttccttcaacgttttcctgtgacagttctccattatatctttgttagataatagttagcaacccattaataacttccaactttttgagcctctaccatatcttgttttcactgggatttctacaccgtggctactttgtgggacctgacttatcaagaacttaagcagcatctgttagaaaaggtattttttttatgaagtaagtagggaactaactacctgttcactgctgcccgttcattgctagcacaatgccaagtgtcaaataaatgyttcttgaacaagtgaatagagtacgcttctaggcttctggaaacggtgaatgttgctttatgtggcaaaaagggactttggagatgtgatcaagttcaggatcttgaaatggggagatgaacctgaattaccgaagtgggccctaagtacaattataagtgttcttatgagagggaggcagaggggactgtgactacgaaagaggaggaaacagggagaagaggtgaagcaggtgtgaggcaacaatctggtggcttctagcccctgaaagaggtgagaaatggattatcatttggaggattcagaaggaaccagctgtgctgacaccttgatttttttaacccagtgaggttgattttgggcttttgacgtccagaatgataagagaataaatgtgttgttttaagacctaagatcatggttatttgttagagcagtgatcagaaactcatacaagtatgaatgctaagagtaaaggcacctgcctcccacatactggacccttaatattccttttcatgggaggttttgcagattgctgccctccttgctctccttactcttctccttttactgaaaagatatttactagatgtctagcatgttaaagactgtaccttaaaaaaaaatcacactctaatttagcacagtttcaattgtggttaagcaccatgccattcacacttcagaaccaagctcagatccatgtgtgacactctggaatgtggcagctgatggaggaagggggctgaagttgaatctgcactagttgagttaaccttcccatggtgcctgcactagcagggactggactgagaccccagctttcccagtcaggccttcatttttctctcatggtgagagctttggaaataggcagtgcagtgtgggagtccttcccctagcatgttagtggccagcaccatgccacacagccacccagagctgcaagagagtctgcagaggtgattgccccttgctaggtgagtgtaaaccaaaaataaattctaagctccccaagcaactgaatggatccctgcctctgggccaaggggattccgaaataaacctgaaaaactagttcaggcagtgatgggaagagggggttggatatgactcattatacccttctttttttggaattcagtcacaactgaacagcattagcattaaaacagatcctaaggctgacaaaacagactctttatagcaataagataccaaatttcaaccctactctagtataggatcactttgcagatagcaggcatggaaagaaatcaaattattttaccccaaaatatatttctctggtatatttcgaaatggccctgcaaagctgtttcttgtctacattctgtagagaacatccttccctttccaggtcttttcctgatccaggagagattcactaggagtctggcacctttttagttttgataagagatatttaccatttattctctctgaggcctatttcctggaggcttcatctgcatcataagaaccttggtctttttgtggacttatcttaacccagatagtcctttctactgatgccaggtgtttagctaataacacttttaaccaattgccaatcagaagatccttgaatctacctgatacggtttggccgcatcgccacccaaaatcagacagtcctatctgttgatctcgggtgtttagctaataactcctttaaccaatttccaatcacagaatgcttgaatccatgtgatatggtttggctacatccccacccaaaatcagtcctttctattgatctcaggtgtttagttaataactcttgtaaccaattaccaatctgaaaatccttgaatccacctgatatggtttggctgcatccccaccccaaatctcatcttgaattgtaatccccacaatccccacatgtcaagggagagaccaggtggatgtaattgaatcatatactcccgatagtgagttctcacgtgatccgatggttataaataagtgtttggtagtttctctgcgttcattctgcttcctgccgctttgtgaacctggtgctttgcttccactctgccctgattataagtttcttgaggcctccccagccatgctgaactgtgagtaaattaaacatcttgcctttataaattacccagtttcaggcagttcttggtagcaatgtgagaatgggctaatataccacgtatgacttggaagccctcatccccatcactttgagttgtccttcctttatggaccaaaccaatgtactccttacatatattgatagaagtgtgcctgtaacttttttcccctaaagtgtataaaatcaaggtgtaacccagccaccttgggcacacgttcccaggaccccttgagactgtcttaggctttgttcactcttgtttgggtcgggaataaacttctttaaatattttagagtttcactctttcaatcaacgtacgtgactacccagaattaaactggaatgctgttaataagagaaatgaaaggatgatgggagatgtgcacccagcaatgtctgtcttgtggtcctgaagtctaactctaatcctggctccactatctggaccatgacaggttgtttaattgttctagttagagtgttctcctatgtaaatagggataataattggatgtatggcaggatttgggggaggattaaattaggttatatgcgtgaagttcgtagagccagggtctgggcattaatacgcatttagttactgtcgctcctgtgatctgcacaattattgtcattattttcccttcctcctccttccccctccttccccctctctttttccttttctttctatcatcatccatagctctcttgccccattgttttaaacccatctgtttttgtttctggtaactgtatccaaaagtaatacagaattttccgtaagaacatttattgtgtttccttctacccacgaattktcttatgctacacacacaacccactgaaatttcacctctattgtatgtggcttttctagaaacgtgtgcttctgggctttgtctcacacctcctggccagtgtttggcatgtgctcacacatgcacgcacacacagcctgcactatgtttgttgactgaatgaattaatatttcacagaataacaaacacatgctgattatactccttgggaagctaatttgttttcagctctgagagcaaggccaaatcaccagattgatgcctttggctgtgtatctaaaggacgtgccattgcagctaagtggacctgaatgtacagtaagacytagtggtcaccagaatgcatgccaccccggtgcttctgcatgcaaagggtgcgggccatgtgccagtcacagtggaaaaggcatgcttcgtgtcagcacatttggcatctctctgggatcggggatttataccccaaaaccttgctctagagatttggcttccattagcaagggtaaggcttgtaagaaaggagttttactcacctttgcttgctctcacagctgtgtcagcccattttcatctcttttcaatgttttaagccctgagagaacccagttcaattcccagcaagaaatgagcctctgtaacgcagccccagacccaccttcgagggtaggggcacccttgttgtcacgatgtacaggagccaggcttggcatcggagtggatgcttgggaagccccagagaaatagacgagtgagtgcaagagccagctgcctgcgtggcttagaggaagatttcaaacacctagtgcactgaaagtctgacttaatttgtgatttgtgaatagtctcccagaagctatggggtacagatgtgggacttgtgaaaaataccagacatcctgtgggttaaagaaaaagaaaggggggcggtgggtgaagtgtgagcaatttctggcagctttgtgggcatttattatgtctaggtggcacagtgtggttggactggttggtttcctatcagttgcattccctgtatgtcttcagccaatttttttggtaatccaaggcctgatgtatataaacaaattcctttcttgatcatctaagcaatgaacacttaacagagtcaagcttggagaattcagttcctaccacaaggtccggaatggaggatttataactgggagacagaaggtatgctgaaaggtactcaaactgtcacttccttcacccccaggagcactgaagcagacactgattcctctgcagttgttgggcttttgagctacttccctcctggggagatgcgtgttaactgtttmatgactggcaatgccgtaacagtgagcaagcaatgtgaccttacaaatacatgtgcagaaatgcagatgagtgggcctaaagaatccagactcaacttacttctagtggtaatggctgtaggagagatggggagtaggagaagaaaagccaaaggcagactttagtctggtttataatgctttaatatttttttgaaggaagaaaaatgttcattacttaacgtaataattatttttaaaaagcagcctggsgggggggtattcatttttctgtggctgccataacaaagttcttcaaacttagtgtcttgagacaagacatttattttcttaaagttctggaggtcagaggtctgacacaggcctccctgggctaaaatccaggtgtcttcagagctgtgttcttttggatactgtagaggagaatacatttcctggccttttccacgttacagagactgcccatgttcctcgatccatggctccttttcggtcaccttccagccagcaacattgggctgactccttcaatggccatgtctctggttctttgtcttttgcctcctcctcttacttttaaggacccttgtcatttcattggtctcagctggatagctatcaagggtcactttaaggtcagctgactagcaaacctaattctatctgcaaccttaattcatataacctggcgtagtctcgattttattttaattttttaattgaattcagctttacagtatcttttgtagggggtaattttagcttctttctccgttgaaaacttcaagtaaggaaacacttayattgctagtgagtggccagctggagttgtaggtctaattctttttttttttttaagacggagttgtgctcttgtcacctaggctggagtgcaatggcatgatttctgctcactgcaacctccacctcctgkgttcaagcagttctgcctcagcctcctgagtagctgggattacaggtgcctgccaccatrcccagctaacttttgaatttttagtagagatggggtttcaccacgttggctaggctggtgtcgaactcctgacctgaggtgatccacctaccttggcctcccaaagtgctgagattacaggcatgagccactgtgcctggctggttgtaggcctaattctagcaatctcagcaactgtaggatttctctgcattggaggaagcaagactgaaggtcgtctggctttatggacaatgtgcttagaagttcatgccataccttaggtccagtcttgtgactgaaccaaccagacaggcctaggctctgccctaagtggtcagcctccgaggtggtagcacgcagggcctcacttcccactgcctctgtctatgggcatgtgctgtgtgccattctctccccttatcagtgggttcccagctgcctggtgtacaggagggttaagtagatacctgttgagtgattgtgaatrttttcattcacgggggcagatttgtgtcctactaacaccagacatgtcctgttttcagattacttctttttcaacatctgagtacctataacatctaaagaataacaggaaaatccacctgggtggccaaagtcaatgtaatgggcagaaagggcatgtggtagacttggaaatcagacatcttagactccaacacagggctcttccacttgctagccatggaacctcagactgggatccttgacttccttatctataaaatatggcttataactcaccctgtattatagatctgctgggaacatgatagaacgtctgaacagtgctggcttatagcaagtgttcagagatgtgtttcgttgtttttcttttttctttttttgagatggagtttcactcttgttgcccaggctggagtacagtggtacgatcttagctcaccacaagctctgcctcccgtttaaagcaattctcctgccttggcccctggagtagctgagattacaggcatgtgccaccacacccagctaatttttgtgtttttagtagagacggggtttctccatgttggtcaggctggcctcaaactcctgacctcaggtgatctgcctgccttggcctcccaaggtgttgggattacgggcatgagccactgcgtcaggcctattgtttttcctacgtaccgtgattgcttgctttcttctctgtcgatgtccctgccatctaaatgctgagtccccttgtctacattttgaggctcttctattatggaagagggctagagaggccatcagaatttggtttcactagcctttgatccttcctgtttaaggagctcarcatttagcttcacttccctgtcattcatcagaattcattctcagattggaattgtccagtcttagagtgatttttgtccccagtgacacttcccttatatccgtgctgacacaggttcaggagaccaggtcgagtcgaaatcctggctgttccgctttctaacaagctgcttcatctttctgtgcctcacacatctataaaatggagctgggcatctgtctccttcagttatggtgagaattaaaataaaaaacacaaagcacttctaagaaagtacaggagaggccgggcacgatggctgacgcctggaatcccagcactttgggaggcagaggctggcagatcacgaggtcaggagatggagaccatcctggctaacacagtgaaaccccgtctctactaaaaatacaaaaaaaattagccaggcatggtggtgggcctgtagtctcagctactcgggaggctgaggcaggagaatggtgtgaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcccccttagtagctgggactacaggcacaccccaccctgcaggggttttttttttttgtttttttgtttttttgtttttttttttgtattttcagtagagacagggtttcttcatgttggcctggttggtctcaatgtcctgaccttaggcaagccacccgccttggcctcccaaagtgctgggattacaggcatgagccatcacgcctggtgaatggtgtcattttgatgtactgagccatctcagtttttccagcaaccttccctcacctttgtgstcagctagaaggtcagttaacacatgggatgggaattcttgccaatgtccttcgtaaaagaagaacttctccttcactcacatgtcctgatacttcctcagcatttcattctagcctttctgtctccatccaccatctatcaatcatctatcatctagctatctatcgatttctcttttttggctttaattttgtcactttttcttctgtctgctatagaaatagcaaattttcttatgtaagaaaactctgaacgcgaggccaaagtagaattttccctgaaacagctaccttttccttgaaattgttctatatctaaaatcactaggtgaggagtaatagaaatgtagacatgagaagtgaaactgttttttttccttgtaaaagcttcattgtgccctttagaggataactctgtagtttgatatgataaaaataattatatgattatgctgagtgaggtggctcaagcctgtaatcccagcacttggggaggccaaggccggcggatcacttgaggttaggagttcgagaccagcccggccaacatggtgagacccccatctctgctacagatataaaaattggctgggcatggtggggtgcagctgtaatcccagctgctcaggaggctgaggcaggcgaatcgcttgaacccsggaagcagaggttgtagtgagctgagatcatgccactgtactccagcctgggtgacagagcaagactgtctcaaaaargaataaaaatgaataaaaattatgtgattagagaggggaaaacaatcatttcttgtgcgctaatgccactcagcaggtgcttacactgtctggttcatccttacaatgactccatgttatcgccattttcagatgggtaactcaggtagaaatatgattccattagtttaaaaaaaaatacatagaagataagaaaaatcaccaaaaattcccagccacagtagatgtatctgtatttaactactctcctcgtgttgaatatttatcaggtttctcgttttcttttgtttttgttgtaagtggcactgcaggccagttgcggtcactcaaacctgtaatcccagcactttgggaggctgaggtgggcggatcacttgaggtcaggagtttaagattagcctggcccacatggtgaaaccctgtctctactgaaaataaaaaaaaaatcaggcatgttagcatgcacctgtggtcccagctacttgggaggctgggtcaggagaatcgccttgaacctgggaggtggaggttgcattcagtcgagaccatgctagtgtactccagtctgggcaacagagccacatctccaaaaaggtggcactgcagcaaacagcatccacatgtgtgcacagaatattgttctgttgtgtacctcagatggctttgttaggttagattccctgaagtggaatggccagggaatttaaaaagggttttgctcttgtcacctgggctggggtgcaatggcgtgatcttggctcactgcaacctccgacccccctgggttcaagcgattctcctgcctcaggctcctgagtagctgggattacaggtgcctgccactatgcctgggtaattttggtatttttaatagagatgtggttttgcggtgttggccaggctgttctaaaactcctggcctcaggtgttctgcccgtctcggcctcccaaagtgctgggattataggcctgagccacggtgcctggccaagtctgttttttaaatctggaaaatgggacttgttaacttctgtattgtcttttctgctgctttatccaactttgcaatctataagcttctgttactggaaaatggtgatggtaaagtaattgctttcytatgttccatcacagagggtagactgctagctctagtatttttcaatgctgctttttaagtgatagatgtataccattcagtaccaaccctgcaccctgggacatgcctccttgctgaaactaccatttatctttgtgaattcattattcgtttttccaacaaacttttattgaacatctaataagacctggacatttggctgaatgctggaagtgcaaagatgaaggaaagttgctttttggaaggatattagaatccaaaggtgaagcctgcacagtaagtaggccagtggtgggataagggatccattggcccaggaaattggagggacttggagaaggaccatctcacccgtccaaagaatggaggagtaagggaaggcttctggaaagaagttgtgttgaggctgtgtttggaaaggtgaataggagttaggccagtgaggaatggggtgaacaactgcaggaacttgagtgatactttggggtgaattctctctctctctctgtctgtctctctctgtctctgtttctgtctctctcactcacattttaggtaaagcagtgtttcttccccaggggtgattgtgtttgttacagtgtgatggagactggatactgcatctagcagatagatgctgtcaatcatcctacaatgtgcaggaccgtgcccacacaaagaatgacccgtccccaaatgtcaacagtattcaggctgagaaaccatgtactaaggcacaggacaagcatcgggttggataatggcagagaaaagtaccttacctccttccagaacctgagagtgtgtgactgtgagtgtgtgtgtgtgtgcacacacttgcgtaaagtgagaaaaatctggtgttttttcgaagtctgcctcgtttaggctctggactcctgctctctgttgactctgtccagagagtaagcgactcagcaggtgtgcctccccatgggcccccttcacggtgtcctcaccttgatttattagagcattttattcccccaacagtgtttatgacatccaaggacttggtggaaccatgaggaaatgagagtggacagtgagactactatcattcattttcactccccgtaaacatcttctgtttctgttttagaagacattgctaatcccctcatgcactggctttgcgaatttctttttcagcctgggtttgaaagcaaagtggtagtgactttttcctgatagctgctgaaaaggttccacagtatttggaccgctgcctgcttctaccctggagcacaaaagatccaggcgtagaaattggttctaacaatatccttttagagaacaccaaggggatgtgagtcactttccctttgatttaaaggcactgcgtccctcaaattcagagttagagggtgacatgtagttgatctttacttcccgggggcagaggaccataattaaatggctgtggaaacccagaagcagcctacagaaactcttaggagccctccgtctgggaggaattttttttttttttttttttggtatatctgtgtttacagttctagaaaagtgttggttttgagggcaatggagacaggaatgaggagaaaatgtataaaggagaggttgctgtgagccgagattgcgtcactgcacttcagcctgggcgacaagagcgcaattctgtcaaaaataatattattctgttgtttcctaattgttgatttgtggtccatatatttggttccttaactaaattggagttcttaaaacaaatgttaagaacacaacatttaggcacacagtacttggattccagtagctttggataaattaataaaatccttccattttctcagttgtagaatgggaatagtacccaccttataggcttgctgtggggagtaagtgggataataaatgttaagtgcttttagctgtactgtacatacataatttctgtaagtactggctattttaaaaattattttaacactattctgatataggaagttaaaaaatagcacagaggggatccctgtgatttttactcacttttctacaagcatgactccttatataactacagtacaggatccaaaccaggaaayatgcctgggtacaatgtgagtgtataattccaggtaggtaaaataatggcccttattaggatgtctgcgtcctaatccgcggaaactatggatatgctttgttacatggaagaggaaaattaagattgcagatgaaattcaagttactgatcctgcgaagttaaaatcaggagattacccagggttatctggttgggcacagtgtaattgccaggattcctaaaagggggagagagagtcggatgagtcaggcagtgagatggcagcatgagaaggacaccgccacacattgctggctttgaaaatggagggaggcgggcatgagccacagaaagtaggcagcctctagaaggtggaaaaggcaatgagatggattctaccgtagagctaccagaagggaacacaccttgctgatgtcgttttactattttcttatttatttttgagacagggttttgctctcgcccaagctggagtgcagtggcgctatcatggctcactgcgatcctcccacctcaacctcctaagtagctgggactacagtgtgtaccatcacgcccggctaacttttttgtatttttagtagaggtggggtttcatcatgttgcccaggctggtctcaaacccctgggctcaagcggtcctccctccttggcctcccaatctgctgagattacaggaccctgctgatgtcttaatcttagccccttcagatcccagttggtcttctgactccagagctataaaagaataaatgtgtgttatttcaagccgtgaatttcttattaatgtgtcacatagcaatggaaaaataaacgttctatgccatttttatcacatgcgtaggttcatttaaccaccgccactactaaaatacaggactgttccatctgcaccgaggtctctctgtgctaccccttgaagtcacacttgccaccctccgcccttagcctttctttcagcctgtgaggaagcaaaacttttactcttcaggcatcacctcacgcgtcttttctgcctgggaggcactttttccagttttcctggcgaaatagtcatcttttaagttctctgacaacccctctctgagcatctaatcccaatcagaattccctcctaatgtaaactctcattatatcttttaactttatttcttagcacttatcatgctgtatggataatggtatatttgggtgagagtatttgtttctctttctccctaagtaggctggaaactgcatgagggcaaaaacttagctttactcaatgttttctcagcttcatgtacgtgactgtatacagagtctgagccgagaaaaccttccttgcatgtacgagcaaatgagagtattcaaggtacagaactgaaattttctctgggtttttaagtggaagagtacacaagcattataagcaattttacctgcatttactcaacagacttttgttttttatccccttcggtgtaggttgtcatactaaattggttcagattctgtatctgggggtagttagacttctgtgaactccaagtagacggttgaacatgactgaacttgcacagtggacacattgtgcatttgtttttaagtccctagctgtttccagaaatagtttggttaattcatactgataaaataaatccccgtaagagcattattccccaaagtgggcttcctttgccaaacctaattatctggagaaggtattgaagaagtcaacttacctcttggccaaatgctttctagaattattcaaccaaagacagcaggctgcacctaggggaagccaaacatctggatgaagaatgaaatatccagatgttttcaagtatctggatgtttctaaccatctgtttctcttggttattgacaaatgatccagctgttttgcagaagatggtataccttgcctaacagaagagagaagtaacattcttagaaaactttgacatcatctcatctgtactaacacaggatttctgtctttaattgaagccatgacttgatcacaaaaatgaaaatagcttcatgtgtttctgaagctgttgtcttgctttgggcgccagactgcacaggattttaggttaattgtcttgtttacaattagagtctgcattgtttgtagcttgattctatttataatgtactcacaccttaaccaatagcctcacagatggcatatgagaatactcatactcagtgctgctaaaaacagcctgctgcctgaacaccagagtgtcttttaaagcgtagaaaagttgggtacataaaatttctgttgcaaaaaggaatgtataggccttaattgaaaatgtatctttctggaacaggagttttagaagctgagtaccacccactcccttgctccacaattctcttttgtttaaggcaacacgtaggttcttagttttttaaatatatatatatatacgtatatatatacgtatatatatgcgtatatatatacgtatatatgcgtatatatatacgtatatatgcgtatatatatacgtatatatacgtatatatgcgtatatatatacgtatatatacgtatatatatatgtgtgtatatatatatataaaaatatatttaaataatgttaaggctagagtagaatgacatcatgggaaggcttattgaaacttggagtggattcgtagtctgccacgagaatccttgtctgatgtttgtgggtgtgtaggactgaatttgaagtccttaaatggatgtcctaacagtgaataaagacgtggggcttgaatttatgtattatcttattactctgtcattttcttgagtggtacaccagagtgcatggaaaagtaaatgattggaagccgcgtggtagttaagggtgatgatgtaggagtgagaacacaggcttggtgcctggcgtcagcacacacatcacaggccctccctgtcagtggctgtcgtctgttagtgtttccagcacagctctaaagagcgacgcttggaggctggggagagggggatggagaggcatatgattctgttgacatttagtgacatgcgctcttcccaaccaaacagatgcaaatggattttagttgtgagtggttgtttaacacctgcataagtgacagacctgcagagacaggttgtggatggaacgcaaaattcaaatcagtgcatgagaacagcagctaaagtggacagacccaaatgttttgcctaaatatttggctcctagttgtacaaaaagccaaatggtttcaatttcatcctatataaaccagatgattgtgtatttacttctcacttgccctgccagggggatggttggtggggggaagacaaggacaaacaattcgaaagagcaaatgagccaaaatccatctggattttgttaatgctgattatatagtttcttctgttgtttttaatgtcttccaagccttctgtgtattagccagcattaaggggaaaaaatgacattttgactttgactccctttgtaatgtaatgcattgttatgtatttctgaagtttttcttaaggaaatagtatatgataataatgactagcactcactgagtgttcgtgatcaccaggatcaggccaaaggttttcacgcttgtgccttttaaactctcaacaacccagtgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgggagtgtttcaattaaaattatgtatggacatggaaacttgaactttttatgattttcatgatcacaacttactctgatctctttcaaccatttaaaaatatgaaaaccattcttagtttacaagccctacaaacactggcattgggttaggtttggatgatgggccattgcactccagcctgggtgacagaatgagactctgtctcaaaaagaagaaaataaaacaggcgttccttacctacagcctgctatgatttggggttcttgtatttttttttgtttgtttgtttgagacggagtcttgctctgttgcccaggctggagtacagtggcacgatctcagctcactacatctctgcctcccgggttcacgccattctcctgcctcagcctcctgagtaggtgggactacaggcmcccgccaccatgcccggctaatttttttatttttagtagaaacggggtttcaccatgttagccaggatggtctcgatctcctgacctcatgatctgtcagcctcagcctcctaaagtgctgggattacaggcgtgagccactgygcccggccggggatcttgtattaatartagggagacagtaagcaagcaaggctcagttaatgataaattgttatcaggagacccagcagtttctgctttttctaccctcctctttgasctctatttaaactaataggttactgggtttsaacatgccatgcagtgggaagaggcgggaaccccactgagctgtcctctaagtgaatcatgcccactatttggttgtgaggctgtggactttacttttcacgcatggcattgaaagaacagggaagggtggattccccatctcctcttcctctttggaatcaggaaaacatgtttctattctaaatgttctttgataaataagattgcatgttcctggctcctgtaacatatattttctttttcctttgtccggcatacttgactaattgtagagctttttgagcctaaaactggataggaacccagtgcatgcactcttaaggactcagaggcctgctcaaggttaagtgcagtatggtctgaataataagcatagatgcccctttactgagcagcagctgggtgctgggcactgtgctaggcatttttggatgcattttcctcctccaacttcactttcccctatgagattatttcctctgtgttagagacaagaaaaatcaatttacaggtagtttaagtgacttgttcaaggctacagtaagcttgaagtggcaaggatgggatttgaacgtctgtctgcttgattccaagaccgtggcctttgtcattcaggtcatgctgctttcctcaaggcaaggaactgaggttttctgttggcagtgaggtggtggcttcttgtttccctggtcttagatactgctcaactcacagttgaaatgtagaagtgaaaagtcagacagcagcaggtgttgctgggaatgtggagaagttggaaccctcacacaccattggtggggatgtaaaatggtacagctaacttggaaaacagtcggcggttcctccaatagtcaagagttcccatatgacctagcaattccactcctaggtacgtatcaaagagaaatgaaaacatggaccaagacttgtacatgaatgttaatagctgcattgttcttaatagccaataggtggaaaaaaccctaatgtccatcaatggacaaatggataaatatgttgtggtaaatgcgtgtaatggaatattccattttatattcataaaaatggacaaagtcctgaggcattctataatgtgagtgaacctggtaaacatgaggctaagtgaaagaagttagttacaaaagtccacatatggtgagattccgttctgtgatatgtccagaacagagaaatttagagatagaaaatagatgagtgatgactcagggctgggggagttgggggtgggcgggataggaggggtagagggtgaaggtgatgaaaatgttttgcaattgtctgtgttggttgcacaactctaaatgtactaaaaatcattgaattatacaattttaaatgggtgaatcgtatggtatgtcaattatatctcaataaagctgttaaaaaatctgaaagtgtcaattaatctttgctcccagagaaaaccactcagggcccgagctgctcatgggcacaaaaacccattcctcagattccttggccatgctggaagcctggcttgtgtgagagcctcaagtctctgtaacagcctgggagtgttggtcccgtcacagggctgtggcagcctttaaagctagaaggcactgctcagaggaactggttcctttgaatccttttccgtcaccatgcaaatgtttacaagctctaatcaggagaaatgaaaaatcacatgtctaattttaaatatgttgcctctgatcacaggtgttgttaaaacagctcttttatgactttataaatactcagatttattttgaagcaatgtttcattattcctatactatgattaaatattgagactattgcttttccaattgttctattgcagtatttaatgagtgcaattaaatggaaaaattgcctttttaactggtgatagtccattagtgtctctgtctcttcaggaaagaaaagaagtgaattattagaatgacaaatgaggcaaagttaccaccgtgatggagaggtgcgatttccctccacataatcttcagttagtgatctctgtaagagaatgtttttcaaaaggctaatagagaagtaatgagatcagaaggaggycaacccggccttctccgtttggcagcttgattaatttatttctccttcttggagattgctgcaaggggcttttgtcaccctgtgtttttcatgggactgtaacctgagtgactgctgatatattagccttgcaggcaaggaagcaagtccgttgccctggaatggaaggcataggagttaagggtttgtttgcttttgcaacttgaacacactcattgggagctttggataatgacaacaatgatgatgattttaagagttaatcaaattaaaggctatgaaatgatgcccactgtggatcctgtgcctggtgctcagcacatacaacatcatttcattttcacagcccttgtgacatgatagggctcttttgcagatgaggaaatgcaggctcagagttatctagcattgtacccttaagcagaagggggaggtaggagtgaatctctgtctgcctctaaactcttgagctcccctccagaagtccagggctcttagaaactttgtactcaaccattaaattgttgccattgtgctgaggagcaaggaaactgggatcacacagctagatcacagtgggggaacctgaattatggggatgctcacaaaagggcaaaacacaacggttgctgtcatttgatgctttatgttaagtrtgcatatgctcagttrcagaaacctaaattgctaaattgcaaggctgtatatgatatgccaatttggcatattctgtctttttatattctgccacccctatcatacttatgaaaatgccaggttgtaatcattcactgggagaaacaaggggttgaacattgttatcgcacaaaggaagctgggcctagtaaaggaatgtaaatactaaaatgccagcatcactgttacttactgtgtttatactggatgtattacttaacctctctggctttatttctgcccgccctccccccgccccccccccgcaatgcctcaatctgtggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtaaataagataatttgtttctgccccccaaaagattaaaatatagatttttttcaaagtctgtttttttaacacctacggtccctgaatatgttcgattgaggtttgtgtctgtaatttggaacggctttttgttgcaactaaaatattcatttgcagaaattatcactgagggtgttagcttctttatgcttgcgtttcttgcatttgttactaaataaaatatttagaagtcacgtcgattttcaaaatgatagttaaggatgaaggtaatattggcatatttatttttatctgtgtaatttttgcaacttataaccccttcaggtccaaatgaaacaggcaaccaggtaataaaccaattacgttctaatacagattacttcatgacagtgtcttattttccagtttatatgtaggtgagattctttggagaccgtcttcgtaatatagctagtttttgtccattcattttgctttgacttccttgtataggtacaaaggtgtaagtaggagagtctaccaggcagcacacagaygtggccctgtaaccacccttgtgtaaaatcagagtaatcctccctatccttgcttatttcactgggttcatgggtgatgactgtaaatgacacaggagacagggaaagagttttgttatcctgatacacacattcttaaatgcctctagctgtgtagacattggtttgtccatattaatagtatttyacgaagtgccagttgtgtgcctgctttgtggcatatgcattggcattcattgctttatttaattcttccaacaacgtgtcagatgtctgttcaaattattcccccctttacagacacagaaactaagatttagagaggttatgcaatgtgccaacagggagaagttggagctggaatttgaaccaggctggctgactccaaagctgtgtcctcaagcagtacatcagagccgaggaaggtcaagtttggaacgccatttagctgctctcagggagtctgattactgtttctctgttgaggctcagctcaagccttccctgggccatgaaagacaacttaggtttgggtgtcctgtgtttgtaccttgttttgtgcccacctacatcctgggttatgtctttccccaccccaagccttttttgccatctctttttcccagaaagactggaaacttgcctaaagagacagaatcccagatcccagatggatctactattttagaatctctgcttccgcatttctaaaatccttcccagagaattatttgactagttaaagcttaagaaacaccccagtggattatgagtgccttctagccaagaatgggtatttcctctgtgcaatctgagggcccgggacactcctccagcggagtagcctgtgatttgtatgggctgcatgaattcctgcactaacaaggtaaaagaaggatgttaaagaaaacccgagatcttttgggtacatgctataaggtgaaaggcttatttccatttgctcaagaacaaacatccatttgtccaccccaagtatttatatagttcaattaagcgggcaggtaaactgattttttgggtggttaatgatctgatgattttcctctctgtcattgtgattggatatgataatctgagagttgcccaaattagtgcctttactgtagttataataatgtcatgatgactgaggatcactgagtgtgccttttgctctgttaagtgtgcattcagaactttactaacatgggttccacaggaaatattagccccattttgcaaatgaagaggctgaggctcagaaatttaaaattgcttcatgtcgcacagttcagtgtaaagttgcaatgcaaactaagatgtttctgttgcttataatcttaactataataatcataaaccatgttctgttgctcagaacccttgtacttataatataaaacaatctttttaaccaagattcttcgcttgggtattctgagtagcatggaagagcattatactttttttttttttttttttttttgagacagagtctagctctgtcacccaggcctggagtgcagtggtgtgatctcggcacactgcaaccttcgcctcccaggttcaggcgattctcctgcctcagcctcctgggtagctgggactacgggagcatactaccacacccaggtaatttttcatttttggtagagacggcgtttcaccgtgttggccaggcttgtctcaacccctgagctcaggtgatccgcctgccttggcctgccaaagtgctgggattacagacatgagccaccaaacctggtcaattttctatggggtgtgttacattttttaaaattttattttactgtttatatagaaaaagttgccttatcaaccattataatcatggtatttagtgagtgtaatctgttctgatgtaatacttagtttaactggtaaaaaatattttgacagaatttaagattagttctttttgctttgtccgtcaatgtgaaataatcagtatatcatatttatagaattctgctaaaacatgcatatatacataaacagatattcatcttaattgatgttaattgagatataggagtacttcattaagtctccagaatacatacttcataagcaggaggcatatatgtttgtatatatgtatgtacatagacttsatacacatgaaataaaatttcaaatggttcctctgttcmgcaaacgtgacccaaagttttggcttatttggcgttttgttttcttgaagacatacttgaattttaaatagttaatccatttaagaagtttcatttaaggtactgttaaaaagaaaaaacacagaacaacacagtgagagcagaaaaggtatcatctcctcyccctcttcttctcttttagaaaccttgctgcgtgatccactgatggtaaatatttcatgtactttgcatatcagcctgagttccttttgtgaagtcaggtaaatggaatgtaaatcccctcgtcctccagacagtaaaacggcattatttgatgttacatcgcataaagatgcagatttgattccccctttactcacactataaaaacaaagtttttaaagtggttagccatacctggaaatgtaaatgcattcgcstaatgtaatgccaaagaaaaattaagacaaatgataccacatcgctgccacaaactgcggctcgtacaaaattcactttagttattatgctgtgaatacgggctctcaccctcctccgtgaatgcacaatttatgttgaatgcaacatgaatcattttaatagaccaagcaaaaagtccccaaagtcgattttcaaattatgaaccttggaacagaatataacaacagcgaacaacaaatagttcagactttactctgagctatgagtgaaccattaaagatacagcaagcactttcggtgaggtgttacacaattcatagcctaatggcaaaaatatcagaaatggggtattttttaatgctgtttttccagccatcattctgttcaattattttcacatttgtgtaatcaagatattcccaaacagaacatagagttgtgtattgttgggaactaattatatgtattataaatccaagaattaatttaaatgacccagtttccacagagaaaaagccacattgtttttamatagctaactaaacaaaatgctaacccatatgggagaaatttccaaagaattaaaaccacccaccaggaaaatgggaaagtctcccctccacacacacacacacgcrcrcrcgcacacacacacacacacacacacacacacacaaaatcaccaaatcacacctgaacaagaggaagaaaattaaactcattgaggagataccatcttttttaaaaaaaaaaaaaaaaggcagcaaaatgtgagatgggcgtttattatgagatacacgaagacagagaccagaggttccccaagtagcccctggacctgcagtgtcagcatcacctggtagcttgttagacatagaaattcttgggctttattccacacataatgaatcagaagcttatggggtggggcctgcagtctgacgtttattttttctaaaactttaagttycagggtacatgtgtaagatgtgcaagtttgttacataggtaatcatctgccacggtggtttgctgcagagatcaacttatcrcctggatatgaagcccagcgtccattagctgttgttgctgatgctcttcccaccacctgcaagccccagtgtgtgttatccgcctccaccgtgtgtccatgtgttctcatcatgcagctcccacttataaacgagagcatgcagtgtttggttttcagtttctgcataagtttgcctaggataacggcttccagctccatccatgtccctgcagaggacatgatctctttcctttttatgattatataatattccatggtatatatgtaccatattttcttcatcctatcatttatgagcatttggagtgattccgtgtccttgctattgtgaaataccatttgacccagcaatcccattactgggtatgtaaccaaaggaatagaaatgattgtattataaaggtacatgcacatgtatgttgaytgcagcagttttcacagtagaaaagacatggaattcacccaatccgaattttaacaagtcttccatgtgattctgagacagactcatgttcgtgtggttctggctctgcagaactgaggtgggccccaaaacttgmgtttctaaaaggtactagctgagcatgatgactcacatttgtaatcccaccactttgtgaggccgaggcsggtggatcgcttgaggccaggagtttgagaccagccttgccaacatggtgaaactccatctctactaaaaatataaaaatttgccgggtgtagtggtgcacacctgtagtcccagctatttggaaggctggggcaggagaatcgcttgaacctgggaggcagatgttgcagtgagccgagatcaggccactgcactccaacctgggtgacagagccagagtctgtctcaaaaaacgaaaaacaaaaaaaaccaaaagactaaatgtataaaaggtacccaggtgatgttgatgctacttgtcttggccaatgaaatgaaaagcctacaggccaggcatggtggctcatgcctgtgatccacaactttgggaggctgaggcaggcagatcacctgaagtcaagaattcaaaaccagcctgaccaacatggtgaaaccccatccctactaaaaatacaaaaataacaccaaaaaaaaaaaaaaaccacaacaaattagccaggtgtggtgatgtggcctatagtcccagctatttgggaggctgaggcaggagaatctcttgaatccaggaggtgaacgttgcagtgagccaagatctcaccactgcactctagcctgaacttcagagagagactatgtctcaaaaaaaaaaaaaaaaaaaaaagcctacagttgacaggcagataacagagggagcaaaggagtcttgtggaagacaatagggagtgttgaggacctgtcaaacaacacagtccccatctgtactttgggagggaaggacttcttaattccagctgcctgttgccatgggggaacatagacccagaactgccatcytttctaatttttttaaaaattaaaaggctaaaagttttggcttataaaaatggtatttcctgagtttttacaattatagtattaagatattcctaggtttttgtttgttttcgagacgaagtttcgctctcatttcccaggatggagtgcagtggtgcaatctcctccgcctcccagtttaagccattctcctgcctcagcctcctragtagctgggattacaggcgcccgccaccatgcccggctaattttttgtattttttagtacagacggggtttcagcatgttggccaggctggtctcaaactcctgacctcacgtgatccacccgccttggcctcctaaagggttgggattacaggtgtcagctagtgcacctgaccctaggataatcttaattttaagtaactggtaactcataaatttttaaacactctgcagttcaaagaaaacatgtttgtggtaggtagycagtttataacctgtgtaagactgtgttattagcaaatccctcaatgtgttgaccaagagtgggtaggaatcctgcagacagaatcttttgaaggtggtttgtttttttattcctttataagtacwgttgtagatttacaaagtaattgagtatatagtacataaggtcttgtgtacccaccgatcgcaattgagcatatagtacatgctgtcctgtgtacccactgatccctggtcctgcccctggtatgagggtattaacatyttgcattagtgtggcacatttgctacaattaataaaccaatatcgatacattattaactagtctatagtttacatgaggggctgctgcttgtgttgtacattctataggtttgttcaatgcataatgacaggtgtctgtcatttcattatggagtgaaaccattccaatttcatacagcgtagtttcacgcctctaaaagtcccctgaaagtgttattaaaagtactatctggccatgtcctcatttccccagcaaagtccttctgagaatttaggcgctttaggctagaggatctcagtgctcagaatgaaatatccctgtactccaagatgcctccagcaattataattgaatcttgaagctagagtttcttggctatcctatttcccttttgtttccaccatgaagaagtggagagccgtgtgacstcagtggtagagctgatgtagaagcgccctctctgttcctggcagtgcctgtcctgctaacctcgtgtctcttgctggggtcttcatcagtaagagacctcacaagatgctttatcaggtcacttggcaaccaagctgatgaggatagcagtttcttttgttcttttaaaacatatataaaattatttttatcaaacatgacagatcaaaagccttctggaaaggagagatggtaactaatttaggcagtgtcttttgctttcacatggtgtacccagtactattaatatgaatttatcacatggaaacaaacttttaaaaaaattaattttgtgaattaaataaagcagcatgcaaatttactatcgtattcagcaaccaaaattttatcacttgcctgatactgcctagtgagcaggtggaaatgtagacacccaaacacccttcatggattcccagctgctgagagtttgaatagtatgtgaagtctgtagagacaaaattgttgttttccccagttgtaaagtgtgcaatattatccttgcaaaattgtctgtttattttttttgcccttttgggggacaaaatgtctttatgttaaattgttttattattgttatctttatggagttaagggcacataaaatattcttacagagagarattctgtagtttccacaagtaaccagagaattgttcatggcagagaattattttttcaatgcctattttctcctgaattttctgacggagttagagataggaaaataccataatctgctataaattcagttgaaaaatagaaatagtgagaaatccaggttgtgctctgtcgtaatttaagcctaatatgtgattgtctacatgtttacaagttaccgcctttttatttcttctctttttctgttttcttcttccatttttatgttttgctatgccattcattcattctattcttttcatttctttttctttttgtaaaaattgtacagagtttaaarttagtcaggtatgtctattaaatttttacgtaaaaagttaaagcagccctcagcatcaacttyttcttcatttctaactcatttagtgaattcagttggtctttatatatgtagctttaagtaattgcatgtaaactgttacttcttcattttctagtcttagatattatctgtaggtttttcaataagaaggaaatttagcttccttctactttggtgccccatgatgatgtgcatcttttttatttctgcatcatatccatatagtgatatcatgtataatgatgtttaagaagacagttwtttttgtttaaattgttataaataagtaagtgtatgcaccactatgccatgtagcatatcaagattatttttctttcctgcaccttatwttttccctggagttaatactcatctttttttagaaatttgctgagtttgtgatgtacctatcattcaacctcaaactttcatgtgattgtctaaatctcagttccttttattagaaaaaaaaaaaaaaacaactcccctggagcctttgtaccttctgyagtttggggttgttgtcctttttgcttggtgcacaggaatacttggtgatgttctttttaaaactgccctcacattgtatcctggaaagttcatttacctgtacccggagttggaacttctcttccacatcttttcctgtattggtttggttattgttttgtgggagcatgtcttgtagtagctttctgaaaaaggatgatagaatatgtgtgtgtgtctgtgtgtgtgtatttcaggtttcaaaatgtttctgttccatcctcattttattcattgttagggatagaattacagatttaaaatcaattttgcttcagagttttaaattctattttgtggctttctgtgttgttctcgggaagtacaaacccttgtgaccgctgttctctttcatttctatctgcttctctcttgggagtacaatgggaggcatatcatcaaccccttgctgctatccaaataggagactgttccctttcaagagaattttaggtattcagatcctagacctcccagatggcctcataagtatttttatcctctatttatctttgtctttgtgttactttcagggatagttcttctagtctttccatggnnnnnnnnnnnnnnnnnnnnnnntttccatggatgatgttactcttttaactctctgatgttaatgataaattgttttaatttttcttttctgtttagtttctatcttctcaaaattgttttcatttgttttggtaattgtgtttgatgatagtctttttttttttttgagatggagtcttactgtgtcacctaggctggagtgcagtggtgtgatcctgcctaactgcaacctccacctcccaggttcaagtgactgtcctgccttagcctcccaagtcgctgggactacatgtgcgtgtcaccaagccgaactaatttatttttattttttgtatttttagtagagatgaagtgtttaccctgttggccaggctggtcatgaactcctgacctcaggtgatctgcccatctcagcctcccaatgtgctaggattacaggcatgaaccaccacacctagcctcttgataaagtctttccccaaatgttctgatctgtggatgtctgtttctatctaagtagaattcaaagttactgctgccaactcttagcacatggccacggccagttaactgtggactcctctgaaggatgatctggctggactattttttgggaaaaccactgtgtttgaatgtttgcatgtgtcctgttggcagaacaaatatcccacagaaggatcttcttatcttctgcttggggaaggtgtagctctgactgctagagttctagagccaagtgagggggagagttctgagtctctgcattcagtaggtaaacatttacaaagtctgtgttttcagtatcatgccactgttctcacctgtttatgttctcttctgataataaacttctgtcatttttctggagttatgaaatgatggtatcctgctgggctgagtggggagggattctcaagctgtacatagctgacacacaggtttctaaaaggttgtctttcacccccattttcagaagtaccaggttccacattttctgagcctttgctggctctctgataggaattgtgttacttctcagctgtccccatggctagcttaagactcagctctcttaagtcacttcctagttgtccatctgctttccagcatccaactgtaattttttttttttttaagagaaatgaagtctcattttgtttcccaggctggtctcactgtaattcctgggctcaagttacctctcaccttggcctcccaaactgctgggattataggcatgaatcgctgtgcctggcctcaactttaaatttttatattgaataatctttgatttgtattgtcatgttgttttatagcagttactgctgttttagtgtgatttgggatgaaaattttaaaaaatcaatatgtataatccaccatctttgttccttttatttttatgttactcattcttttaagcttgtcttagacgtgagtattatgttttattttgctgggagaacaatttgggaaaatttgagcagcaaaccataagtttcttggtgtctgtgtacttggagctctgaatcactattgtcactgagggagtggacaggaagtgatgctgagataagtctagatgggataggtgggcaacatgcaggagaaacctcctgggaaaggtgagcaagagcacacaggtgagacatagcatcgagtgtggaaacctccatgggtggcaggtcagtgttgctgagggatgtggacatgtctgaggccaaatagatgagtccctattgggttttgcctctccacaatctagaggaatatttatggaaggttaacagggcatggtggtgcacacctgtaattctagcacattgggaggctgaggtgagaggattgcttgtcttacaggagttgaagactagccttggcaacatagcaagacctcatctctacttggaaaaaaaaaattagctgggcatggtggtgctcacctatagtaccaggtacttcggaggctgaggcagcagaatggcttgagcctgggagatcaaggctacagtgagctgcaattgtgccactgcactctaatttaggcagcagaatgagactatgtctcaagaaaatgttcaagaagaaatacaaactattgaaaaaggaaggctgaatgctttatcagaaaactgtatttagaggggacctttctggggtcttttagtcagggtacataagtgtcagctgctacgacaaacaacttgcaacgtctcattatcttcatacaacaaacgctgatttgttcctttcattacatayccagtgtgagttggctggaaggtccaccctacacaaccactcgtgaaggcagacttgaaggggactccactgtcttggagctacactctaaaacaaatagcctccaaagtcaaggactctgtaacaggatgaagcagcattttttatgggcaggtttgcacgtggcatttgttgcttccatcaacattccactggcgagagtgagtccctggcccctatgtaattatgagggaggctgagatgtgagaagcacatgggtgttgggagagcactaaaggtctctagcccagaagcatgacttccagccaagtgagacagggaagsccagaaaaatgtgtcacagaacttatggcatcagaatctgattcccaggcatgctttccaccatatgcatagacatttgcaccccagggatagcaccattactcccaaaaattgcaggtttgaaagggtacctaaaaacaagccaccagattgtcccattccactrtcattctgccatcaacaccgaggtgtcggagtagcagkagagccacatatttcttagtgaggggacccagaatgatcccttttgtgctagaggatctgagttcatttcatgaaactgaagcatcttcttggagmtataagctcaccttgggatrggcccttgcagatgacaataaaggtattttggcacataaaaaaactgctcagcacaccttgtatttgtatttcctttgacgtgaaccatggccatccagtaggccacgcaacattcccactgccatgttggcttgtttttcttttgttttcttgtcaacataagcctcatgagacaacagcaggatgcaagattgtacaatgrcaccatgactctgytttctgggtgtcctctgtgggctctcagcagtgtccccgatgtggagggtcttcttaytctgtgtgtgtgccctctgctgttgaaagttgcctgtcacccatgatgctgtgctgattgagcaaactaatccataacccaccgccacgttcctcgcctacttgcttctaggcacattaaacggtcagtgcacaggtcctcatttttctcatgcttccatttccatattctcaatcaatcactgatggccagctgtcaacaggcaycatttttggtgggacctgaagatgtatatcccttgttttcagattcctcgcctctcatcatgtaaggtgatgctctgagctgggtcttaaagcttctgggcacagccccccttgagtcttcattatggcaaatctagtgcaggtgctgagaggcggtaactctttaaagggacaggatatggaaacgtggcttcatggacagtattttagtatatttctgtaaatagcacatgtgctagatagcagatttgtgtatggatatgcacccggctagggacctctttaatggtcattcatttgggagatgacctttggttcctaaactggtggacataccaaggactaaaggagtgacttgytctcagttctttgtcattcagctgctttaatattaatatgacacccgttttgggcttgaaaagttttccttctgctgagaaatgatgatggtgacaatgatgacaatgacgatgacccttggttggagcaatgtagtctaaatgtggttgcatcatcttctttcttcctttgccttcctcccttgctctttttctgcccctcatgccggctccttcctcccacatcaccccacatttttttttctttctcctcaccatcaagaaatgttccagaatgccattattcttcgtcaccacggtcaggtatatcatcctaagggcagagggtgaaggtgcgtaattagtgtttcaccagactgagcatcatcctcggtgcaggggagaatggctggtatttatgagtgaatggcagcgttttgacaggatgatgaataaatatgctgggcccagaggactccaggtgataagcatttctttgtggtctggtaagtgatagcacccattgcttaatttctctaaaatctgcatttgtcaattttgtatttttttatttgaaaggtatttgcttaaataaataggccatataaatctagctcccaatgtccattttcaaatgatttccagcaaggaagatggaattaccacgaggaacctgttctcttatgtttctgcttagatggctgggtctataccagggtttatttaaatgaacacaggaaatgccattcacctttaccatgaatgggaatctttgcctgtgactctatcgtgtgaattagcagagcttggctattattcccctacttcggtagatactggctgtacagaagggaaccccagtttcaatgagtacctatgtgctgggcacttagctggtttttacacacatacttcatttgaagggaaggaattgactgaaaagaattctccattccaacttcccaagtcagttgccatttggccctgataaagctgtactttctcacttgttccttatttaaaatagagaaaagtgcatcaagctcttgttaatctgtcaggccttcctaagatgtctgaagaagttagtttggtgaacatgggcttcagggtcagactgcttgtgttccattcttgatcctatcacttccttgctgcgggaactctggaaagtcacttaacctctctgagcaagcttccatttttccaggtgaaaacgggagtttagcctagtccccacttgataagatggttgtggaaagtattgtgcgtcatggacctaaagtacctaggagattggcctggatgtcgttttctcataaagttgactatggctattggtggtactagtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaggtgttggagaccagcctgagccccatggcaaaaccccaaaaaaaaaaaaaaaaaaaaaaaaaaaaattttagtcgggtgtaatggcacacctgtagtcccatctactcgggaggctgaggtgggaagtttgactgaacctgggaagtcaaggctacagtgagctgtgatcctgtctctacacctcagtctgggtggcagagcaagaccctgtctcaaaaaaaaaaaaaaaaaaaaaaaagtaaaataawgcatgggaagtcccttatacagtttgtgatatgggtacacactcagtgaaatggccattaatactgctgttcttaactctgaaarcagagtgggccatttgaatgctcactttgatattttttaaaggaaaaatttgaggcattgacacatgccttttgcttactygcttggattggtttgatcaactttgttgcggtctaatttatgtawaataaattgcatccatttaaatatacaattcaatgagttttgacagatgcacatgcccatgaaaccaacacgaaaataaaaaaaawagaacatttacgtcacctcaaaaagatttcaaatgccacttctgtggtgtatgactctgagtccagacagcctcagctccaggaaaaccctggtctgttttctgtcactattgatgaatttgcattttctagaattttagataagtgaagttttctagtacttgttctgcatctggtttctttcattccacataattaccttgggatgtacccatactgctgcctgtatcagtggcttactcattgtcattggtgagtagtactccattgtgtggagaaatcacattgttttaaaaatacctaattacctgctgatagacatttgggttcttcccagtttttagctgttgtaaatggatactaatgtgaacgaagccaccgtgaatattgatgcactagtctttgtgtggacatatatctgttttatcttgggggataatactctggaatggaatgggcaagggtggtccgtatagggctatgtataactttttaagaggttggcaaatacttccctaaagtggtcatcccattttacattcttgccaacagtgtttaaggatccacttcctctacatccttaataatacttgatattatcggtcttctaaattttctgtttgggtacatagtggtattttgttgtatatttttttttaattgtgaaatatgtgactatgatgagtaatgattttgaacatgaaaactatgcttattgctcatatctatgttattttattatttactttttttgagatggagtctcgttctgttgcccagtctggagagcagtggtgtgatcttggtttactgcaacctctgcctactgggttcaagcgattttcctgcctcagtctcttgagtagctggtgttacagaagcctgctaccatgcctggctaatttttgtgttgttttatttttattttatttttttagcagagacagggtttcaccatgttgaccaggctggtttcaactcctgacctcaggtgatctgcctgcctcggcctcccaaagtgctgggattacaggtgtgagccacagcgcccggtggtcatatctctttcttgggtttttgtgggggttggggtaataggtttattgagatataattcatataccacacagtttcatttttagtgtattgacaggtgtgcagtcatcgtcacaatcaagccatagcttcttttaaactttgtcttccttctctttctaattatctccttcccccgccccctccattctctttccatcctttaaatgtcagtgtcccccacaattctgttgttgaccctttctccctctggccaatgctccttcccctgtagatcatacccattcccaagatttcagtcatcaaatccattccaatatgactcctgtatccatatgtccagttccaagtatctgtccatggtgttggtcccakgttattcgcacctcatatgtctttggcacagcactcttgacagctcataaagtcacgctgttacccccacaatgtccccccacatatcattgctatccctcctcgacacccacacctcytgcatgttcctgagcttcttaggcgtgttgcatcttcctgaccttcccagtccgaagcccaaggagatacttgataaatattcgtctaataaataaatgaacttgtgttctccatattccttgaaaatatgcttcacttttatctttttaagaaattaattgcattactatcttattaaaggtcaagaaaaataattcatatcactcactattcatgagactgctaaatagttgccctggcaatttctgattataattttagaaatatttctaacctctggccttttttcttatctctacttaaagcttttctggaaggaattcattttccactttccttaatgttccttaaatgttstacatatcttaaaagtggattcctcataaaacaatatggactatggtcttattctstttaacggtatgaaagctcgcctgaaaggccaagagtaagattcttttaaaatcatgcccaagttttaaaggaatataaaactttctctttaaaaatatacctttctgctttcatcccytaacccacaaagctcaagtctagtttaattcaaacttggaaatagttcttttattattgctccctgcaatgggaacagagctgaggctcctaaggtctagagtcaacatgaaaatacctttgcttctgggccatagctgtgtttcttcttaacaaggcagaagccyagaagagacttcatgtactgtgactgtaataaagagggttgtaagtagagaagctggaatttgaaaggttacgtacaagtcaagctgcctctgtaatgtcacttatatccaggaaagagtggcaaagaaccatcccagcagatagcttgagggtgggaagggggataggttgttgataatatggaataggaggaaaaagatcatagagccaaagagctcgatacatatactgatgcggtgtttattttattttagttttttgagacagggtctctgtcgctcaggctggattgagtgcagtgaatcttggctcactgtagcttctgcctcttgagctcaggcaatcctcctgcctcagccccaccagtagctgggactagaggcacatgccactacacccagttaattactacattttctgtagagacgggctttccccatgttgcccaggctggtctctaactcctgagctcaagagatccacccgcctctgcctcccaaagtgctaggattacaggtgtcagccacagtgccatgccctgatgtgatgcttaaattcagaaattgggaaggagggtcaggtagctataagcaaaayacaagagaaatataagagaaagaaagacttgtatctgttgttagtgagtttttgtggtgrtgatacattaatggaggcaacagagggtcagaaatcagggaaatcagggtggaaaatagcccagcagaggggaaaagaggaagtctgaacgagggccacattgcagatagaggcyggtgtactggtctgctcaggctgccataacaaaataccacaggctggatgacttgaacaacaaaaatacattttctcatagttgtggagcctagaattccaaggtcaaggtgccggcacagttgatgtcttctgaggtctccctcgtctgcttgcagacagccgccttcccaccgtgttctcacgtgacctagccgctgtgtgcatgcatccctggtttcttttcctgtgttcagatgtcctcttctttgaaggacaccactcagtattgcaataggacctgccctgatagcctcattttttacataatcacctctttataggccgtacctccaaatacagtcacattctgaggtagtacgggttaggtcttcagcatatgaattttggggaaacagaatccagctaacaacagttggggatgaggctataacgaataccactgcctaatgtttgcacggggatatcatgcttttcagagaccatctgcatccttatctcacttaatccttgccccaccctttagaagaagccaggaggaggtcctagtcagctgatgtgagattacatggccctgactgtcttgcctggtgctgcaggccaccttcacagccttgccataccttttcccatttatccatggattggtatgagccctaatggtgcacccttccgacaatccttcatccttcccagacgtttcatcagccaagtgaaatttgcaattgtttcagtgattgaaattatgcttggagtgcaggtgtcatggatgaaacagcaatgccttgcggtgacaaattcagtgtagaaataattttagcaagcccagtgattggaaaacaatgactcaactttaagctatattgattttgtatttctgggctcagcttttgactcagtctcattccccagaaataatccctgttaacatttcggtttgtgttatggaagtgttttctcttctatgaattagctaatgcccataccatacatatgcctgcatttgtacactcttaagccaaataacatcgtactgtgtattattctctagtagcctgctttttattgaacttaatgataaatggcaaacatttgaccatgtcacttaagtttcttaccgtgatctccaacagctaggcaatattctgtcatatgggtttaccatacttttctcaatccacaatctcatcagagtcccaatagttgcctgatatgtctccatcagttgtgaggtatgtttcaaatgatttattactagaaattcttagcgagctgaagtttgtaaattttctcaagctactttattgatatataacacagatacataaactttgcccattcaaaatgtacaattcagtgctttcagtatattcagagagttttgcagctgtcaccacagtcaagtttagaatattttcattttcccaaaaagaaacccttgactggcatccttttccccacttccttttctctccactcccaacctctctcccagctccaggtaaccactcatctactttctgtctctatatagatttgcctattctagacttttcatataaataaatcagatactgtgtggccctttgtgtctygatccttacacttagcatcatgttttcaagggtcattcatgttgtagcatgtatcagtacttctttttttagggctgagtaatattccatttacggatatgccacatttcatctatgcattcagttcayggacatgtgggttgtttccacattttggctattgtgcataatgcttccaggtacacttgtctacacatttttgtgtggatataggttttccttttttggggtatgctcctaagagtgcaatttctggatcacggggaactccttgtttaaccttttgaggagccaccagattgttctccacagcagccacacccatctacattctaaccagcagtgtaggaaggttccgatttctccatatcttcaccagcactcgctgtcatttttctttttagtcttgtcattttattgggtatgaagcggtattgcattgtgattttgatttggattttcttgatggcttaggatattgaacatctcttcatatgattattggatggatgatttttttcagcggttatcaggtcacacctgtaatcatgcccacctcattttcttacagtgcagtgtgtgcttttaggcacataccaagagcttacagagatccttctggttcagaggaaagattcacatccccaacaaacactgctccccgattacaatatagagaggctaaattatagtccatatcacttttcctttaaatccctttacttttttgtgctacaagagtttcagaataataattcygcagaaaaaagtactgattgtccagcagttgtgtcaggtagaaaactgggatgcccgactgcattggtttagccagaactgtggccatgaaaccttgcctggcccccagggatggggtgaggggggatatcatatatgctttaggtggggcagaggggtggtctgcccctgtgcaggcaggaatgttcaggaagcaggctgcctctgtttctactctaaatatttaacattcacggatggcatggatcctgactaagcggagcagatgctggctctatattgcacatagctcctgaatatcagccctgcttggctatgcatgtgttttttgttagtttttgagacagagtctcggtctcttgcccaggctggaatgcagtggcacgatgttggctcactgcaaaccctgcctcccaggttcaagcgattctcctctcccagcctcccgagtctctgggattacagacgtgyatcaccaggcccagctaatttttatatttttactcgagacgtagtttcrccatgttggccaggctggtctcaaactcgtgaccttaggtgatatgcgcccctcagcctcccaaagtgctgggattataggcatgagccaccacgcccagcagtatgtttgtttttcttcaaacctagatcaagagtcaaacactcaaatgtttggtgggagcagttgatgatccagagctttggagtcagcgagacagtagagagtggtggagatggtggcgcacaagagggtcagtgccccatctcaaggaacagctgcacctcrgcctaygcgattgtgaaaatgtgagcatatgcaggccagaccttggcttctctgtcttcatttttcacaggagccagaagtttggatgtgcaatgtgaaatctcacaaattaaacatgttacataactgtattttgtttcctatctctgctgtaataaattttctcawtgttagtgacttagaaccacacaaaagttacactttacagttttggaggtcagtggtccaaaataggtctcagtgggctaaaatcgatgtgtcagcaggacaccatttytttctgtaggttctagaagagaacccacttccttgctgtttccagcttccagggactgcccaaatcctttggctcatggccccttcctctatcttcaaagccagggatggctgctcaagtccttctcaaactgccctgttcctggttctctctcttctkcttctgcttttaaggaaccttgtaacttcagggagtctaccctgataatctgsgataatctgcctrtttgaaggtcagccaattagcaatcttaatgccatctacaaccttaattaccatttgctatgtaacatatttatagatatcagggattagttcatgaacatmttggggtagagggcattccacatacagcagtacctataatgtatatgcttcttaaagaatgcatgagtcttatttattttatgtccttggagtgtatagcagagttagatagatctttctggattggcggttgattgaatattggctgtacaaagaaactggttaggagtatagagaaaagatcaatcatagcactagcttatagtttattttattctttaatgattttttaaaaatatttctctcacttacttgaaaagcagtcttagaaattaactggaatgggtaatttatttgtctttcttcttttgtaaaataatggcagtttgtaactcagatttttgtatgaggaataaataaaatactgtctgttttcctttgatctttctatttgtggtccagccagccagctaactatgcattcctttttctgccttttcatcataacacctatcttagcaactcttcattgctgctttgcaaagaggatttgagattgtttatgtaggggcccgtgtataatacctcaagagaaaaagacacagatgaggctattgggattaagggaaaatcaagtaaatcgagaggtaaagcactgtgcagaaatattggccagaagctatgaacagttgccacagctgggctgaagagttacctgtgagccttccaggggtgtaagccaagagaaagacagttcaccaaatctatcgattaatagaaatcatccagcagcagtgccactgtaagatgttcaatacgtagcacctttctgtcccttctcctctagccagttgggacaggattagcaagccaaagactttctgaaataatccttagctatattcttggtattcaccaaggaatttaccaatatgcaaagacttggggataattagtattatctttgccattacctgcagtaatattatgaagattagagatgtaactctgtcctgaagaactgcagtctgtggctcaccttggagaagaacttaagaacttattgaagtgagcaggctcacctgcctttgctcagagccacatcacctgcaggcaggatctgcaaggtcagcagttagcgtcaagttgcacagcctgggcttgggtggcgttcgctttacccttgcccttgatgtggtgccgagttgtcaggattctcgtaaaattcctgggtgatggcttcttctgttctctttatttccttaactgaacatctgtctaattgttcacctccatcgctttagtgctttcctcatgctttctctctttccagacaataaactttattttcttcataagaattcagtctacgcaagggtattaggcagcttgtttgcaccttttaattgctggatgttttccagaaaggctgtttgcagtagttccagtgggttcatctgtgaatcaggaaagacaatgcagctttgtgttttggtttttatcagttaccttctgtttgtaaacatctgtttggaaacgtttgctggtgcccaccccagcacccctccacccctgccagaaataaagggattaatctctttttgcttggcatagggagaagacagtgtctgctgatgtgcttaactttttttttttttttttttttggtcaggtgcgtaggtatgtgactgaaacccatagactttgcacatattgtcaaatgactttccagagggactcaggcactttatttaattaatgccaatgaagcccgttaatccgctcattactgcagtttaattttgatgctggtttttgatgatgtattgaaaacttgtataaactggcaattacaactggaaaacatttctagtttagaagagacccttatttttcatatgcttaggaatatccagcaagccacttttaaaggctttttatcacattttattcttaagctttctgaattccttattatattttgcctgataaatagttggattttgttttttggttcaatgtaagaatattcttaaactaggtaaactgttttaattgtttgtcattatgttctctcattctgttaaattttgttttctatttttcatgtttttgggtttttctagatggcctgtctttaacacttcttgatatttttgattaaattttcatatatcatcaaaaatagagatgacagccaggggtggtggtgcatgcctataatcccaacacttttggaggccaaggtgaggagaccacctgaggtcaggaattcaagactactgggcaacatggtraagctctstctatcctaaaaatgcaaaaattagccgggagtggtggtgcatgtctgtagtcacagctacttgggaggctgaggcaggcgaactgcttgaacctgggaggtggaggttgcagtgagctgagatggagccactgcactccagcctrggtcacagagggagactctgtctcaaaagaaaagaaaagtagagaggatagtataatgaggttcctgtctgccagtcactctatagtaactattaggaaacccctttttttctctgaagtcattgctccggtgtgtgtgtgtctgtatataaaaaaaagtatgtatacatayacgtatatgtatgtgtatagataaaaatgcatgtatggtgctgggcgcagtggctcacgcytgtaatcccagcactttgggaggctgaggcgggcgaatcacgaggtcaggagatcgagaccatcctggctaacacggygaaaccgtgtctctactaaaagtacaaaaaattagcctggcgtggtggcgggcacctgtagtcccagctactcgggaggctgagaccsaagaattacttgatgaaacatggcagacgacatagaccagcagcaaactaccaacactgtggaggaccycctggatcttaggctcagcccagaggagcgaatttgtgtgaaaatgagaaacgaccgagagcttcgaggcagattacatacttatgatcaacatttaaatatgatcttgggagacgtggaagaaactgtgactactatagaaattgatgaggaaacatatgaagagacatatgaatcaacaaaacagaatattccagtgttctttctccggggagatggcattttcctggttscccctccactgagagttggctgaaacaaagaatttgtcctgtatggaaaacaggagactttgtacagtggcctctctaaatgtgcaagatattcaaaagagaaacccgcatacatttggatattaagaaataattctggggattcttccactcctgaaatgagttgatttgcagataattcacaacttcttaagctaaatggtattttcgtttttctcaagctcttccaataaatatgaccaccaagatttttttttcctaaaaaaaaaaaaaaaaaaaaaagaagaatcgcttgaacccgggaggtggagcagtgagccaaggtcatgccactgcactccagcttgggcaacagagcgagactctgtctcaaaataaataaataaaaatgcatatatgtatatttgtgtgaatcatatacacatatataaaatatatgtatcatatacatatatatcacatttctttttctagtgtgtgtgtaccttgatttatgtctcacatattcaaaataactcaacttgtttaaaataagagcacaacctatttaagtagtaaagattcaaagccttcttctaaaatgcttaactttcctgtggatttgtggacccgtgggaaaatctcagtccccaggcaggaaggaaggagatatgacacatctctagtttgttgtaagtcgcctaccctagacctcatctccagtgctctgaatgtggagaggtaggtgcagggcagtgggatagagaggtgcactttgaaagactatcacatggaaacaaaagttccggctgggcacggtggctcacgcctgtaatccaagcactttgggaggccaaggcgagtggatcacgaggtcagcagttgaagaccagcctggccagcatggtgaaaccccgtctctactaaaaatagaaaaaattagccgggcatagtrgcatgagcctgtaatcccagcgactcgggaggctgargcaggagaatttctkgaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacctttgcctcartactactggcatttgctgacatccatttatcaagatacagggatggatttctagaaggcccaggcaggggtgctggccaggagacaccaggcatagaccttcctttctcagagccttcgtggcccctagtttgaatctttgagtcactgcagtaaagttcctgatgtttgasagtactccttatgaagggagtcatatgagttgctagctgggttctctggatggtggtgtcatgccaacatgggagccactagcacaaagaacatgctaggttctgttgagacctgactttgggaatagcataggtacttatctttctcagcaccacacaaacacactccagaatgcaaaggaacctgcactgtgccatcttgcttctccctgcatagccacttctctttccagtggtgtttgtattttggttcattcaatcaatgaatgattgattgaatcaaccacttggtcccttcaatctgtaaccttcctgcaacactgtctttgtgatgttatcataaccttgatttttgagggatagaattgggcataatcagagaaaacgtggtctgggacacatttgtgggctattctatgctaaacatttccatatcattaatgttcaacacagctttgtggtgttggagataggattatcattgttaggatggttattatcaatactagctgtgattattgatcacttccacatgccaggcacagtgctgggtgctacatatttattacctaatttatagcttgctgcactcttgctgggtatgtgtaattattcccatttcacccgatccctgggagtttggtgaattaatcacccagcatccaaatagctaaccggtagcagagctgggattcaaactcagttaggctgacttctgtgcctgttttcttgcctaagcggtggacgcattgagtaggagaaggccagttattcctctttgtcactgatacaactggggacctgttgccggagatgtggagctgtgcattagggctgggtagaacacacataatgaaccatatgcacgagaactttttcatctttctgcatacacttggaactagttctttgttattgtaaaagcatcatgcaccaggtaaaatgtttaataacacagagaaatctaattgtcaagtatcttctcaacacacattaatcaacaattctcmtatcgaaggataacctcttgtatttacaaaaaaaagaagaaaaagtgctgtcatcagtaaattcattcatgtatgttatacacttacatacaaaatgtatctatttgattaaattagaactctgctaatgaattactttccttgattgcacagtaataaagtcaatgttgtaaatataataattatagccaagtgcagtggcttacacctgtaatcccggcactttgggaggctgaggtgggcagatcacttgaggtcaggagtttgagaccagcctggccaacatggtgaaaccctgtctctactaaaaatacaaaaattatctgggtgtggtggcacatgcctgtaatcccagctactcaggaagctgaggactgagaatcgcttgaacctgggaagtggagtatgcagtgagccgagatagttctactgcactccagcctgagcaacagagcaagactccgtgtcaaaaaataaataatatatgtgtgtgtgtgtgtatgtacatgaattatatacaaatgagggaaaatatacaaatgagttgaatatatacaaatgagggaaaaattgttccttgtgtcaggaacaattactgtgaattttgtgtagcttttcctgactttttaaaattcaaatatatttcataaagttgaaatcacactgtggtctttttttttttttttttttttttaaccaaacatatagtggccatgtttctatgtcaatacatactgtttggcagtacagttgtactgacttgacattatagcttcataacttagtaaattaatcccttattgctgggcacagattctgttttccattttttcagtcatgagcaacgttgctggtttacctggggctaaataagaagtttaaatgcaaatagataattcttgagaaagcttcttccctgtatatactctttctgcagcagtgtctgagtgtctgtaccttcctataccttcaccatatcatgtatttgtcattttatagtgagttgtattacttgctaggtgagctggtatctcctttgataacacaaagaaggcctgggtttgcttggcaatttgttccaatattcttttcagttttaaataagttttgaacaaaaagttttagcattttacataaaaacctctaaagctctcaggctaattagtaatgtagcatatacaaattaagtttttttctgctgtgcttaattcttattaacacactaatcatgagagcccccaaattgctgtaaggagcacatttagaaaacatataaaggatcgatagttggtacttaagaaatcgttgaaacaccttttcttttttaatctatcttagagctgaaagataaaaagacttaaaatgagttagaatatgagtttttcagcatcttatagcttatgagttaaagcaagatttaaaaaatacatttaacatactaaatatttcaaaagctacagagataccgtaacatttaaaaaaataaattttcattgtggaaatcaactgccacaaaaacacaaccttttacgagacaacgtgatgtrcatgagaagccctgatgttgagaagctcataattcggtgtgagaaacacacaaggcatgatgccattcccatctgggatgaacagggaagacttcctgggagaggtgactatggacttaattttgctttgacacagcaaaaacatgaggaatgaattttgtgacttggaagattgttagttttctgtggagggaacaacactcatcttgcaaatttgccttcactattcaatcattagaaaataattttaaatgagcttagcagttctcagaattttggatttcaggaaacaaactttttaaaaacaaaacaaaaaggaggataccaatttaagcttgtcaaaaagattttcccccaaaagaaaaacacattaaaaacaacgacaaaaatcaacaaaaactaacactrttcccccatcaacaatcaatattactttctaaaagcaagggcgttttgacaccagatattgtgaggacatccacctgctctaagggacagccatttcactggtgttctgtcaatttttattttgaactaattttagactcacatagaagttggagaagtaggctgggcaccagtggctcatgcctgtaatcccagcactttgggaggccgaagcgggctgatcccttgaggccaggagttcaagaccagcctggtcaaatagtgaaatcctgtctctactaaaaatacaaaaattagcctggcatggcagcgcacacctgtaatcccagatacttgggaggctgagacatgagaatcacttgaagctgggagctggaggctgcagtgagccaagcggagtgccactgcactccagtctgggcgacagagtgagactctgtctcaaaaaaaaaaaaaaaaaaaaaaaagttgcagaaatagcaatatttaactatacttgttactcaaatttcaccactaaagcagtgtcatctttttattccaggatctagtccaggatgccacattatatttaattgttgtatctccttggtgcctttagtacttttttttttgagacacggtctcactctgtcacccaggctggagcacagtggtacaatcatgggttactgcaacctccacctcctaggctcaagcgatcctcccacctcagtctcctgagtacctgggactatacgcatgcaccaccatgcctggctaatttttgcatttgttttatcaaggcagggtttcatcatgttgcacaggctggttttgagctcctgggctcaagaaatctgcttacctcggcttcccaaagtgctgggattacagacatgagccactgcacctggcttggagcattcagtctttgatagttgcttacttatttccttctttctgatcttgagaccttgatttgtccagtattttctcatcattagctgagtgtaagcattttttggcaagaacattataaaaatgatgtggtrtctttcttagtatattatctcaggtagaacataatgttgatctgtctcatccctggtaatgttaaccttgatcacttggttaaggtgatgtctgctgagtttttccaatgtaatgttattaatttttcctttgaaattcataattatttgaagggagatgttttgagatgatgctggcagcccygttttccttaaactttcacatgctgactttctattgttggatcttgcctgcagcagtgtttaccatgatgcttggctagtggtgactatgtatttcccttactctttttatagtcagtaattggaattcttctgaagaaagagctatcccttctcccccatttctttcttttcttttctttttgttgagacaaagtttcactcttgtcgcccaggctggagtgtaatggtgcgatatcggctccctgcaacctctgcctcccgtgttcaggcgattctcccgtctcagcctcccaaggagctgggattacaggtccatgccaccatgcccagctaatttttatatttttagtagagatggggtttcaccactttgaccaggctggtctcaaactcctcttctctggtgatcctcccacctcggactcccaaaagtgctgggattacaggtgtgagctacagcgcctggcccctcccccgtttatttctgattcaattactttatattagcgtagattcacaggtatttcctttttttttttttttttgatttattaatacctccatttattctgttgctgaaaccattccagctttttctggttggcttctatgaaggacgctattttaatggggtgatttttttcttctcactacattcttgctcactccccactttttatgtccggtggccataggctggtgagaacttgattttgaacagttgaaggtctgctgttagggacgtgctaatctagggaattgtactgaactcgtgggagcatgttagtatcagatgtgtgccttgtccgtcttgcttgtaggaagaacaagagacgagacacagcaaggtgatgatgggtatgtgaagcaggataaagaaaaaaacaggacaggcattacaggcttaagyctgtaatcccagcactttggaaggccaatgcgggtggatcacctgatgataggagttcaagaccagcctcaccaacatggtgaaaccctatccctattaaaaatacaaaaattaacaggcgtggtggcgggcatctgttgttccaggtactcgggaggctgaggcagcagaattgcctgaactcgggaggtggaggtagcagtgagctgagatggcaccactgcactccagcctgggcaatggagcaagactctatctaccmcccaccctgcaaaaaaagaaaagaaaggaaaaaaaatcytggtgcttgtaggagaggcatttatttcttttaggactggacggggcttggagggtttccaggaaacagcctcaacctaaaaatagtagacacagttcatgaagaacttactatgtgtccagtagataaatataccacaagcattatcttctttaatcatctcacaatcttatgaaggagatactaatattttgcttgcaaagatgagggaagtgagtttccgaagttgctaartgcgtaaaggaggtggtggtgtcagaatgttatcctgctcagatggttgcatgggacagtgtccagaggaaggcctctgattccttccccagcattaggcaatattcaagtcttcagttccatgtgtaggggagaagactttccttctgctccctaatgacagtggtacccacacccgtattccaccataaaatcttttttattcagtattaggaaaaaagaaacatctttccgtccagtggtcactgtgtgtgtatgtgtttgtgtgtgtgtgtgtgtatgtgtctgtgtgttcaccgtgctgtgtgaattgtggctttaaatgtattcctgtcaattccatatatttttaaaatgttgcttttagagtatgtgcaagtttggggcatttttgagggcttttttttttgacggggtcttaatatgtcacccaggctgtagtgcagtggcgcgatgacagcccactccagccccaaactcccaagctccagtgattttccttcctcagaccccaaagtagctgggaccacaggtgcacaccaccacttccagctgattatttaaaaaaaattttgtagtgacagtgtcttgctgtgtttcccaggctgttcttgtactcctgggctcaactgatcttcccagcttggcctcccaaagtgctgggaatacaggtgtgagccactgtcccaggccagttttaactcacaatgatttcataagaaatccacatctgagagtcccagaaggtaagatattcccctttcttctaaatatacttgaccaccaccattcaggttcttctattaaccctcctatatttgccaaccctcaacctgttagaaacaagaattgggactctggagtagatgttagcaacatcatgagctcaaacccctccagcttacagcggagacagtgaggtcctgtaggatgaggttggagagcaggaacttgccccgaggtcatgtgcagagttcgaggcagggcctggatgggaagcccagcatggagaccccaggccgtctctccgccatcttgttgtgatgcttccggaagaatgcctgtcactcttgctgacatccgactgaccaagtgggcaagaggaattcttcaaaacaatttaataaatgcttacattttctcttggccccgtgccacatccccccactcagtcttgttttcaaggttgaaggttccttcagagctagtgaccttgcccttcctggcctgtggatgtcgctctctatccgtaaccctcctttccagcgaccctgtttgcagcaaagactataattttattttgggtttggatatactgattacattttagcttctggtatattttcttacctgtcacagccattaaatttattttaatagttactctactctcctgatagccactaaagggggaattggatattgtctatcaattggttggtctctgaactaaggctgtatctaattacaaggcattgtatcggttstgatttattaaccatttacttggctttggagaaggcagcatttttagtagtactgttgagcctgcatgtagcttttccaggagggcagggtgccyggatatctgatcttacagttattactttgtgtcatatataattttgttttctccctgcaacaaataaatctttgggactccggaagaaaaaaaaatgggaaagaaaaaaaaaatttgtggttacagtataataaaaataaactgtttgtcgtgactgcagctgacatttatcagcctgtttgtgggtgatctttctctctctctataatacagaacataatttgtcactttgtaaatacattccagtctaaatccctgccagcatctgttagtgtttgaaggattaatgtgctaccctgtgtatgtctgcacttccagggaacagtgtagcatctgattacagatcktgggagagcaggagggaacaaggtgttttctgtgctttttcctacatgcagtcgttttggcctttttctgatttttcttgtctttatcccattctgtctaggtacctggaatttcattctttacaaagatgttcctggtccccaacctttcttctgtctgtgatagtcacagctgaagtcatagtattttctgtgtactatgggttgagctgtgggtaattctttggggccggttagacttgggttcaaattctttctccaactagtttatgagcttaagttatgtgatttccatttcttcacttgcaaaatgaagatgctaatacctacttcttgaagatgctgaggttgagggaagaaataaatgttaatgcaaagtgcccagtttagtgcctgccaagagtaactggtgggtctgtgtcaccttctgacatkatcagtgtgattgtctccaacgcatcyatggaagtgaaaccgttggaggaagctaatgccgtgagccagctgttggttatgtttttgttttgtttttcttttttacttgctggatagtgggttctgtttattgagaaatatttacatccgtctaawtcaggtgcttgctagggttcttggcacacagagcatcccaccaataaactgtggttcccaacaaggcttgcaactgaatctgggcaacaatgaacatgacttcaataatgacaaaaagattcagattcctgctggaaggtccatatgtgctgtccccagtaggattctggaattccctgaatcatagtgttgcttgtaattctttccacattatgaagtggctctatagactgcctaccaccttgtatctactgctgtcgtttagattaggaacagattgccagatgtggaagaaatagcctcattagtaacttttctgtaagcaatctccttatttcttkttttttgttcttttgttttttgtgtgtgcttctgcgtgcmcctcctctatggctccccccaccaaatttctgtgtcttcatttgcaactctcttttctccagtaaagaggaaagtgtatagttctcctttccttacagaaacattattttgttattgttgtttgggtttgggtttctgaagtataaatgcatatgaactggacagaaggattatgcccatgtgccaggtggccaagatggggcttgtgatttgaagcttcttttcctagattcaggaaagtatcactggttaatcagggaatacatctttcggcccattggaaaatgtctgttcttagcaccctaaatgcccaggtattagcatacttgggaaatgtctagaaacccctatttcaatttactgaccatttttggtaaattcctagagatgccaaaatgcatttcaaaaagctttcatgttcaagaagacttgtggaatgatagaaaacatttaacgctgttatgtacgaagtgaaatactgttaaacttttagattatttaatagaagacacattttacaaggcaaagtgtttagatatgctccctcctatgcctatccacacatccttaactcttcacgttgtttgagactgttaggctgtttttttattgtatatttcatcaaatagtgggtgataaaacaacagacactctaaggaatggcatgacattctcctttcttctcctgcattcattggaacctgaatgtagtattaattataagactgttagacttcaggggactacmctcttattctaaaatagtggtcaactaactgtgcccttcagacagaattcctgcccagcacctggctttgtaattaaagttttactggaacagaggaataccagttaatttatatctcgtctgttgccacttttgctttcatgctattaaagctgagtatttgggagatacttgaaaaatctaaaatgcttmctatctggccctttagagaaaaggttttccaatctctgttctagaggattcgtggtcatttggaaagaaaagtatgttaagacaaaatgagcaggtggttggattagtattttctttctacacatatagaaactgttcctatcatacctgactcagttttcaaactkgcttaatccaaagcctggggggtggatgtaggagagaagttgaaattagctggggttttttttttgtatcacaaaagttacattttttttttttttttttttttttaagacgtagtcttgctctgttgcccaggctggagtgcagtggtgtgatttcggctcacagcaagctctgcctcccaggtttacgccattctcctgcctcagcctcctaagtagctggtactacaggtgcctgccaccacgcccggctaattttttatatttttagtagagacagggtttcaccatgttagccactttggtctcaatctmctgacctcgtgattcaactgcctcgccctcccaaagtgctgggattacaggcgtgagccaccgcacccagccgaaaagttataattttaatggtctaaatcaaatttgttcaacctgcagcctgtgggcacatgtggcccaggacagctttgcagcccaacacaaatgtataaacttgcttaaaacatgatgagatattttttgccattttttttcaactcatcagctatcattagggttagtgtattaataytttatgcacagcccaagataattctttgtccagtgtcacccagggaagccaaaagattggacaccctgggaataaaacagaaaaaaggtgtaaaaggcttcgagttcatggacagaacaacatttttgtaagtaaagtatttacggatgtggcccctttgtaatctcctgggctcagggataatttccaggctggggagaaggttgtgtcatggagacagcagtactgttttggaaggagaattgacttgtcacaatggacggagaactaccatcccatttgggccaacctcttttttttttttctttttgtttcgagatggagtctcgctctgtcaccaggctggagtgcagyggtgcaatctcagctcactgcaacctctgcctcccgagttcaagctattcttctgtctcagcctcctgagtagctgtgattacaggtgcgtgacaccacaccccgctaatttttgtatttttagtggagacgggatttcaccatgttggtcaggctggtgtcaaactcctgatcttaggtgatctgcctgcctcagcctcccaaagtgctgggattacaggtgtgagcctctgtgcccggcttctgccagcttctcattatgatttttgagcagatttcgctgctttttcggcctttgttgtgtttataaactagaagtaattatgtcaactttgtaagggctcagtagcgtagaataaggccatgtctgtaatctccccttctgtgaacagaggttatgttctcaaaagccttcaattaacatgagtggaatggattttctaaatttatatggaggagaaagttgtaggtcctatatgagtgatgacaggtgatacttaagttaactggaacatatggcccttagccacaatttccccacatgcccttctgggggatgctttgtagacctgatatcccagaaaggagtgtggactcataaagtcactgctgtcctttggttttcctgatgtaccaaatgtagtaaggcctcttttcaatgtggtaaaagctctgggccaccccataaggctgcaagcgctagaagctcttcccatagagaacatctatatcctcaaaccaaggagaaaaaggaagctgctgttcataaatattgaagaggcagggagagcttgcactgaggccagggtgtattaacatgcatgccatcgtgaagtggcttctaatggacatttgtaaggtggtgtcccctcccttcccctcccccctctaatgctgcctgggttgctctttgcaacacgtgcagtctgcaacttagctggcttttagcaaaattacccatcgcgattcatttgtcccattgggccatgggataggtgactacagagccagattcgaatgtggccctgtgccggtgcccaaaccagcaggctgcacgtatgcactgacagaatggtacatcccaccactgctctgtgtctgtgtgcgactgtcagctgctctctactgctcctcatagacttcctgtctgcctttttctgcatttctcagtctccccatctccccttcttatctaatccccttccttcctctctcaactcttccttcctctatcctttttctttcccttttttttttaactattcttctttagagtttgttttctcattgaacttgtgatgtacacattaaaggaaaactcattaatgtggaaaattaggagcatcatagctaatgtatgctcagggcttactgtgtgctagacattattctgagtttacacagtgatgtcagatttctcctctgtcacagtaagttccaaaagatagtgaagaatattgcagtgaaaacactgaaactcacatatttcatactcaggggtatcttttaagtgtgaagcaagagaaaaaaacgtggaaaaaaaaagactcaggaaatgctttccatttagctttcttgactaagttagtggaagacttattccagattataaagagaagaaccaaaataaagagtttaagaatgaaggggtatgcagcaactggtagggtcgagtctcctcaggcacaacatgcaaccaaggaggggcagctcactcggcctgcgctggccacacaagtgcacctgccacagtattgaggggctggactgatttctcattaatgtctgggcaaaactcaaagaggcaaacattttcattacatactgttatccatcctattgtgggaccaatttctccagaaaggtctctctcggtgggaggattaataaacaccatcagaaatccaattaaacccaattgttaaaatccaacaaatacgttgcttgtggatacagttgtgtatagtaatgtgtatggtgatggcctatcatataggaatgatagaggcagcacagtgctgtaatggaaaccataagggcacgcacaatggctcatgcctgtaatcccagcactttgggaggcmgaggcgggaggatcacataagaccaggagtttgagaccagcctggccaacatggtgaaaccccatctctactaaaactacaaaaatagccaggtgtcctggtgcatgtctgtaatyccagctacctgggaggctgaagcatcagaatcgcttcagcttgggagctggagcttgcagccagccaagatcacaccactgctctctatcctgggagacagagcaagactgtctccaaaaaaaaaaaaaaaaaaaaaaagggcatggatctagatgccagacaatctgggtgcatatctttgctccaaaagcaaagattgtaaactgtctttacaatctggggcaagttagctaatctctgcttcagtttgctccttagcaagatgggatgatattaccacttacctcagagagttgttaaatgggtaaattcatatgtaagtgttcttagagcagagttcagtacatagtaagtactgtgtaagaattggccatcattaatattattcattggataaatatcaaattcaaaataccgtttacattgggaaagggaaaaaggagagaaatatatgagagacgtatgctgggggtatctacgatgttttctttttgatttttttatgtcattttaaatgtttctattcttctgttctgttcttaaagtatgcctgtaattattaggatataattaaggattctgtcttatttattttttaatcttcttactgtgtctatcttttgtctttctccatattctgggagaaacatctaagtttccattccttataactgattatttttcttgggatcaattctggtcttcaccatctgccaatgtgagttttagtttctctataaacttttaaactttaaactttttttcttttttttttgggggggggggcaatccattcttaacccccttccagtttttctcagcctattcttgtttgtttttgttttctatttctgtttcattgagatgcatacaaaatggaagatggccaacatttctaaaaattttgtttcctgacatagagaacgtttagaggtcaggttgctctgagactgtgttgtgatgtcttttttttttttttttttttacttgtttgtcctttcttttattatctcttgctgttatcctcacttttttctttgctgttcttcatcctttaattagcattcaaactaatcgttattagagtgtgtaacatgatctttgacatacctaggtaattttacttaagtatatgagttatgttgatacgcacagttcctcagcatgaatgtcattgttttgcaaattttagctgaaggtgacatcactgtactaaaattttcttgtgcatccacttcctagctatgactctctacagatggatataacttttttaagatgaaaaccatttattttcaatttctagtttaactgcctcacagtaaaaaagtgtactttttgtgatggcaggaatttgaagtatgttgaaactgcctttgtgatctggctcatggttaacttcaataacgtatgaaaagaatccatatttttatgtgtagtgttctgtagctcttttagttggtttatactcttttaatggtctgttgaccattttatctaaatattccattttgtcttttacttatttctattataaatggttaatctcttctactaagattgttaaatccatctttttgtttatggctgtgttatttggcacatgcaagttcatgattgttatatattcttgcttaattatttttccctttatgcatcatccatttttatctttagtgtttagtgttttttatttttattttgcctaaaattttatttttatgttaatatttgctatactagctattctgctttcaaaatgttcctgatgtttttctttatctttatcatttatcttttatctttaacatttttatatttctctcttttaatcatgtgtgttaggtaggcaaggatagctgctaggacaaaatattttctgatgttttaatagcttaacacaatggtaatttatttccagcttatgtaacagtgcttattgggcgctcagttgaggctggaaatagacatgtgagtgttttatggactaggccttgaagaagtgtacctcccttagatttatattccactggccaactctaagtctcacggctatgcctaattgtgaaggagactgggcaatgaatctagttgagtgccctgcaaactaaggcacagggatttttgtgaacagctggtagtctccattacagttctcacatctggacaacaagtaccttttgctcccttattctcacacagagaacatattcacttttcttccaaaggcagagtctcaaaatcccatttaattctttgattctgtgcaaattctagggtctccttcatgcttagatatggttccttatggtcctgtgggtttcagaaaggcagcccattcatgccgtctacccccctgctgctctatataatagaaggtggagtagagacagaatatcagtagcaaaatctccattttcaaaagaaaagaatgagaaacatgttgctccatgacagtcaatgatagaatcacgctggggaggtaaagaaccttgtagtaagagagcattctttatccaggtctgaaatctgctctctggagggaagtgccctgtccattatcctccatggtcccatctgaactggatctagagaagggttactctccttagggaaattagcagctgtcagcccacttcctgctggtgcatggttgaggctccgtttttttgtttttagcagttataggcttttaaggtcagattaatctttatttaatttcttaataatcttataggattcagatgtatttgtttcccattaattcatgagtagtggccacaccagtctttcctagacttgaatctcaagttgctttatttttctaatttgttatcatcatgcctctctttcagcacagtagcagctactatgaggctatttggaataatgagcttggtttgaaaagtagcatcattaatctgatatatgctactgggctgaattatttgaattcataatgggctattgtctctcaaagacttttgcaggcttattttatgctttttggactccagaatcaattgactttttcaactctgtaatgtcctaactttcatttctgcttgcacactggacaatgctttttttcaggaacacatctctttcttgtaatatctttgtaaaagcagcgtggagcagccagcacacaatgccattttagctcttccctagagcttcagactcaataggtactagatctaccttatgagttatggcagagcacaattttaccaaaagtctttcagtgtaaagacacagatccacatgggtgtctctgattgacagttggctttgtctatttggtgagtaggatatccaagctcatttcatttagtggctgtattgtcccctaggaacttattataacttaacgtttatctcatggaaggttgaagtatggggaacccaattcatatgagaaatagcccaggagttacattctcttctgctcagtgaccattagtggaaatgtaaatatctcacctcaatgcagtgtgggttaggaaatgtggctttctgtctagtcaacctctttttcctatgctgtggaaagaggagaagtattctgagggacagctagttctatctgcagtgtatcttttttaaacagcatagaactattttttttttttaattctagtcttggtttctgcctttcaatgtgtgaatttaagttcatgtttcttttgatgactgataaatttgaaataatttctgtatttcattgtgttttcttcactaccaagtttttcttatttttaaacttttctgagcatatatatgtatattttttgagacagagtctcagtgtcacccaggctggaatgcagtggcttgatctcggctcactgcaaactctgcctcctgagttcaagcaatcctcccacctcagcctcccaagtagctgcattaaatacgtgtgccaccaggcccggccaatttttgtatttttagtagagatggaatttcaccatgttggccaggctggtcttgaactcctgacctcaagtggtctgcccgccttggcctcccacagtgtggggattataggcgtgagccattatgcctggccaccaggcatattttggaattgatagaatttctttttatctgagttactccatacatcattttttctccctgttgctcatttggaagctaatgattctttcctccctttcttcctttctgtctttctctgttttcctctctccctgttagtcttgaaagtcttacgtacatgtttaaattttttcttagagtatcaagttatttaatgtctatcattctaatcaacaaagccagaccatgcatgatttaatggatcagtgaaatccttccccccataaaacaaacttcacttgttagtgttgttttagttgcttcttaaattcattttcagtataatttatttggtcctgtagctactccaaatgacgcacaaaatttggctaaactgatgactctttttgtgtttatggtgttttgagtcctcaactttttctgtcttgaatttttttttttttttttttttttttaaggcagagtttctgtctgtcgcccaggctggagtgcagtggcgcgatcttggctcactgcaagctccgcctcctcggttcatgccattctcctgcctcagcctcccgagtagctggaactacaggtgcccgccaccaggcctggctaattttttttgtattattagtagagatggggtttcaccgtgttagccaggatggtcttgatctcctgwccttgtggtycgtctgcctcggcctcccaaagtgctaagattacaggcacgagtctccgcacccggccctgtttttgcatttttagtagagacgggttttcaccaggttggccagcctggtctcaaactgttgaccttaggtgatctgcctacctcsgcctcccaaagtgctgggataacaggcgtgagcmactgcgcctgtctacattttctgtctttactggtattatggygggaacccataaaccactgcgaggcagataccattttaagcaggaaaccttatttttttcygaagcacatttaaaaatattttccagtttatctattaaacatcctcctttgcttctggagatcctctgaaagatttatctctttcgattcatctgtaaagtaaaaataaccgtcgtcgtcatttctcaagcgtgacgatactgttacacgtttactgcatattstgcataccaagcacatatccgtcacaygcagtgtggccaacttccgagaggccggcattcagccaaacagcctgaagaaccaggagaaatgcctgagtttccaaatggcttatggtaagttgttgctgccactatgagtagcctacttgcatttctayttaatggcttttccccatatttgatggtatgttaaacagtcaatcattcattttctaaattaaagcctgtcctgaaaacgtgctcagtgctattgactgtgcatcaggtattagagacacagatatgaaactgtactttttaatttacgataaatgtcagtgtgaattattggttgttttgcttttctttcatagtctccgtaggcttcttgggaatggaaattggtataacctttttggaggaccctcagtaaaaagctatcaaaatttaaaatgtgggtatctcttgacctagtgagtctacttccaggaattcatcttaaagaaaaaaattatagtttcctaagtatttgtattgcagcattgctttcagtggccaacaaaacaaaacaaaacaaaattggaaacaacataaaataatattaccggagaaacaatgagtaacatgtataggattttttttttttttttttgacggagtcttgctctgttgcccaggctccagtgcagtggygtgatgttggctcactgcaactccgcatcctggtttcaagtggttcttctgcctcagccttccaattagcggggactaccagcgcatgtcaccatgcctggctaatttttgtatttttgtagagatggggtttcaccatcatggccaggctgttctcgaactcctgacctcaagtgatccacccgcttcagcctcccaaagtgctgggattacaggcatgagccaccacgcccagccgcttctcgtagatactacccaggaattttcacagtaacttcaaggaagagattgttctgtaatttctgtttttactgataaggaagctcacgcttagagaatgtaagtaaaaagttcacaaagctagtgaagtatgtgggggcggtttttaatgaatgattgaacattctttagtggaactacaatactatgtttttaggaaaagttgcacgatgtttttacatgggtagaaaatatactctggaaggatttgaaccaggctgtccctgttcttatcttggggcagtaggactttggggcacgttttcactttatatgttatcaacttctgtattatttgtaatacaatgaaccagttttatttttgcaactaacagtaagtataaatagctgatgaccacttggggtgaaccgaagtgcctatgacaaaccacacgcaggcatcctcgggactattgaggccagataatcctttgttatgggggctgttctgttcgttgtaagatattgagtagcatccctgacctctgccccctggatgccagttcactttccaacaagttgcaacaagcagaaatgtctgtagatattagcagatgtctgctagcagttagaatggcctctggttgagaatcagagcagactctgctcacactgggctatcagggtatagttctctccctcccaacagctggaactgagaccatctccctccatttgaggatcattccgatttcccaagtccaccgtgtggaatgtaaaatcctttgaaccagaacagacaaatcttgtttttgtctttttattgaatttaaccactattgacttgcgacttgcggcaatcaccagatcccagatctctgtgtttggagctacacgtcyttctgaatcgaggaggtggggcactgatttttcttttatcactgacttccccgaagtgggaagttccagtgcttaacaagtttcattaagaacacagctattaaatattcagaatatacagactgttgctgttgagaatgtaattatgcagtaaattagctgatgtccagtacgttgccttttaagcagatctttgatgtatgcagtacttgcataagatatagggcatgtttattaagagtcttcaactgtgtataaaactagagcagtcaaaagtaatggtgtctgctgaaggattctttatcatatgaatttacctttagtcatctattatttatttcagctattttatatgccattataataaatattatgacagagaaagcttttacgcttcaacttattgtactcctctttacttgcctgcaatccttcaggaaaatgtaaccacgctttacctatagttaacgtaaatcatcacttacattagaatgaaaaattcactatgaaaaaaagctcttacttcaatagcaaggcataaatgcacaatcatgttgactgccaacctcctgtgtcattcactgtccttccttaaactgtttttaagctgcaaagtgaatatattgcatagagggaaataggaaggttttggattattttcgctctcttattagtttctggcaggataagcattttttatccggattgcaaaatattgccaattactgtctaagcatttttaatagttttgctttccatggcacgcaactcatatactaaattaaataagctgttatctggtgcaatttctccttgaatagactcagaattacctatagatattgacacggttattttataaattgagttccagcaacacaaggcaaaaattttggcctgtatgtaatgaaggaagagttgtcatcattttcttattagggatgtttgtgtattttggcagggggaggtaggaaggggacctgatggagggccctggagtgaaggttgatgctggatggttgatttgaaggttaggaatggcaaactcagcctctgttcttcaagaatccccctgcgtccccccgccctgccccctgcccaaaaaaaaggaaatccagggctttgctagggatcatttttggtgtggttctgtattttaaaatgtggaatcatctccaaaagtgtttgtttattaaaagcaaagtgataaaatgtgtcaagtcagtgaagagactctcaaactcccctttcctgcgaatcctatcagaaagaacatttatgagggcatacttttcatctttaggcttggcaaagatgggtcaaactccccatcagactggcacatggtgctgtttcaggtttgactaagagagaaaagaatcactagtcaatgaaagcaactgtgtccccatgcattttcccagtgaagatgcgatcaccccattgccaccgttaccattgcttaaataatattagaggaattagtgttatgaagtcccacatatgatattgatgaattattaaaccagttgagttagatttctattgtagttcagtgaataatgtcatgtcaatactgtgctcaacgccagtgtctcttgctgttgtaaatgtgacagctcctatttaaggttttagaacataaaatcaggactgagagtatgtaaagcggaagggtgagagacatcagcataatgcaattaaggcccattggattagaatttgcaggatgccattagcaataagctctgagtgtagattattgccgtgcttacattttctccttcagcggtaacacttctcttgtaaattctaactgggtaaaataaatatgatataaaacagacacaaataagaatatatagatgatgttaatttcttcagagcttcccggtgttacgtcttcaagaatatgaygacaggggaacagcccagtgtggcagtcatgtgacgacatgagcattggaaccagccacatctcagttggcaacacgtatctgtgtcttactagcttggccactgtcacgtcactcagcctctgttttctmatctgtaaaatggggaaaattatagatgcttcagaagatatttgctatcactattaaatgaaaacaagcatgtcatcagtgcttattatttttgttgcttttatgatcaataaatacatgcaaattagagctttttaaatgagattctggaaataagtttttccgtatgtgtaagggaggggtagatacactgccatccaatcagcatcaatgggtaccttgaagtgagatcacaaaatagctaattccctgtaaacagcaacccttctctctgcagttgcacatgagtagtcccccagttaaaagagaatttcctccagatacaatggaggccacgttcaacacagccatctagtgtacctgggcttcttccacctccagccactgtaccgacgtgttcctttatttcacccacatagtgatgatgcttccaacacagcataacaaagagctgctgctttgtgctgctagatttgccaaaagtctgtgccagggattcttttgttggaggtaagtggagaacgcaaggcccacatgcacaagatgggagtattttgaagcatgctccgtaagacccaacatgtgggcagcagaccaactacttgggttcactatggcgagaaatgggataggagagcgaactcactgataccctcccagctaattcctaggcaatctgcaattaacaatgattgtaaagtaataatttgtggttttgaaaactaggtttgatcactggaattattcctgtcctatgttctaaaggcctgttgccttgagatgttttttctcctcccattattggtaagcataatgtaggcatgagacgttgcctttgaagtgtcggaaggatggagaggagaaaagaaaacggagattgaatctggaaaacgcattcatctttagaggcagtgttaatgaatacatgaatttagtcctgtaaatgttttctcccttatttgggacttggtgtattgaaggtgtctgttaactgtgctaccaatgagtgcccctgtatccgagggaaactggagaagtgtacttgggctaccgggttaccaagagcaggacagcatgaggcagttacagatctgatggtttttcttggtctttgtctcagctgccatgagggcttctaaggggcaaggagggttgggggatgagaggacaggtacatagtgtggacataatggaatatggaatagcaattgaaatcttgcgttgggctgaatcatggctttgcagttattatcttgatgcggctgtgcatgagccttttgaacctcagcttctccatctgtgaaataggtggataatgactgcaccctgcgaagatgctatagggataaataactgctgtggggcaaggactgaaatggttgttgttttgagatggcttttatcattgggccagtgacgacccattcagccctatcagtgaagagtgaagcactgcactctttaaggatagggctgaatggtttatcacccattcagcggtgaccaccacatcttatgcattgtgatgatcacgatgataaaacaatacataatcacaatataaggatctagagttatgaactactgatcaggtatcatgttctgctccaactgctttagatacattgcctgacttcccgatagggcaggtgctgttattactcccacttcacagaggagcaaactaaatatacaagaagcagtaacttgcccagccccaaaccaccccctgaaaaaagaaaacaagggagacccacagttattaatatgcattattattggaaaacaatggtcatcacattttagcagtggccttcaaaataatgataatagcatatattgagagcccattgtgtggcttgtaccttatattcactctatctaatcttcactctaaccatagaaggcaatactattatgctcattcataattaaggcaattgaagcccagacccttccagtagctttcctgaagtcaagttgccagtgcattggacatactrggctgtagttccagggcagcctggctctggtgtctttgctgcaatgacaatatctccccatttctctgtttaaataccacacactccccatatggtttctttggtttcaggcagtatcgcatcagagtcacatatggctaatttatagtcataaaatgatattagagatcactgttgcataacaacaagaaacccctttgattccacacttacagactcttgagtcactaacacaggtttcagtatatataaagaatagatgaagaagacttagtgtattaaggtggcagtgaactgtgctactgatgagtgccactatattcaagggaaatgggagacatgcacctgggttgtttgattatgaccttctggctgagccctggatgttgggagcaagtgggcttctgagctacatagaagttgcctgatgcttcacatgtgggatgccacctgtgtggctctgttttaaaatgatgggtagtagagtctgtatacataatttaaaatacattaacatttctgttttgcctgagataagcttgtactggtgtgatcagaaggaagaatgaggatttggggaaggaaaattttgagagccattttacagcatttcaagattcagtgatctcagaacctcttttggttaaacaagcatgggargatggatgattggatggatggatgaatggataggtaggtgggaagataaatggatagacatataggtaggaaggaatgagggatatatggaaggctagcagtttattttacggtggtgggatttttttcttttccttttttactcagacagtcttgttctgttgcccaggctggagtgcagtggcacgatcatgtctcacggcagcctcgactttccaggttcaagtgatcttcctgccgcagcctcctgtgtagcaggtgcatgctgctatgcccagccagttatattttagatgcttttttatatggcccatattcatatgtctttgtgacttttttttataatggatgtgagtgtgaagtaggagttggcctgaaacaagcccagagaggtagacagggaccaagtcatggactgagttagttgttgttgttcctcactttctgtttttatttctcctctttctggacacatagcacgttgcaccttctagaagctaggcacagccacatgactttgtcaagggaaatgtgagcagaagcaacaccagtcactattaagtgggaagtctttgagatgccacgtgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagctgggcgacagagtgagactccatctaaacacacacacacacacacacacacacacacacacacacaaaagcacagggctttgttagcaggcatgacttggattctttaggatccttccctcagtaatctggtctgatgtggccttcagggaggatctttggacatcattgccatccatctgtccactgtgctggactataacccacccagactaccatttattgccaagtggcatcgggacaagagttttacacaagaaacatcttctctgctagttaaattaattagataatttgtcttccagacaggatgttaggaacttatgaacatgtatcgttacaaacctatgagtagatgactaatattcatcttttacagataaggaaactgaggctcaacagtgttaaatggtccagaatgagtgtgttttctagctgtcactgcctgatgtttactgctcaaagcttaggacttggattagagcccaggacttggcagccaagataaaccagstgcaattacgctgaacatctcagcccagctcctgtccatccctgaacaggacacttagggtagaggatgttctcagcagtgccatttgcatcccccttcatagccttacaggtatcatgttatcctccttaatcttacttaagcatcacagtctagactagaattcccaagtcaaccgtttgttttacgggactcttcttatttgaataggcaggtggccctgtgttcttggcttttttgtcctttcaaggagctaggtctaagaagtgatagtatttaatctcgcactccgaagcgcacccagatttaaaagttgggagtggcccatacacagaaggctagtgggaggggcaacccggagatttgtccttgcagaatgatgccatgaagaacatggccaatggaacaccattgcttcaaatcccgacctctccagttctcctggtttcttgttaggcgggaacttgggcttctttatcagtgactggggtcagttcttgtactcaacttcctatctctgtgatctcttgtaagatgctgcattgtcaaatggagaaaacattgtctttgagttgttaggagccttgagtgagatggtatgcaaatgtccagcccgtggcaggccctaagtacacagtagccattattaccattattattcctatcaccagcatgtattccacctgttgatagagttttctgggtttactaagccagggtgttgcctttgggatcgaggtccgtcagaatccattggtataaacgagtctttctgcttttgtactttctataaaggagttgtctttgatttttgatgcaggtttaatggagatatttcagaacctggatggcagcttttgaaattaagatattgtccattgcatctttccatgatcgaggcgttgtcgtgcattcccctccttacagcgttttaggatgcagattgagaggagataacgttagcccgaagcgcctttgcagcctcttttgcgcggctgaaacacagcacaacccacccccccgccccaccccccagcctgtaggtttagcagaatcccagcctcacatcctccccgaacttggcagtaaaagccctgttcttccattcattccgatgatttatattctctctgggcrtcttatattaaacaggggaattccgacatgttccataacacatttactgtaacttgataccatgaactacacttgctgttatttatcatttctttttattttctctcattgcagcataaagccaaggtagaarcaatgaccctggacctcgctctgctccgtagcgtgcagcattttgctgaagcattcaaggccaagaatgtgtgagtgttccagtggagggttatagatcataatttyttgctattgtaatatctttatcagatgaacacaattgggagaatgcaaggctgttgtgttgtcttggcgtccaaacaggaggctcatttatattggccctgttaaggtgaaccgtattttcttgactcacagtcaccttcattatgagatgtgtcatcaatctaataacagcttcccacataccaaaagagaagacactattaaagcactagtaaaagtggctaataaaagcttggcaatagtaagatgcatcctgattataagattttttgtagtgcatttcagaatggagtaagagtatatttaaattgcattcaggaacaagtaaactcagttatccagtatggcagggaggttgacaatccaagcacccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccctttctaacagagaaggttgtaggagaaagggagagaagcggaagggggtggggagacagagagacagacaggaggcctcaaaccctgaaacactgagctaaggaaagtgatcatggcaagctacactaattacaatactttgtttccaagtgtttatttttactcatatttagggcaggcaatcctggtttctcgttgaacatagaggtttgaatttcattaataaataacttcatttattttttttcagtgacttgattcaaacatgaggattaagttaataatagcacaggttgtgcgaaggataagataattacacaagaggcaccagaaccactgaatgtggagagctctcataaatgacaagctgcctttgggttaggctctgttgggaacattagttctgcagtgttgcaagcagatgaaggatgtgagggaagggatcttaaaccagatattcaaatggccctgtggggagctgacaccacactgctgtctagtgtccaattctccttgcatggctgtgtcacccaggttggaacgtagtgcacaatctcgccttaatgcaacgtcccactgcgggcccaagtgattttcctgtcccagcctcctgagtagctgggactacagatgcctgccaccatggcctgctaatttttgtatttttagtagacatagggtttcaccatattggtcagactggtctcaaactcctggcctcaggtgatccacccgcctcagcctctgaaaatgctgggattacacacatgaaccactgcgcccagccgctctactttattagatttaaaaagtttgctctcagctgggtgcagtggcttatgcctgtaatcccagcagtttgggaggccaaggcggggagggtcatgaggtcaagagatcaagaccatcctggccaacattgtgaaaccccatctctactaaagatacaaaaaattagctgggtgtagtggtgcacacctctagtcctagctacttgggaggctgaggcaggaaaatcgcttgaacctgggaggcagaggttgcagtgagccaagatggcaccactgcactccagcctggcgacagattgagactccgtctcaaaaaaaaaaaaaaaaaaaaaaaagtttgtactcagcctggcgtggtggctcacgcctgtaatcccagcactttgtgaggccgaggtgggcggatcacctgaagtcaggagttcgagaccagcctgggcaacaaggtaaaaccccgtctctactaaaaatgcaaaattaactgggcggggaggcacatgcctgaaatcccaactacttgggaggctgaggcaggagaatggcttgaacccgggaggtggaggttgcagtgagctgagactgaaccagtgcactccagcccgggtgacaagagcaaaactctgtctcaaaaaaaaaaaaaaaaaattgactcaggctcttgctggagtatgtcagtgtcccaagtcattgaggtctacattagagtcagtcttagtgagagttgcaacatcgcctaagcgcagaccccaagctggcttgtaggaacagtgagataacatcccccagccagccagatctgagagagccctcctgtgtgtgtcctttgcagcgcttggctgttagtagcttccaccctttgccagaactatcaagaggcacctcaacaggctgcaacactagcattcaagacatttgttcgctgatttgcttcgtcattcatttatccaccggttccttcacttcacacacatttcaggagcacctctaaagccccagacattcttctgggctctgagaagagagtggtggccctggaagccacagtaaccgcacacaagctgtcacctcagttgtcagctattatggatggctgactcctcaaactcatctgtctgtggttgtttgggagggaatgataatgacaagaacagcagcggagtcagcagctcatttactgagggcttatgggccatacgtggaaaatattttgcatgtacgttttgattcaattctcaaagcagtccttgggagtagatgctattaatatctctactatacagataaggaaagtgaggctagagaggatatataatttatccaaggcatgtggaatgtgggtagaggggccgatttagcctcttcacggctccaacttgaccaccgtactatactgtgtttcattttagtttattttttatttattttttgagacagggtctcgctgtgttgcccaggctgaagtgcagtggtgcaatctctgttcattgcaacctctggccttgggttcaagcgattctcatgcctcatcctccagagtagctgggattacaggtgcaggttaccacacacagctaatttttgtattttctgtagagatgaggtttcaccatgttggccaggctagtcaactcctgacctcaagtgatctctccaccttggcctcccaaactgctggaattacaggcgtgagccaccctgcccgaccctttcattttaaatgtgatagaaacagactcagagaatgtgagtgactttcgcagggtcacttagcaggttggtgacgggcatggggtttcactccagtctgcctcttgttcttttcctcatagcatgtgagatctcacaattcactgccgctgaataactttgtccagttcctctgtcagaatgtgttggaagtgagcagctttgctgaagagagccaactgttacataataggatcatcttccacgtcttaactggaccattagtttttaaccattaagtagttgggaaatcatcaagttcaagtgccttttgtaatcaccaagctcaaaaccttggaggaaactctcacccattttgccctaatcccagattttagcacaggactttggaattttagaaagtacttctaggttgagaaacaagggtgattttccatatagagacctctgtagcacaaccctctttgtatgtgtcccatgagagtacaggattttacatggcttagagaaatactgtggtggtgaaaatatgcataaaaaagcgagagattttacttttgaaatgctgccaaagtgaaatctctyttggataggcagatgacagtttagtacttgcaggtctttcgattctgacaactgtcagaagtgaatttaagtgctggtgactaggctgccagagaaacacatgtaactctattcttatcaccccccatcttcagacattaaaattttcttgtgtgtaaaacataatgacaaatgaaagaaaggctgccagttcagaaccaatctcttttcacgctgttgcattgaggagaggaaaaaatcccttaaatttgaattccatgtggatgctcttatttaatatgccgtttcaaagcctgtatgcgatcaagccagagtattatcaggctctgagttcctgtgtgtattcccttggtccatgctccatctcaagtgtttctccacactgggataggcagcatattgtgtagtcttagagcagaaaaggtagaaacagattcttagtacaaacactggtgagaaaagcagcatattgtactgtggaaccacccgccgtctgccttctgtgggagatggggatcagcctcttcctggatctcttctttttattcgggtgctgggaggtgaggctgcaaaggaggctgttgtagagggagccctcctaaccatgattatgtaaacaatagctgctaggcaacttgttgtttgttttatgcaaggcagtgtgctaagcacttacatacatgtattctgtctgtagtttgttataagagtcctgcacacttaaccatgattatccctactttgcaaattacaaggttgcagtgcagagagcctaagacactttctcaacttgagcaagtaggagatccagaatttgaacccaaatctctctgaatccaaaacgactttttgttactttgcacacttcagtcataggaatttcagtgtggatttctgtattggttatgtattgccgagtaagaaatgactctggccaggcacggtggctcacacatgtaatcccagcacctggggaggccgcagtgggtggattgcttgaggccaggagtttgagaacagcctggccaacatggcaaaaccccgtctgtactaaaaatacaaaaattagccgggcatggtgatgcatacctgaagtcccagctactcaggaggctgaggcatgagaattgcttgagctctggggtgggcagaggttgcagtgagccgagatcatgcctgggggacagtgagactctgtctcaaacaaattactccaaaatttagtggctaaaaaacaacataaaacaagaaacatttctgttgtgcctcctcttttcctccctccctctttctcatagttaatttgtttgaatcaggattcaaataaggtcgatgcatttttaatctataggttttgtctcctttttttttttttccttaaaaaaatttcttttaatgcaacagatttaagggaccagggtgttctctagagcaggggtccatgacctctaggccacaaaccaatagcggagccgtggcctgttataaattgggtggcatggcagggagtgagtggtgggcaagcataggaagctgcgtctgtgcttagagccgctctctgtcactctcattagtgcctcaggtcctccccctgtcagatcagcaacagcattagtctcataggaccgtgatccctattgtgagccacacatgcaagggatctaggctgcatgctccttacgaaaatctaatgcctgatgatctgtcactgcctcccatcaccttcaagatgggatygtctagttstaggaaaacaagctcagggctcccaccgattgtacattatggtgagttggataactatttcattatatattacaacgtaataataatagaaataaagtgcacaataaatgtcatgtgcttgaatcgtcccaaagccacccccactcctttgagtctatggaaaaattgtcttccagaaaaccacttgctggtgccaaaaaaatttggaaacctctgctctagagatttctgcagtctgtactttggtgattgcatctctgtggtgtcttttaacatactcttctgtctcctgagtttcctgtgaaagggtagataactcaagagactcaatcaacttcgtgtttaatgttttcgtaagaatacttcagaggcagtggtgtaatcgtccaagagtacacacaggcctgatygccaaagccagttttcttcaggcccagcacgtcctgacctcctcactcctctgcccactctctgtttactcactccsattttcattcattgattctgttattctccactaagttttctgggtggtcagcccaggaagcctcagcctgcttccagatagttctcctcagagttagcggtagcagcggtcgtcggccagtgtgtctcgggtcaaattattttgggcattactggaaagttccaaaccaaagcctgtggtaagttccacccaaactggcttgtgagggatatttttgtttaaactgcattcctggagaggagccagacttcctactgcctggcagcagtggtgtccataggagtatgaagagctgggaccctttctaatcactcagaccaaatattggggttttctgaaatggactgagaaataacagtatgtttttatgaggctttgcacattttccttcctagcagtagctgcttagtctactgaaaagtgcatattttgaacagggcctagaagagttaacagctcctagagagaggtgctctgtaatactttttcttcttcaaaaaatggtttatggctgggcgcaatggttcatgcctataatcccagcgcttttgggaggccaaggtgagaggattgcttaagcccagaaacgtgagaccagcctgggcaacgtagtgagacgctgtctctgtattacaaaattttttaaaaaacggtttgtaggtccttaagtccctgataaaatagagaactgaattgcaatcctggaacttaaaaagttggtgacgacacctgagatatttattacttagattgcagttactggtcagcttgtataatactgaccaagggttttgattcttcctggaattgataggaaattcatattaaaataattacccaagtccaaacatttttagaactgcatttttgatcatggatttttatgtctcttctgaactttctgtcaccggtataatttaaagaaattatacttaagctttgtctcacttagaagataatatagaacagtggtgtttttttaattaaaaaaaargttaaaatracggttttgtatccttgctttacttcttaaacatatgggaggaaaaaaaatctttaacaagtttatttattttcattttctgctaaattactttcagaacttgaatctactaatcccagatataatattcttggattcatattccaaattttgctgtctcaaatccatctagggaagtgggtgggctataaattataaataaattccaaattttgtgggatgaattaccctgaagaccaacgtgtaaattacatattaatctttctttttctccctagctcggttttaagaataatgttttagccaacatatctgcattactcttggctcaayatgagaaatccatttttggtttgcctaacagaagatcatgttgctttgcttctctacacagtatgaaaacccaaagaaaagaaaaacagaggcagttttttgctctaatgaatgctctaaatctagctcttaattatgattttttaaggaaaattttgaaaagtctacaagttaaatttttttttctatcccatacattttccatcctaaggcattgaaaaagcacactgtgaaatacttagtgtatctagaaacatcagggaagaatgcttccctcctaagcaaaattttgccttctgaaactttttcagcattcagtctttttatataatacttagaaaaatatttctgaaatagatcatacactctcttcccaaaaacatcaaagtatgaccgtaaagggcagaggtaggtaaacttcttgtaaggggccagagagtgaatatttgagaattttcagactattaagatctctgttgcaactgcttgcttttgccgtggtagcctgaaagcagccgtagatagtatggaaatggatgatcatggcagtgttgcaataaaactttacaaaacagacaatgggccagattggccaggggccatagtatgctacccctgggcaacaacctgtatgccctggagtagtgtaaagaacgtgggtgttgggggtcaactgacgcttccagctctaccacttactggctgtgtggctttgggcaaactactgaaaatctctcagcgtcactttccaagtgtgtgtaatgtgtattttcacagtgctttgcaggttgttgattattgaaaatagccataatgcatgaaattaccagacacatctcactttatggagcctggggctattggtaatatgcatttctttctcatcttgatcgtaaaatgatcttagaaaggtttctgagaatwtatagagtttaagacagcaataagacaactaattaattaaacaggaaaaggggatgttgtgctcagagaggaagtgtgggtctcataagggctttcacaatcgtttgagaggacacgtgtgatgtctcatgcctgttatcccagcactttgggaggccaaggcaggcaggttgcttgagttccggagtttgagaccagcctcggtaatttggcaaaaccttgtctctacaaaaattacagaaattagttgggtgtggtggtgcacacctgtagtcccagctgcttgggaggctgacgagtaaggatcacttgagccagcatggtggaggctgccatgatcatgctactgcactccagcctgggcarcagagccagaacctgtcttgtaaagaaaaggaaaaagagagagaagggcagaaagaaagaagggaaggaagaaaggaaaattgggcccaggaatgatctttacaatgcctgacaaccaagagaagaagggaaatgagcttcacattgcctgcaagctctarggtgacaagagccaagagaaattattgttactgtagtgatgttccactgaggatcataaagtactttattactctactgagtatggttattggatatgtgttcttctttttctttttctttatcttttttgctattcttttgttattcttgatttatgctgatggaaagccatggacccaaggatgcttcacagttttctttcggagtaaatgcttagattccattttctttgacatgactatgtctgttcctcttgattttaggcatctttttcagatgagttgccataaaagcagcctgctctggataagtgaggtacagcaggacacactgcaaatactaggaatccttaagtacagtggaaccccagagcactctacctgctttctttctcacctccttaaaaactttttttgcccwcacctcatcatttattcagcagtcacaacagtgccaagaacttggctagagattggaaataaagcttatgccttctctcatatctcctgtaccttatttctttcttacagtagttgtgatgcttagcagttttttgataactttttataatgccaaccttcaaaaacctgcccctggtggagagaataattattacatcaattaggggtcacttagcatgacatttgtcggaaaaaaaaaagttagtgagcctttttgccatattaaaagtcatcactgccaagacataaatgaaaatgtgttcgaattaaccacaccaatgttcacaaaataaacatttttgatttcccaacagaatcctaggtttaactatcactatcatctttcatgaaatcaaagtcatatatgtaaattgaacacaactttcccttccatagagagtaaaaaccacgctttggagggtagatacaattaccccagggttgtcttttcccactcctcacaatcccaccagtgcacatgcaaggtgatgtccttcctttagctatagcaaataatgttaattattgttggtgttaaataatgattatgtaaagcactagactagacattcgtcggcaaagtttttctgcaaagaatcagatagtaaatatttttgctcttatcagccagacagtctctgcggcaaccattcaagcattgttgaatacattgttgagtgttacatgagactattgtaatataaaagtagcctgggacaacacataaataactgggtgtggctgtgtcctaataaaactttatttacaaagaacaggaagtggcttggatttggtatctggcctggcagctgtggtttactactccttrgacggtggcccagagaccctttaaatgaaattcaktttactagcaccctttttcatcatgagaaatatattctgtttttcttaraaaatgggttatgttaggtctggtcaaggtaaataagtgttgagagtcgatgttgtgtgcatagttaatttcaattctttgaagaarctcccccatgatatttcacggctgagagaagaggaaagagtttaagtggaacagtgtgctttgctgagctttggaaatattaccatatagggaagcaggtcaataagacaactaagtgctgtttcaataacgaagatactgaagcgctaattggagtatggaaccatataatgatgataataattgctaatatttatcagctatttatcatgtgtcatgtacagctaagcacttacataccatcccattttatccttataatgackctaagagtgggttaaaaaatggcagaagaatggcagtgtttaatggttcagcctggtgcaatgattaaccacattttacagactaagaaattaagaacctcaaccaagttcatgctagctggtacgcagtaaggctagaacttcgtccaaaatctcttcttctgttgagctcagcttgcatagtagcttggagaatcagaaagatctgtctcatttgggaaatataccatgtaaaaaacattgtttctaaaggagatttgtcccatgagtaaaatagatgatggacagccactgcctagtgggacaattagaaaggtcagttcaaggttggaggagatgcttctttcagccaattttcctttttctcaggatcacctcaggtgatccgcccacctcaacctcccaaactgctgggattataggcgtgagccaccgctcctggcctttcagccaattttctatcaccaaagggaaatcgttttgctggaatatgtgtaaaggaggttaaagtcagaagagattctcgtccgctcagttaaggtactcagactattttccaaccaatcaagagggtgctgcttcatggagttcgtttaagctgaagcggcagctgktgactgtcatttgcatcatctttatacatttactgtgaatgtcactgtccatttccactttctttctacttgtcttcaaattgatgcttatcaagtagacagaagaagaccaaggggtcgttttgctatttatacctccaaattgatggcgtgatcactctcaagtgcaaacccagccctgacactgtcctgtttggcaatgtcctgctatctgacctgcaaatagctacacttcctgctgtggcccacccaggcctctgggatctgatcccttctcccatgtcacctgtggccatgtcttccccaacccaggcttctctgctccgctgcttatgttctggatcctgactctgagcctttgcttgtgtggctcctctcccacttgtccatcatcatgtcagttatgtaagcatagattccaaagtgacaatgagggtagttaggatggcaagaggagaaaaaccaagctggattcatggattgcttgtgtcacgtcctctacagagcctcccttctacctgctcttacccgggcaccacagttgatgagttattttttggaccatcagcaacacacccaatcattgtacatggaatacttyggggatgcttttttctatattgattttacttcattaaactgagctccagaggagcagaaactttggctaatacatcttggtcttagcttgtaatatctgtgctacaacttattaagatggtgacgctggcaaattccttaatctttctaattcttaatttcatcagcaaagatgggaaaggatactaacaccactctgggttgttgagaggattcaataactgaatatttataaagcgtagtacctgatacttaataaaaaagtgaattttaacctgtgtcatcattgtcatcgtctttatcatcctttgcaattattacatttactgccttctagtacaaggaaggggatgggtggctggctggctaggtggatagaaggatggaagaggtaagtacaaggaaggggatgagtggctggctggctagatggatagaaagatggaacaggtaagtataaggaaggggataggtggctggctggctagatggatggaaggggtggaaggggatgcaagaggtaagtacaaggaaggggatgggtggctggctggctagatggatagaaggttggaagacaggaaggatggaacggaagaagagggaagaacaaaaatggaaacacatagtactgttaggtgaactgaacttctaaggtgccgattctcagtgatagaatcttgagttgatacctccttgggtggcatggagcctatacctttgtagatcttgggaaacaacttctaaagtaatcatagttgtatgtaatcgtagttacaacaatagttattttaggcacataacccaaaggttttcttacaaggaatctatgaaccttaagagtgagggcttctgttaagagtaagggcttccctggagtggacatggatcatgggactgagccagcttggcattgttgggttgaacagggagcgacacctctcagcccagtctatcaagcctgctctttgacctgcagtgagaccacccacgcagacatcaatgcagcaaatccccggcgtcagggtttcaacatttggttactctcagagaactctcgatttatataagacttggaaaaagggtttgagtttctgtggtttacaattatatttcccaacttggcccatgaatccagcttggtttttctcctcttagcatcctaaccaccctcattgtcactttggaatctacacttacataattgacatgttgagaagctgtgctaaaaccacactgaaatcacattttaataacatgggaaccatcttttcccagtaaattgttgagaagctaattcttgtcagcctaaaaacttgaatatacatttgaataaatcagcggtgctacaccgtggcagcctgctgaaaatccccaaggaagattatatttttagttgagctacttgtcactgcactgtgtttttaatattgtgagtcctttcttgtcttcatttttgaagaatctattgcataccttgtcattcagaaaaacataaacgggacctctcaattagcggtaaagttcgtcagtttaacttttaagcttaaactcctgttatagttcggtcacttactcgtcatcaaaaagatatttgagctgatattatgcaataatttataaccaaaaacaggaggaaaaggtctctgtttgtctcagaagtacaagttatgcataaggtgacaaattacacagctttgggaaatgggtcttaatggaatgcaccaggctaatagaaaagcagtgcctcgatttcccacctcagatctgaaaactcctgagagactgacagggcggttccccagcttggctgtgtgaggaatcagctgggaatcgaacactgcagtctggctgtcacccccaggattctaatgtaattgttctgcattgtggatcgatggatggatggatgaatggctggacagaaggaagacttggaaaaaatctttgagtttctgtggtttacaattttatttcccaacttggcccatgaatccagcttggtttttctcctcttaccatcctaaggagggagggagggaggaaaagggggaaggaagcaggtagaaagggaacagggaagggaggactggaggaaggaaagcagggatcattctggagtgtacactgggcatttgattttaaagcaaatccaagagatcattaaatttgtatcaatgaatacactgttacccctcaatcaacactacaattcatatatcagaatagcactttgttacttgtttctgagatagggctggctctgtcacccagactggtgtgcagtggcacgatcacagctcactatggcctcagccaccagggttcaagtgatccttccactcagcctcctgagtagttgggactacatgcctgcaccatcatgcctggctaatttttatttttgtagagacgaggtctccttgtgttgtccaggctggtctcaaacttctggaatcaagtgatcctcctgcccctgcctcccaaaatactgggattacaggcatgagccatgtccagctgccttgtttttttctttgaagagaatgatagaccttccataggaaaaatgttaaatatgtgtgtgcagaaataaagatttcaaatatttttgcaagatattttttctaataccacttttttctacattttccataatttagtgaagatagtaaattaacaaagtggaaaagactgaatattttaagaaaagccaagtttaaaaattttgaacctaatatttcttaaagtagctaaaattcagatattgagaataaattcaacttgacatggcaaaattctaataggctgaaataatgttttggtctagaactatgtagctttgtgtagcccatcaattgtctaaaaaaagagtaacctattttgatgaaactcgctgtatcttgtaacctgtatcctgtcttggtattgtgggagtatatatgatttaggggaaagagtctggagagaccttaagtctgctttagggaaagggtgaggaaccccactgaaggctacttaacgcattttgagaatgtcagtaaagatttctcagagcccagggattttttttttaattgagacataatttacatacaatacaattccttttttcttttttttgagacggagtcttgctctgtcgcccaggctggagtgtgatggtgtgatcttggctcactgcaacctctgcctcctgggttcaagtgattctcctgcctcagcctactgagtagctgggattacaggtgtgcgccaccacgcttggctaatttttgtatttttagtagacacggggtttcaccatgttggttaagctggtctcaaactcctgacctctagatccgcctgcctctgtaatcccaaagtgctgggattacaggcgtgagcccctatgcccagccaaaattcattattttaagctgtacaattgagtgatttttattacgttcacaaagttacgttaccattaccacttttgaattgcagaacaatttcatcactccaaaaagaaatctcataacaattagcagttattttccatcgctacttcctccagtcccaaggcaatcagcagtctgctttctatctcyacctgtttgcctattctggacatttcatatgagtggagttagataatacatggccttttgtgactggctttcacttagcataatgttctagaggttcatttatgttattgcaaaaatcagtacttcatttctttttatggctgaaaaaaattccattatgtagatgtgccatatttgtttatctggttgtcagtcggatatttctgttgttcctactttttggctactgtaaaagatgctgctatgaacattattgtgattattataccttatttgtaaacatcatgggtggggggttgcagtaaacatgttggaaagtagggttggaggtccgtagaaattgggggcttcagcacttcccccaagctcaacaccaaccccctttctgagcccctcttgaaggagagttccctgggacgtgcctggtattggtacaatcagtcaggaagcatttttcctggggagaaacttacaagtccacgatcaaagccaacaagagacaaggtgttacatgactcattttyggtttaagaagtgacaggctgattctaagttgggttcaattattttgttaaagcgttttgcttatttgacttctcctgacctcggaaataattctaaccaatcagtgctggctcccattggccctggggtctggttgctttacagctggtgacagggggaccactccactaccacatgtgaattaatcctcaactccagagccaagtgccattctccagcaaggttgtatttcttcattagctattcccagggcccagaaagtcccagaggatgtcagagtacattaatttttatcataacatggaatctttcaggtctgaatggcagcacacggctgtcaggggcttctgaactctattacagctccatatatctctaggcaaaacagaggaaagagtcgtcattggcaagggagatgtacaaaatgcatgagatgttttattttttgagtgacttgaccacgtgcttaagcacattccccaaacaatttttttcttattgtttgtaagttgtaagttgtaaattcacctctgccaccacctattaaagcccactccctgcattaaaactgtataaagtgtatttaaataaactctctttgcatgatgtgaatgaaatcgtcatctggtacttaaaactattctataaagttattaaaaaattaatgttcccttcccatgatttttctgcagaatttatgcatccatgatactgcagaagttcataaataatggcttgtattgctgctttagtattgctttatgcctacgaaatataatgttaatttgtagcaatgctaatgtgttttcaggaaggctctttgtttattgcctttattttccccacttaccaagtgggtaaaatgctttgagggttgcattttatgtattcaggaggcccaggtattattttaatagaagcactattgacaaataccagtcatcccccctgtgccaggccctggatgaggcactgcttcgcatgggggctccccagattgtcccacaaggaaagcatagtcaaagacaaagttttcagttgtaagagtaaatgtgttctgcctaggcattgtcaagtaatttactgccagctctagcccttcactcaagtttcctggatacttttgacttcttagccatggatgtgtttgaaggctgcatggaccttcacttacttgcactgcaggtcagcctaattgcatgagctctgtggaccacagagcagggttttccaaagttcaccaagacaaatattgtattatcttaacatatattcattttttaaaactgaaaatcagaagagcaactccacctagcagaagtcttttgcaaagggcgaggcgaggctaaaaagtatagaagagttcgtttccagtgcaattttataaacacagatggtccttaaattaagcaaatggtacctaaatgactgtgttgtggataatggtaacagagggagggactcgggggttttttaaaaagtactgattgtatgcagtgttttaaacagataactgtgatcttagtgtgatgaaagatgctgggagatttcaccagtggtatcttattatttttcggggattttgtaattcaacaaaattctgttgtatgccaagcataaccctaggtgtgagagcacaaggtgacttcagataccacctctatccttcaggggtttggggcccattattatgacttaatccattttgggcgtgagaagctgagggtcacagaaagaaccaattccctctttaaataatgccaccccaaccctcctcatctgccaggtctttcccttcttctatttgtatgaataatagtcactttctcttgtggagttcgctaaattctactttggcctatcaaatttctttcatatcacaactaaatttcttaaggacgggactatggttcatttgtcagacgaacaaatgggaatttgccaagagacacttgggttaatttacgtcttttccatccaagggcactatgttgaagtgaggctagtaggtcatgagtgtggttgaagttactttttcttactttcccgaccagcccccatccttactgcacttaaagttgattgtccattttattaaatgtccccaggaagccagaacacagggcagtaaagtgctgaatgcaaagggcaggagaaaaatggaaacaaccagaactgtaacaccaaggaatgagacctgcatgtcagatatcatgcccattgcactaagtgccattggggcacaattatcaaatggatgcattttccctagaaaaccatcttggagagcatgtggatgtacttctattttacatttccccctatttacaatcaatgagattgagattttgttgctgggactgctgatgatgggatgggaaaatataatcaaggtaatggacatgaggcaaaaatttaaggaaatgacaaaaacaagagtatttccattttcagttaagtgtatgtactgatgttctggaattcactataagaagttgcaaatggtgcatgaaatgaaaaattcctggtggtctccaggggacacagccggtgctgtgctccactctgggtaactgttttggattattttctctattccaactgaaataaaaaaaaattaattaaatgtggctaggttatcttgacagcagaatccattcccagttaattattattttaatacttgatggtgtctgtcaaattgtcgacatgtgacggtcctttcaaatttaaaggaatagctgatggtcactggccacccaagctgatactgattttatatgttgatgtttctcattttatttgctctttccttgaatatttattcaggacattctctaccagacatattgagtaagggcaacagaaacaatacataagtatcttataaatgtggaaaacaatgtatatgtgttttttatctctcaatgattggtgggtaccatatccccaaagtagaatgagcatttgagaaaacaggaaatatcctcttttaggcaccatctctgtcaaggctgatgctgggctttttatatattttctctaattcttgtggctgtcaaacaaggtgggcattatcattccctttataggggacacagctgtggctcagaggggtttattcactttcctgagggccacacacataatgagaggcagacacaggtgacgaagtgagttttccctgtcacgccatcttatctgtcacatacctctctgacatgctaaaattgcactaaacaaaagaattctcttatgcacatatcatgcaaaagatattctttaactggggatcatgtttctcattccatcaatagaatgactaacattttctgagggtgtctcacgtgaaagtaaatcgctcatgtttgttctttttaaaagatgcccttcgtattgtgtatcttgcagtcttgctttctcaaacttaagccaactatatcgtcatttttgcaaaatcactgcgtcagtttactattatttaatgtttattgctaccaattttaagaaatcctttataggactatttgtgaaattgattttgtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcgattcccctgccttagcctcctgagtagctgggactacaggcatgtgctaccacacccagctaattttttgtattttagtagagatggtttcaccatgttggcgaggatggtctcagtctcctgacctcgtgatccgcctgccttggccttccaaagtgctgggatatacattttttttttttttttgagagatggagtgtcactctgttgccgaggctggagtgtagtggcgcartctcggctcactgcaacctcctcctccggggttcaagcgattctcctgcctcagcctccccagtagctgggattacagtcgtgtgccaccacgcctggttagtttttgtatttttagtagagatgggtttcactgtgttggctaaggtggtctcaaactcatgacctcaagtgatccgcccgcttcagcctcccaaagtgctgggattacaggcgtcagccactgtgcccggccggatagaaataatttttataaactccttggatgctacctaaaatcatcttgttttgctagtggcacatgctgcattttgggcagctgtggccttggtggattgctgaagtagatttgaccttacctggactgaggcagctgttgaagggaattgctgtgttcagtgtatactgccatccatgatttcatgaaaccagctctagctatttaagcaggggtcaaacttagaattctacattatttttttcccttttctgggaggaaagacagttgaacaccagcaaagactaagaagtttcttagaagactgtgggtccttgggccctttctattgaatttcagagtatttccaaatactatgaagtcttgcagcttagttgagaaatgccccagatggtgtgacattctgcttccaggagggattggaaagtatttccttttacataacattccactcagctcattcctttgctgtgtctgaaattgaatcccccaaagccacaattatcttaacattcagaagagtgtttatttaatctgcaaaatcttgcctcacttttggggagcatgttaacaatttcacttacaaatcttctgtgtaactcaaccccatggtggtgtctactgctgctcctagactctttaaagcacctttctcatctcaggtttgaaatgatatgtctcattcttgggttccttgagtcgtaatgggtttgtcttgtctccacagcataaatgactctttcttgatcaactagaaccacatcaacttcttccctccagcttcagtgatatattgtgaaacatggctattcaacgtcctgtagaccaaatgccataagaaaaatagcattgattcaaacgtatccatccagatacctaaaaaagttttacttcttaccacatcttgagtctgggcaaacacgcacttcctatggacattgattactgtctactgtagagataacatttgcacatacagattatggcacatggtagaaagtgttaagtaatgtaggaatggacatatcccaagcaaaattggaagccaagtcccctgtccctgctcaagttggtatgactggtgtatggtgccttaatgggtacttaaagtccaggtgagagtggcaggaggcagccaaatgcctaggtagataggagccggtccctgttgaaaccccacttccaagttgaagacagtttaaagactgaaagccaagctacaagttaaatcctcggaccagattgagaacttgtcttcttacttggtgcactcttctgattgatccccacctttcacctattttacatattcctgcccttccctaactggtttcctatgctgtcatgcccacctttgagtgttgccttcactttaaccttctgtgcatgctcacaaagtaattagcatgtaycctccattctgagttaatataaggccccagacccagccacatggggcaactttactgccttcaggtaggggaaccacccccaccacattccctctccactgagagttttccttttagttaataaattcggctccactcactctccattgtctgcatgcctaattcttcctggttgtgagacaagcagttggacctagctgagctaaggagcagaaagactgtatcacagggaacttgtgtaacagcttgatctcctgtcctacgtagctatctattggtaagaagttgaaggaacttgtgtcattccgttgtgcctgtcgtcttgaccttgtaaaaggtcttgggtaagcatgcaagaagttttgaagagggagatacagctaatttgcagatraaragcaagggaagaattcctggagaaaggaagagtttcctgagtcacctttgggaggtaggaagggtttgacatgtaggctgggcatctgggaacgagtgagggattctgtgagccccatctyagtggaccactcaaggaaggtgggtaagccctgggtataagtgtgtaagcagggaacagaaagtactgtgatttaaaatatgttaatttttctactgtacagatgagagccagcttggagatgggctgtagctcaagyatcttacctacctctgatttcttaatgccacgttataaggctgctgcttatagctcttgaagtcactccaaaaacagatgagtgagaccctgttgctaaagtcccactgggtgtagattattcacagatgtatacacagtggctcactccaggtaggatgtgatcagtgcttttagaaatacagaaagtcctattggtttaaaaaaaatttttttttgtaatgaattgagttttaaagctagcactgtacaataaaagggtgaatttcactatgaattatgacaaacacagtcatagagctgccatcatcactgtcaagatacagaacagtgccatcaccccccaaatgtcctctgtgccttactgtagtcatacctgctcctgacacctagcccctgggaaccattgatcttttttctgtccctagttgtttgtcttctctgcaatgttacataaacagaaatattctgggtgtcgcttttggagtttggattccttcccatagcataatgcatgcagtatttgtctgtttctgctaaattacccccaagacctagcgacttaaaacagcaaacatacactatctcactctgttagttttccattgctgttgtaataaattaccacaaacttatgtgcttaaaacccaaagctattatctgacagctctgtaggttaaagatttgtcatggttctcattgggctaaaattaaggtgtcggtatggctctgctgctttctagagactccagggagaatatttttccttgccttttccagcttctaaaggtcacccacaacatcttcaaaaccagcactgttgcatctctgaccttagccctgtagtcccatttccctctagccacaatcgggaaaggatctcaggactgttgtgatgacactgtgcttacctagattatctagcatgagctccctgtctcaaggtgatagagtttgcatgtttttctcctgcacatgccatgttgaaacataatccctagtgttggcggtgggtgtgctgggaggtatttggatcatgggggtggaaccctcatgcatgacttacggccatccctttggtgataagtgagttcacatgatatctggcaccttccttcctctgttgctcttgccctcaccatgttagctgcctactccccttttgccttccgccatgactgtaagcctcctgaggcctcaccggaagccaagcacatgcttcttgtagagtctgcagaatcggagccaattaaatctcttttcattataaattatccagcctcagttacttctttattgcagtgcaagaatagcttaacacacaaggtcttacccttgatcacggtctgcagcatgtcttttaccatgtaaggtaatatgttcagtggctgtgggggttaggatgtggacttctttgggggacttttatttttcccagttactatttttgtgactcaggaatttagggacagtttggctggttgtttctggctcagggtctttcttgggctgcaatcaagatgtcagctgggggctgggcatggtggctcactcctgttatcacagcactttgggaggtcgaggtgagtggaccatttgaggttaggagtttgagaccaacctggccaacatggtgaaacgccatactaaaagtacaaaaattagttgggcatggtggcacatgcatgtaatcccagttagttggggggctaaggctggagaacagcttcaaaacaggaggcggaggttgtggtcaactgagatcacaccactgcactccagcctgggtgaaagagcaaggccccacctcaaaaaaaaaaaaaaaaaaaaaaagttagctggggccaaggtcatctcaagtcttgactatgaaaggacctaacatcatgcatggctgttggcagaggtcacttcctcatgagcattaaactgaaagctataattcctgactattgaccagaggcgaacctcagttccctgccatgtgggcctcttcatggggcagttgataacacagcagttagcttccattggattgagtaagcaagagagcaagaacaggagtgatacagaagccagcatctttttgtaaaccaatctcagaagaattgtccatgattttttctatattctgttagttagaaacaaattcctaggtctcacccacccttgaggtgaggggattacacaaaagtatgaaaaccaggaagcagggagcattgggagtcatttggaccctgcctaggacagtgcgtttgagatccatgttattctatccattagtagtagtttgcttctttttaatgttgagtaatatgccattgtgtgtttatatattgctaatggattttaaagagggctaatcaacgtgttgattagagggaaattttcttcagtgaaataatatttgagcaaaaccttgaagaacaattaggaatttgacagagggaatggcacgaataaagacccagacttaatcaagtgaggggcgtactcatccatggggcagtggatgattcacctgcctggagcttaaggagaagggggtgtagttgtggctgttgctcagaaggacctgaatgtcaggatgcatttgtgtttaatttagcagacatttaggaaccattaaaagtttttgagaatgggtaggtaagattagaatagtattttaataagtttaactaggctttaaccagtattcataaaaagtcaagtgggagaatgtagaggtgacaagaccaggtgtgggctattgcagtgactacacctaaaaggaacagagctagaaacatggagtgacatgaagtcattgtcttaggttggtgatcctagcagctgagcctgggatggggattcttgttcctatgatcgattaggggactgttcccagaggagagcggagagggaagcaggctttggtttctactggaaatctgtttccgcccgattccatggggagctctggagaaggaattgtatcaccgagttggtcctccttgtcaacagagcatgtgtgtgggggtgatgacttcccagatgtgagggtgccctccagcaatggacagttatctggaggagttcatgctccagaggtagtgcctacctctgtggagaagtaggggatggcacggtattttaggggttcctaatgagcctagagatactgacattgaccagtcatggagactaaaggagaagatgggatagcacattgttttcctaagtatttgtaatcaggtgactggtttgcaaatatcagccattacagaaataaagggtatcaggacggggaggagatgtgaggagagaagatgaagagtttagatttaggcatgttgaccctgaatttgtgggaaggtatccaggaagataagactgacaggtgggaatgagattctggaacttggaaagaatatagtggctagagctaagggtttgaagtcttcatggcgattttgttcggagtcatggatttggaagaaactgctgcagggaagattttagagatggaatgaaaagagattggtgatggaacaatgggcaaaagaggaagggttggaggagacaaaaaatggagtggtagtggcattgggaggtccaagagtggatggtatcacagaagccaagacaggaaagtgagccacaagtgagggaggagcaggatcctctgcaacagggcagtctagtcttagcagagaggaggttgctgaatttattgattgagaagccactcctcgccaggcagttttgagaggttctggatggtgatagaatggaattcattcagctgatgatgagaagtagatttgggtcagggaaggagactgaatggagatgaatatttcaaaactatagaccataaatgggaagagagagacgagtgcaacctgcctaggtcaagtgaatgtccttttttctcttcccagcccttgtcttttttaccctctttgttttctgcatttctttccttctgttctgatttttccttacctgatggtcagaaagatctgattgagctgacgcgtagcaagaatgagccagtggagaggaaaatgtaaccacctaatgggttctcctttcctgctagctggacagagctgatttatcaagacgggggtactgcaaatagagaaagaatttaatccacacagagccagctgtatgggaaaccagagttgtactactcaaatcaatctccccgagaattcagggatcggagtctttaaggagaaatgtggtggatagggagccagtgagtgatctgggagtgctgattgtctcacgtgtccatgtgaagagaccaccaaacagggtttgtgtgaacaacaaggctgtttatttcacctgggtgcaggtgggctgagtctgaaaaaggagtcagcaaagggtgatgggattgtcattagttcttagaggttttggcataggcggtagagttaggagcaatgtttttggggcagcgggtggatctcacaaagtacattctcaagggtggggagaattacaaagaaccttcttaaaggtggtggagattacaaagtacgttgatcagttaggtagggacagaagcaaatcacaatgggggaatgtcatcagttaaggctattttcacttcttttgtggatcttcagttgcttcaggccatctggatgcatacgagcaggtcactggggatatgatggcttagcctgggctcagaggcctgacactgatttgttggcttgaagatgaaatcacagggaatcaaaggtgccctcctgtgctgactcagttcctgggtgggggccaaaggactggttggcaggtctgcatggggccaccgtgttgtcagaaatgcaaaaatctggctggtgcaatggcttacccctgtaatcccagtactttgggaggctgaggttgtcaggcctctgagcccaagctgagccgtcataacccctgtgacctgcacatatacatccagatggcctgaagcaactgaagaactacaaaagaagtgaaatagccagttcttgccttaactgatgacattccatcagtgtgatttgttcctgccccaccctaactgatcagttgaccttgtgacattcctcttcctgaggcagtgagtctcaggagctcccccaccgagcaccttgtgacccccgcccctgcctgcaagacaaaaccccctttaactgtaattttccactacccacccaaatcctgtaaaactgccctacacctatttccctttgctgacccctttttcaaactccgtctgcctgcactcaggtgattaaaaagctttattgctcacacaaagcctgtttggtggtctcttcacatggacacgtgtaacagaggtgggcagatcacttgaggtcaggagttcaagaccagcctggccaacgtggtgaaaccctgcatctactaaaaatacaaaaattagctgggcatggtgctgtgcacctgtaatcccagctactcaggaggttgaggcacgaggatcacttaaacccaggaggaggagattgcagtgagccaattgcgccactgcactccagcctgcaatgcagagtgaaactgtcttaaaacaaacaaacaaacaaaaagcaaaaatctgaaaagacatctcaaaagccaatcttaggttctacaacagtgatgttatctgcatgaataattgagaaagttgcaaatcttgtgacctgaggaataacggctggtaattatttaaaactcaagcccctctcatcctaacgtggtggcctttcattcattttacaggaacagtttagttttgggggaaagctgttatttaaactataaacgaaatttctcccaaagttagcttggcccatgcccaggaatgaccaaagacagctaaccagttaccggaaacgggtcccaatctagaccccaagagagagttgttggatcttgggcaagaaagaatttggggtgagtctataaaattaaagtaactttataaagaaagtaaaagaataaaagaatggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagataataaaatagacttgagagtccagaaatgaatccatgcatattgtgaattgattttcagcaaggatgccaagacaattcaaaatagtcttttcaacagtgatgctagaaccactggatagccccatgcaaaagaatgagattagatcacacttgcataaactacacagcaaaaaatagcaaaaaaaaaaaaaaaaaaaaaaaaggggtcagagacttaaatgtaagagctaaaactatacaactcttagaagcaaacataggggtatatttttctgattttggcttagacaatgatttcttggatacaaccctgacagcacaagtgacaaaagaaaaaaagatatccagaatgatccagaatgaaaagtgtttgtgctgcaaatgataccatcacgaaagtgtacagatgacctacagaatgggggaaatacttacaaattaaatattaaataagggatttgtatctagaataaagamcttttacaattcaataatgaaaactcatttaaaaaatgagcataaratctaaatagatattcctccaaatatgatacacaaattgccaatgaatacataaaagatgttcaatctcattagggaaatgcaaatgaaagccacaatgagattccacttattgctaggatggctaaaataaaaaagtcagataacaaatacttacaaacacatggagagatgaaagttcaaatacagtcctggcggaaatgtaaaattgtatggccaaactggaaaacagtttggccattattcaaaaagttaaacattgaattaccatatgacccaataatcccactcctagatgtatcttgaagagaaatgaaaacatgcrtttccatagcatcttacaaatgaatgtacatagtagtgatattcctaatagccaataaatggaaacaatccaaatatccatcattggtgaatggataaacaaagcgtggtatattcatataatggaatattatttgcccattaaaaagaaatggattactgatatatgctacaacatggatgaaccctgcaaacatcatgccaagggacagaagccagtcacaaaagactacgtattgtatggttccatttagtatataaaatgtccggaataggcgaatctataggacagaaagtacactgatggtgttttgggaataagagtgtaggtrgatagagggtggctagtgattgctaagttttttttttttttttgagttaaaaaagtgctataawattagaatgtagttatggttgtacaattatttgagtatactaaaacagctgtacagtatacataggtagattttatggtatgtgcattatatttcagtaaagttctttaataaattagytaatgcttattgtagaaaagttggaaaataccaaaaaccataaacaggaaataggaaaaaaagtaatcctgactgtatatctggaaatcttttcgtggggtatggggtatgaatcacacatattaattttaatttcctgctttttcaattaaattgagaaagtttgggaacctctggcttaatcattatttatccacttctctgttgttggatgttagattgcttctagttcatatgtaattttataattttagttgacatgtcattatggattcttgggcataaacgtttatatgaattttgaatattaggaaataatcttggaagctatattagttttctaaagctattataacaaattaccacagatggagtgcctcaaaacaacagaattttactctcttacagtttcagagaccaaacatctgaaatcaagtggtttgcagcgttggctccttctggaggctggaaggagcatctgttccatgcctttctcctagcttcccatgactgccagccacccttggaatttcttggcttttatcttagtcagtctaatctctgcctctgtctttccatctccttctctgtgggtgttccttctccccttctgttttgtaaggataggcctgtcattggatttaaggcccaccttaatccaagatgatctcattttaagatgtgggacttaatcacatttgcgaagaccctttttccaaataaggtcgcattcacagatccctaccattcaactcactatggaagcaatgggatgggaggtaccattcaactcacagattcctaccattcaacccactataaagcagtggcatatgaaaaggatgggaggttgctatgggaatggtctgccccagatgcaggtaaaatggggaagcattttatatagaatggaaaaacaacagtaaagctggctaaaacttgatctgctttttacagtcatgtgctgacaattctaaacattatcaatgataaaatacttctccctcatgatattaactgtgcaatttttgctgcccctgctacatacatgctttattgcttggaaacaggattacttggtgaaataatgtgaatctttcaattctcatgatacatgttttcaacttaatatccagggtgcaggaatatatattcccaccaactttatacaagataatacaaatataatagtatgaataaatatgctaatttgatagaaaatattttaatatttactactagtgtagttggacgtgttaaatattgcaatggttatttgtaatctacctttataaaatttctaatgtctgccactgtttctgttagactcttaagaagatacgtgtttgtctcatagatttgtaagaactctttatatactaaaaatatggggcttctatatgattgcatatattcgtcacttttgttccactgttttagagagcagaagattttaatttctataaagatttttatgtttccctttattgcatgccaatgtttgttttttaaaaacttgtacgtcttaggctgcgatgtgaaaagtgtcttttttttgatttggaaacagagtcttgctctgatgcctgtagtggtatgatcatagctcattgcagcccttggaactcctgggctcaagtaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataccaccacacctggctaattttttttgtgttttgacagagatggggtttcaccatgttggtcaggctggtctcaaactcctgacctaaaatggtccacctgccttggcctcccaaagtgctgggattacaggcgtgagcccccgcgcctggccctgtgtcagcctttttaacagcataatttttcctttattagtcataactactttaagggctattttgatttacagacaaagtgagacttggatgaattaagaaagaattaatcaggtggttgaacctgagttccaactagggtgacaactcttcgcagattgcctgctgctgtcctggttttcacactgaaagttccgtatcctaataagcctctcatcctcagcaacggaggacagttgcccactcaaagccttgtgacattctagrgtatcctatttctacatggtgggaatctagaaracggagaaagaatttctcattcccgaaggagcatggattatccttggttgtagtgtttatgtccacatcacgtggattcccraaggagcatggattatccttggttgtagtgtttatgtccacatcacatggratattttatttttcaggcctcttcatgtgcttgtgtgcaacgcagcaacttttgctstaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcggtgggtttgaattgcatatttgttcacttatcccctttctcataccagctaatattcccccaaggctstcattctgaaaataattttcattagtcctgcttgagacatgtgggtggactcagcttggctcacttaatttttccaggtcttttttgttcgcctgtgattgtgggggactgtttagaaggactttctagagcaaggaagattgtttttacgactatacttcaagctcctcattgattttgcttagagatggaataataattgatgaaatctgaatggcatgacctttattgatttgtaattcaacaacttcaacatcttaccaagaagaatgtgcagttattctagcaggagaaacaatgcaattagagcctgcgagatgaaatcaaattgttttataatgagaaattagggaattcgaggcagacattagctgtgtaattgtggaaagggaagaactgtagttagagcatattagaaatctggccgtgcctcttttggttaaaatttcaattaaaacatcagatggcacttttttcctattgccattaggagaatattcaattgactgaaaaggacatttgaaaatttcctcgtattttcagcatatttgtttctagagttggagaaacaactatttgtctagagagaagtactctgaaaagacaaaggccttgctgggtgaggctggatttaatacatgttagggagatttctctttcacgtttgcttggtgtgtgtttggcggggggaacttacactcttagcaaagtagctagaaaaaaaaataacgtgcaaggggcctattttttcctccttcttctccgtcttaagtcctgaaatgttttagtgacccagaatgaagcttatttttttaatcatacttccataaaatgtaacccctgggacttggaagagagagaccagccaagggttagcttgaaccctttatcactcccaaacacaggggcttatggtataagtgacacactgcagatagatttacttttgccattttaaatttatgatggctgaaatgaaaggtaaatgccagtaataatcctcccccgtgttaaaagacatgaaacatctagtaattaggtggtaacaaaatctggacagccttatctttgcaaatcacaccaggtttgtgaaggaaagtggagtggccctgttaaggggcgagggaggctactgtgggggcaggcagcagagagagctccagaaataaatctgccagccccagtcatccaccagatgtggagggcaccacgggatatgtttaaatgagctggtatttaatgggagattatgtcgaattgtcagctgctcactctccttgtaaatctgtatctcaaatggtatttcgtgtgacgtctttgttctttgcttaactacggtgtaattcatgcctacttcagagatccaaatctcagcatcatttaaaagattagtttgaaaggaagggacttgggctcttgaattagacctatgttagtttatagggaggccttcctgaaatgtgttgtcaggcttgctcctgtgtgatggctggcactggttttatgctttccaattattctttgcacatcgttatttattattactgttattattatttgacatggagtcttgatctgttaccaggctgcagtgcagtggcatgatctcggctcaccacaacttcagactcccagggttaagcgattctcctgcctcagccttccaagtagctgggaccacaggcgcttgccaccacacctggctaatttttgtatttttagtagagacggggtttcaccatgttggccaggatggtctcgatctcttgaccttgtgatccgcctgccttggcttctcacagtgctgtgattacaggcgtgagccaccacgcccggcctctttgcacattatttaagggtgttttaacaaaatggcaatttccccaggctggcttgtgtattaccttcgcattgcatcccttggctcccatgagtgagcgtggtgacttggtgcgtaggtggtacgtgaagacagttgctcactacccaagaactcagggccctaaaccatgctgtaaaatgcaagtgctgatatctaattacctccatcaaccttggcagaatctcttcgttggagttaagaccccctgttaggggaaaaaagaaagtcctatgtttgcagaaaatattatactagactgctccaaggcaaaatatttattagccttcctgtgtcttcactgtgttttagttacttatctggaatctgagcaactgaattgagtttctgcatacctaaaatacatcatagtgaaatgagaagttgacttctttgctgtgaaaaaatttcagataacaattaaagtagaatgaaaagagcagagtgctggttgaacaaccctcaatggctgcagctgcatggagtgccaaattgccctcccccaccccacacacaaaatcacacatacacgcacgcacgcacacacacacacacggagtttctcagcttctgtgtagacagaatccagcctaattattttaggcgggaattttaaaaatcctcaataaaattgggcttggtagcacatgcctgtaatcctatctagtaagaggctgaggtgggaggatggcttgagcccaggagtttgaggttgcggtaagcgttgatcatgccactgcattccagcctgggtgacagagtgagaccccatctctaaaataaaaattaaaaattgtttaaaaaaaatgcagtataggccaggcacagtgtctcacgcctgtaatcccagcactcaagagttcgagatcagcctagccagcatggcgaaaccccatctctactaaaaatacaaaaattagccaggtgtggtggtgcacgcctgtaatcccagctatttgggaggctgaggcaggagaattgcttgaacttgggaggtggagattgcagtgagtggagattgcaccagtgcactccagcctgggtgacagagcaagaccctgtttcagaaaacaaaaacccaaaaagcaaaacccccacagtatatatagaaatacaagatttgtgrggggcgggggtccccctacaaagcaagtgttactgtccacagagcaaatgtcaatattttaatgtactagtaagggaaaattctattaagacataattgtttggctttgtcagtttgtcaacttgaaaatagagtcagcagcatctraagagttgttttactacctctggagctgagaggtgaacatagtcgtttttcaggaagccgtttctggctcagacagatmagaagctggcccacccttgccacttcctggaggactgtcagtgctagctaatgagactgtaaaagtggactatctgcccaggagacagygaggaaggaaatcaggggtcacccttayagsgaagggctctttgcagagagagtgcctgatacgtagcagctggtacttctccatcttgaaactgtccttcctggttttgtctaatttgtcatcatgggattcttttgacttgtttctagattagggatcaagaagaaatgactttctcctcttagacatttaattcacttagtgttccctagtcatgacatacttctgtgttatccttaaatactgaaacagggaccttattcttaacagtagaaaatcactgtgtatgatgatagtgtatacctgtaataccagctactcaggaagctgaggcaggaggatcccttgagctcaggagttgagattagcatgggcaacaaagcaagaccttgtctctaaaagaataagcagaaaccaaaagccctaaacatgaggaaattccacatgtaaacattaatggaaaacatagaagagttgaacctagtggtaaattttacctttagagcaatgcttgaaacaagggaaactgtcaaattctcatcatgggatttgtgttcctttgttttttttattaaggacttggtccttggattggaattccaaacccatgaccaaactgtaatcatctaattctgtattgagtccttactatgtgtcaggcactgtagtaagcaacactcaagaatcttacagtctactttccaagaattcacagtctagttttggaatcaggtgatcaattgacttacagtctggtatggtgatgacagaggagcaatgtacagatagaacagaaggatggcacagtgagccttttcaccaatcttggaaggccagtaatgtcagtgaacactaggaatggtgtcatggcctgggtcctgaagagtggatacttaatgtccatggaggcatgcatttttatctgccttgcatggcttctttcattctctccctgacttccacccaaaaaatcaccatgatatccagctgtggaagagttcattatggagagcttcctggaagaagtagtccctgaactgggttgggctaaacaaatatgccaagaagggtttctggaagcagttgacaaaagatgagtagagagagggagggggtggtgctatatttattccatacctttcagatactctctaaatccttgtccctgttgtctatgccatgtaggtagagttttcaagtcatgtcccataccttggatcattggattctcaactcagtagcacctttgtgtgacacctcttctgtaataccttattatgttgaaataaagttagcaaataacataacttacatgcacaaatatattttcaattcgatatgatagctttactgtaatgaaagaaaaaataactgaaacaaaatggcgtgtgtttcaacatgtaaatgcttgggccaggctacaggaaagatggggatgtatgtatccgtggatgaatcaccttgaatggactctcataaaaaagcccaccattaccaggtgtgtggtattgcagactccagcaccaccaaccttgagtgaagcctgactatattagtctgttctcatgctgctaagaaagacatacccgagaccgggtaatttataaaggaaacaggtttaatgggctcacagttacacatggctggggaggcctcacaatcatggcggaagatgaaggaagggcaaagggatgtcttacatgacatcaggcaacagagtatgtgcaggggaattctcatttataaaaccatcagatttcgtgagacttattcactaccatgagaacagtatgggagaaagcacccccatgattcacttatctccacctggctctgcccttgacacatgggggttattacaattcagtgtgagatttgggtggggacacagccgaaccgtatcagtcaccctccaaaaatcacacaaaatctgaaagtgcttttattcattctacatgtaaatagttgttgcactacccacctggaaattcagtggatgtttctaggctcagataattatccacaggcttttcatctccatgagtgtccactggggcattcttcattgagcaatacatcatgtgcattgcaagacatctgccatccctgctaccatcaccagcagtcatcacgacaaccagaagaaggccgtcatatattttcaaattgcctgctgagttccattgccttagacaattaagcttggaagtcagactcttcctgtggtttgggtactagaaaaaaggcagccaacaattcgtttcaaggtctcatttctgtatccttgatgacgtttctggccatcagctttgttgatgactttagagcagctatgtcatttaacactagaaattggatgtcaccgagtcctgtggaagggatatttaatttccattaaaacatgaatttcattctgcccttgccatgcttttcttggtcttagcccaacctgagctgctgatattaaggaatrataggataattccataattttcattttaccttttgctttttgttttccatagcagttatctagaggattcccattatgcttcttcattacccggtgcccagaatgaacttatagaagcagaatatgaggggtcctttgacaaacatgagactgtttagaaaattgcttttgtttgctgtgatccattttgtaagggaagtcactataatgttgttatttaagagaaagagacaaacggaaagaaacaaacagctggtgtttaacgactccgtcagacccaattataaagcatcaactagttacgttgatttgtgtacatccatgccatgggtatacttaaaaacattagattttgccagaactcatcttggctttgtttacatttttcttttaaacgtataagactattgatggtacctcaccaaggttataacccctttataatcattaatttttaatctagaaaagagtcttggagacaacaagactcatctataatttcttggatgctcaaatgaaaatatacaggactcaagcattagctaaaataatccaggaaagccctgtcaaaggttaggaatgtgatatctttctgtttccaaaagcagcagccctttattcaagacacttttctgtttaatttaattatctttgaacttcctgttgaaggttttgaaaaatatatgttagagggtggggagagagttcagtatgtcaggactgctacatttatgagtgtgggtctttattgaagtctctctttgtagccaatccttttttttttttttaatttttaaattttaaattcttacttttagatatgggggtctcactctgttgcccaggctagagttcagtggcacaatcatagctcactgcaacgttgacctcccaggctgaagcgatcctcctgcctcagccccccaagtagctgggaccacaggcatgtgccaaaatactcaactaattgtttattttttgtagacatggtgtctccctatgttgcctaagctggtcttgaactcctacactcaagcaatcctcccgcctcagcttcctaaagtgctgggattagaggcatgagccaccagacatgacctgtgtttatattgttaaatcaccattgtcaatcttgaaaggagactttgttttgatgtatgtaagattgagtttttactcatctctacatagtttcctcagattgcttttttttttttttgagaccgagtctagctctgtcacccaggctggagtgcagtggcacaatctttgctcactgcaacctctgcctcccatgtttcagtgattctcttgcttcagattcccgtgtacaggcatgccaccacacctggctaatttttgtatttttagtagagatggcattttgccatgttggccaggctggtcttgaactcccgacctcaggtgatccactcgtctaagactcccaaagtgctcggattacagatgtgagccactgcacccagcattccttagatttccaataaaaataaaaagctgtgtgggaagtcagaacttggttgcttcatgtcatatttcctatttttaagatttacagatattaacgactccttgggaaaastggacttcagtygcctctctscaacaaaaaacgactattgggcgatgctggcttataacaggtccaagctctgcaacatcctcttctccaacgagctgcaccgtcgcctctccccacrcggggtcacgtcgaacgcagtgcatcctggaaatatgatgtactccaacattcatcgcagctggtgggtgtacacactgctgtttaccttggcgaggcctttcaccaagtccatggtaagagaacagcttctggcgccgcaaacaccttgggtcytagagaaacctgcacacttgtgtstccacctttttacctcttgcgggcatgagtctggtctcagtaatmacattgtccagcccatcataaagggctcttgaacacattttcatcaactttaggttaagtctgtttgggtaaatgcgtcttggagggctgggtagaagatgtgggtttcagtatcatgttaagtatggctgaaagtccttatggaaatggtgatttttttgtttgtttggttttgttttttttggggttttttattcagaaactttgaaaatctattttgttgaatggagcacttgaaaactgctgttttgtgtcagtaggtaaacaacaaacattggtgactactgaattttcagcagatgtgattcctttgtttcacagaaaawctgtatctkwtgttctaaatttttttcttctaatgggtataatcctctgttggagagtcctttgatagctaggagtgtgttttcttctttactttcccaaagacaattttggatgaatcatggtactgtggttacatttggaagtgtttacaaaggtgataagatgtttttatagtttggtgttcatttatcgaccatattaagaaccttcttctatgaaatgsttttagtaggaagtaytttgaatgaagaaagcgtattttccacaatatatttggtagattatttttcaaaaccaaaggacttcaaaaatgtcttcctattagtggacaccagtattccagttacccaaacttaaaatctacttgacagaaatcacccttttcccaaacacatttgccttttagcgatatcacaggccttcacagttggacctaggatattaataaaacaaagcaaaacaacaacaaaagaagaactattgcaggcctattatcctccagctgatctcacgaccttggaaactgtctgctgccttctcttacactcattcccacctgccacccttaaccttcgtatttggggatgacttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccaccactatgcccggctaattttttgtatttttagtagagacggggtttcaccgttttagccgggatggtctcaatctcctgacctcgtgatccgcccgcctcggcctcccaaagtgctgggattacaggcgtgagccaccgcgcccggcctggggatgacttttaaaaccacatcaaaagtcttttgaagtgcttaggaggaggtaagtaagtatatcttttattctaatcacccaagtggtttttaggcagagtaaacagacatattccaagagtcgaatacttaggatcagtggcagtgaagtgaaaggacctacggagaatggtgttccatgccgcagggtgggattgatctctaggaagtaaatgaatgaaacttacctgtaggtggatcacagggttttgaaatctccccatcactttgctcccgatgactgcataagcgcagcctcttcatgaaagtttctttgaccatggttatgcctcatactttgttgtgtccttcagtttacatgaaaagaaggaatatggatctgaactgggtgccagtgccatttaaatgaggcatttaggaatggggagaggagagaggtggattcttccttattttctgctggcccagtgccttccgctttaacaagcccagtcaaccatcatttgtaatctttgggtcttgagtcatctcacttgtatttgatcattgatgtgttttaaggagctcggttcagtggcatcagagagttcgttttctccttcttccataaggtccctaatcagaggaacgggatgggaaagctttagagatgagtctgtgactatggaatttggtgaggggtgatataaccatcctgccatttgttgtagactcgaatggatgaggagtcattgatagaaaatagtggaaactgttattctgtggcctgatcccattgcttagggactctgtgccagggcatgtgggaaaagaaggaaggcaagttctgctaaaatataaagtcagggtaaacatttttatttattggagaagagttgattattatctaatatttaatataatatgcttaataaagtcagacttgaaagttggctggttggacctaacgggagtatctctaaaaaataccagcaaattaagttggatcggtgactgtatcatgatatcggagtgttagctgttttgggagtacgtgtgctcaggacttgggctgagtggaaaaccagagtatggggttagaaatggaggcagarggactaccatgtcggggaggatgcacaatgaattggacgaaggttgcaactcagtgagcaccgtacctgtagtgtgtcttagtaatagcagatgcccaacctccatgcctaactcctttgcctaccccaccagtgtgcagcagcctctgccgcaccctactgcagtctctcctatttccctggcaggagagctcagagactacttgtgaacaggcctcaatgcctatagcaaggcaaggcttgggagaaacaaatgtcctctgggagcagccttgggtaaaagattaactgcgcactgagctttagatccctgagtgagaaagctgtgggaaaatgagtgtgtagctcatgagagggtttggagaaaagtggtgacatcgcaaaaatcccaggttttgttgaagttgtctgtggaggggcactcatagaaagggcactggacgtgagcatttcccttgtagttgagatgggatttgacatgacttcctggtggtggcaagacaagaaagtggcaacctgggacagtggacctcacagctctcctgctaatggtgctgatggctaagctcagctcttacccttgaccactggaacaacttagacatgtcaccagctttctgascctgtctcattacgatgaaaattgtgatacaggttagtgtaaggaccgacaataatgcatataacatcaataatgatggatatagaatttctgcagttattataatctggctctccagtatggtagtcgtgggccacatgtggctattgagttctaaaaatgtggctaatagaactgaggaagtgaattttcaatttgattccatgtttgttaattcgaactgaaaaacaccacgtgtgccaagtggctgccatactggagagcgtggtcaaatgacatgcctagctcagtgcctttcgcatgggaggtatgcagtacttcctgccacgatggctgttactcttgtcgttgtgagcagtgccttggtcccgatgatgattctccaaaatgtaatctctgctgacagaacaagagtctgcaaattgggagtctggaaagggaagakaagggctttgtccctggccccaaagactcagggagaggtttactggccaggtagaaagggcgtccaggtgaagggaccctggttcagtgatctccaacctgcacgtctcatttgtgaggaagccgtagggtgtggactttycttgtttctgaccttgagtgattagaaaatagcagcttttatatgtcacaaatggactttagataagcatgaagatgacgaagactgtggaatatgtagctaagagtcttactaaaatcctctctagtgtatttatatatttaagcgtttggtagtacttttttagccatcagcgttctctatattaggttgatacagaagttattgaggtttttgccattgaaagtaatacgtcacttcatgcagaggtggaattggcgctctgagcttgcttgtcaaattcacaggcattcacttttctttcataaacatttaggactctgtatttaggagaggaatcactgtgaatgtagacctcgggttggtcattttcctagtaagatagaccagactgactggaaaagtcaccctcttgggctatcctgcrtatgtggctcggcattgcttccgtcaggataatgcatcagtttcttggacaaagggtgcatttctgctatttgaatgcagacatatttttggatataagccacgcagttgcatcccatttcttccgtaggtaaaggctgggtttctaattgtgattgagaagcttagcatagatgcaatgtccctatcaccagatggctagtgtgctctgccttgtctgccttttaccttagagagggtgcttccttctgacacgggtattgctggagtacacattctgttgcatgaggtcaggggagcaagaaatacaacccagacttgcgctcggaagccctgccttcatttcttctctgtagctggctcccttaagtattaaacagcagtattctaatatcaacgtcccttttttatttgctgtgacttgctgtgactacggtgattttagttacagtaattaggtcactcttcatggagtcgggctattttaagtgcctctttaaggaatattgttgcagatcagtaattttacaattggatgttcttgtgcaactttattaaatgtgatctgtcttttaaatgttgcccttttacagttacacatttctaattgttgctgtaaatgcattatcactttgaaattaattaatttttccattttggctgcctgcaatataataatcactaatgagaaactcacaggaatcaattctcagcacagcggcccctactggtaaagccatgtctctgcctccctcttcttcttcagatccagagaactggacaagtgtattggggcgtcctgggagggaagtgtttgtttcttcctcccttcaatttatggtgaaataaaaatcacagataaacttggaaagtgagttatttttaagtgtcgttctaaaaaagatgcaatatacttcaaatagctgcttctaaaatatgttaaaggaaactaacatttgctgagtactttctaataatgaagtcacatcatacgtgcattacatgtttattttcttgactctagagcattcttttatgcagttaaattactctaaaatgttttgcacctgcacgcattaatgtgtattgtttggtaagaactttcgagttggtgaaaaaatgtattgtattttagtatctatatttatatatacatattagtctatgggttttaattcacaaaaccaggtgttgtatctggtgcacataagggattttcaaggctaatcttgggtttttgcagttgtaaccatgtgtgatgactttagaatcctaccacacttccaaatagagatgcagattgaccattttcccagataccacgatgctttatgtatcagcatatattttcattaatttctcataatttctgttagaattaataattccaagttctacaatcttagaattattatctttattttgtaattgaaaagcacagaaacctcatgcagcgtgttcaagaaaatgatataccagccttgtaaactttcacttgctaattgcagctgcatttgctttgtccaatgcacggtaatgcccctggcatccatatctagttatgcagttatgcttcctttttaaaatgtttgacagcaccttcactgaaatgaatgctgccaccaccgccaaccccaccttttttttttccacataagctttcatttctggtaaatacatccttgccagagttcccaggtccaagccggtcctttgtggaccagtatgcagatttgaagttgagcactgtcacttgcctcttaggagtgttttgtgcaaccacatatttgtgttggcagataacagtagaaagaatatcatgtgttagggtagcaagagcttagcagatgttttagggaactgcattttcaaatcattttacattaaaaaatggcttacgtttatggaacttctgcgacgatcgggttacgtttcctgtgcccgtgtaaagccagtcatcgtgctgagttttaacggatgtgcagctaccctgctaatggatgggccggcaatgctggtcctgttgcaaagttataaattataactagaaaaagcacaagatgtcattcttctaaccttcgtgaaagccaaacggggtaattctgcccttgaataacccgctgcagggtgatttatagttgtacaatttaaaacgtaatgaaggagataatagatgttgatttgttcctgaaattagtattttagaaaaatacttctccccctttccatctttaaatacctgcagctgactacactatagatactatcaagggcaaagccccctgtttgaatgtgtattggtacattggtgtatcacatacaaggcagagggtgtataaaacaggctttctgttgcgagggggaaatatggttttcaaagtggaaatttcattgtattcttcatgaatctaaacattttgagactcctgagtgaggtttgaattttctggttgcctttctcttgccagtccagatatgttagaaaactggactctcaggacccctctgtggttggaccacactggcgctttcctgcagttgtctgtcaacagaaggacctggtagctggcttgtcctcttacaccactgaggccaccttcttgcaggaagaaacatacttcttcctgccctggattaacattaccattggttttagtagtcttacgtcattatgtccaaagcttttaagtttacagtgcttgcttagtccagygaccaatggatgtaagtaagttggaaaaggrcaaaggatttagaatcatgagggttgtattcaaactgcagcctctrctcccttttagttacataattttgaaatcatttgacatttctgaggttaattttctacatcagtttagctgctttaggccgcaagttattaacacccacttaaaggtggctgaaataatagaggttttgcttcccatgtatccagagttgctgaggcagcaagggttgtgtttggctactatatgagtagctcctttgtgataatctttacttttccctcatgcttacaagatggcttctgtggtgccagccattgcatcctatttgataaggtctgaaggcacagatgggagggatgaggctcctcattgcatgcctttttcctttatcaagagacagagcattctgcttcagaactgtcctcctgagttgacttcccgtcagatcccactggttgggactgagtcatctgtttgtatcctagttataaaggagactagaaaagtgcataactggctttttgagcctctagagtggcaggcgaactctgattttgaggaaaaaggatagggtaatggtgttgacacaggcactgttgaatacgtatgtacatattttaatagttttctcattaatcaaatggaaatgctatcgattttataggrtcgttgtgagaagaagtgagaattgaaatgaaaggcatctagtcttccccggtccccatccacttgacccaccatacctcaagccacttctggctccatgctctttctttccttagggttttgaaacatgttcttcagcctagaatactcctcctccactcttaatttctacccatcctgcaaaactcagtctgaacagcacacgtcaaggaagcagttttggtctctcagattatatgaagctctccaatatgttctttcagaacagccagtgcctagaatactgcctgactcstagtagcactccttatgtgttgaatgagtaaatgaagagtccctggaatttcttcttcataacattgaacacaactgcagtttgaaaacataatttctgtagttttttttttttctttttttttgagacggagtgtctctccgttgcccggattggagtgtagtggcacaatcccggctcactgcaacctccgcgcctccccagttcaagcaattctcctgcctcagcctcccaagtagctgggattacaagcactggccaccaaacccagctaatttatatatttttagtagaagcggggtttcaacatgttggccaggctggtctcaaactcctgacctcaggtgatccacctgccttggccttccaaagtgtggtgggattccaggcatgagccactgtgcctggcctgtagtttctttttcttttttcttttcttttcttttttttgagatgaagtcttgctctgtcacctaggctggaatgcagtggtgcaatcttggctcactgcagcctccgcctcccaggttcaagcgattctcctgtgtcagcctcctgagtagctgagattacaggtgtgcaccaccacgcacggctgatgtttgtatttttagtagagaygggatttcaacatgttggccaagctcgtctcaaacctgcctcagcctcccaaagtgctgggattacagatgtgagccactgcacccagcctgtagtktsttatttaatgtctgtccccccttctcttgacagtggtgtttttgccttcacactactgtatccctggtccatacmgtaaatkttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtyccccaggctcatggtcaaatgacatgtaagggacgtatccagyggtgtgggtatgtttggagggaatgaatgtaaggagagagaggtgaggcacaggagagacaggatgagctttagaggtagacagctctcgggtccagccctagctctctcccattctaactcttgggcaaggttcaaaacctgattaagattcatgcataaaactgagatgttagaactacctcatgggcttgtcttgagaattaaagacgttatgaacttaaggcctctacagtgtgctagatgcttaagaaatgttaactactattgttattggcttgcagtagaaattaaagattatgaatgttcagcattcagaatatactagatactcaataascattattgctgtcattattaacattattttccccagctttactgaggtatgagtgacaaaaatttcatatatgcgcatgagtgtgtgtgtgtgtgtgtgtgtgtgtgtgtggctgggcatggtggctcttgcctataatcctaacagttgaggaggccaagctgggaggatgacttgagcctgggagttggaggctgcagtgagctatgatggtgcccctgcactccatcctgggtgacatagtgagaccctatctctaaaggaaaaaaaaaattatatgtattcgtggtgtgaaatgtgatgttttgatattcatatgcattgtgaaatgactaccacaatcaagctaattaacacatcggtcaacttacatagctatcattttttgtgtgtggcaagaacattgaaagtctagtctcagcaattttcaagtatataatacgttattattattactatcgttaactgtattcaccatgctgtacaatagatctccagaatgtattcattctgtctaactgaaacttaggatcctttgaccactatctccccatttatcaccccctcccacttccccactaccagcccctcctgggaactgccctctactctctgcttctgtgagtttgactgctttaaattccacacaaaaagtgagatcatagagtatttgtctttctgcgcctggcttattttacgataaattgattgcttctcttcccattgtttatagatacccattctcgtaatgatggcactgtgtctgtcatagaaggcctaattctccctgttaacattgaacataaaaacctcatatgggccaggcacagtggctcatacctgaaatcccagcactttgggaggctgaggcggatgaatcacctgaggttgggagttcgagaccagcctggtcaacattgcgaaattctgtctctactaaaaagatacaaaaaaattggctggctggtcatggtggctcatgcctgtaatcccagcactttgggaggccgagccgggcgaatcacgaggtcaggagattgagaccatcctagctaacatggtgaaaccctgtctctaccaaaaatacaaaaaaattagccaggcgtggtggtggggcscggtcgtgggtgcctgtagtcccagctactcaggaggctaaggcaggagaatggcgtgaacccgggaggtggaggttgcagtgagccaagatcgcaccactgcactccagcctgcgtgacagagcgagactccatctcaaaaaaaaaaaaaaaaaaaaaaggctgtgtgtggtgactcgtgtctattgtcccasctacttgggaggctgagacatgaaaatcacwtgaacctgggaggtggaggttgcagtgagctgacatcgcatcactgcactccagcctgggtgacagagtgagactgaaaaacaaaaaaacaaaaaaaaacccaaaactatatgtgcaagcctcaggaaccactaagacagattacacaatgctcatcagaactcagcaggcttccacagtgcagattttaagccctccagttgcctgttttactggcaccaagaacacaccttagcttggaggaaacattggccactttcttgttaaaaacaaagagagggaaactagatctgcctttgtgaggctggagcacctcatcaatgtattttttctgccttgctttatagtgttttaaatccgcctcggcctttgttcctgaatgagcacccgagaaggggagaaagtgactmtctggccttagtatgtgtaacaaattatttaatgaacatttaaccaagatttgcaattcccctagttttatcttcccggtttccttttcttctgtgtgcccgttggcattttggtaatgtgctgcctctttataactctttgtagctcttttattacttttcttttttcttttaagtttgtggtgccttctttgatcctcccctctttcagtttccttttctccaatttcatacttatttccagtgatttttggctgcaacgcagtttagatattggaggccagcgtgattaaaccgaggccaagagtttgtattgccccatgacgatgtttctggaatgtttcttctgtgaacagtgatttttgtataactcactggacatgttgatttttccctgtgaggtgtaaggtaatgttttcctagcaaaaacaaagagggctgaaacctggtgctcagaatcgtttggaaacggaactcctctccctcttctttttacaccaagataaagaaatactttgcaaatcagctgagcacatgttcccagctccgtgccgggctctgtggtcatgggtttccttctttatgtcttactcatctaatgtaattttagagtgtgttctctttagataattgtgtgtctctgagcaaatcacttatcctctctggtcctcagttttcttatctgtaaaatgaatcagttaaccaagaatagccatcccttgggttaatagaacagtttaacttgaaaggaaataaaaaaaggagactaacatgggcccacagacattgtatttcataaattttggatgaaaactgaacctaccatcatktattaagagaatggatattttcatgtcagaaattataggaaggatacagttatgggatgaggagcaattcttttttttttttttttgaggtgsagtctcaytctgtcaccaggctagagtgcagtggggcgatctcggctcactgcaaacctctgcctcccgggttcaagcaattctcctgcctcagactcccgagtagctaggactacaggcgcgtgccaccacacccrgctaattttttgtattcttagtagagacgaggtttcacggtgttagccaggatggtctcgatctcctgacctcatgatccacccgcctcggcctcccaaagtgctggaattacaggcgtgagccaccgcacccggcctatgaggagcagttctttcaatggaatatatttgacttcagggagaactcactcaaatgctgctgttactgtttttccctttgttggaagtgatggggttgtacttggaatgactggcctagaaaaccctacaggtaccatttaagctccatagttcttctgtgtgtgtttcggatcccaggttccaaacctgctctaaaacttgttgctgcatctcacctaatcgtgtagtgagccaggtgagctcatctgtgaaatgcagacctttctggacgtaccacctcgtggggtgaagggaaagaaatgatacaggtgtacatcagggtataagctgtcctagagtctggattctttttatccagaagccattctttcagcctgtgcctttttgtaaataccataccccatctatttccacaaaggatttggggcattagsgagtaaagggggaatatgttctagaagaagggcgctcacctcagtaaattgatgggtgggccacaaaaatcatgtcacaagatcttgttgatgtgcatgcattcattcattcaacaaatattattgagcatctaacataagccgggtgctttgctaggkacagaatgctgtacaaggtccctgtcctcatggggaccgtatgttgggaagacagatgataggcatggaaatgaagagacaaaccactccgacttcagcccaggaaggagctttaatttgagtaattgttttcactaattcatcttcacagaaagaaataatatgatcaccttcggttagtaaacaaaacaaataggcaaacaggtttacaggctgaggtgggctggatcacttgaggccgggagtttgaaaccagcctagctaacacggtgaaacccttctctactaaaaatacaaaaatattatctgggtgtggtggagctttcctgtagtcccagctactctagaggctgaagcatgagaatcacttgaacccaggaggtggaggttgccatgagcagagatcgtgccactgtactccagcctgggtgatggagcaaggctctgtcttggggcggggggcagggcaggggaggggggaaagaagagaaacagctttacttacgtttttgatgagcctagcctttgctgtgctttggaaaatgggctgtggaatttggctgaaatagtcaaatgcgtagctggctgtatgtggactgataactgggcttattttgcttcttttagatctggaaagactaagcgcaaaatagaaatgctaatggtattgatgtgtttttcttcctttggtgtgataaaaaggtatcagtagggatcattcataaaactagttagtaaactatcagtttaatgtacaatggtgaagaaatacatacatcatacttgagaccatgttccagagagtattttgtaacctgtgacgctcttttcaagtcttagagaggaagtatggaaagagcatgcgcttttgactgaggaggtcttgggtttaaaggtcraattttgccacttactttctccatggccttggtcaacatcctgaagtctcaggtccttgtctgcctttgctttgacacgagatgttgcctgcctcaggcggttgttgcaaggactaaaatcaggaaggcctggaaagacttggaagcatttctgtcacatcccaggaactccgtaaatgccagcaagtgttagattattgtgatgattttactactcctattattgatattataattaatattataattgttcattattaccttataaaaattacttatgatatgtttttcttactatttggtgaacatcgagtatagtaccaagtgtatacttttttttttttttttttttttttgaggtggaatctcctctgtctcccaggctggaatgcagtggcattttctcggctcactgcagcctccgcctcccaagttcaagccattctccartctcagcctcctcagtrgctgggattacaggcatgtgctactacmcccggcaaacttttatatttttagtagagacagagttttgccatgttcaccaggctggacatgaacttctgacctcaagggatccacctaccttggcctcccaaagtgctgggatgacaggtgtgagccactgccaattatatacttattttaggtgtattatgctgtgccctgtgcttttctttgttatactggaaggtcatgatggcaggatgtcttatttatgcttctctgtactctgtcctgtccagtgcctttcagaagtaaggtttttagaaaggtttgagttatttcctgttttctgaaccagacaggcagagtatttgatcttacaaaaatctggctcagttcaagttagctgtgtagctttggaacggaccctggacagatggattttctaaaattacagaggaaactagatctgtaactctgtacatttactcctgtgccagtaacaatggcaatattttaatactgwaataaattttttcttatgcatttgctataaattagtaaatctgtgtaaagctgcttattgcatcatcatgtagaatttctacatcctgcagaagtttaagaaaattgtcttccttttacagacaaggacactgaagtttagaagtgctaagtaaactgtcttagatcacttagctagcaagtgacagggatggaattgaatctgtatttatcagaggtgaaagtatatgtgtaattattcaactacacttaggtaaatatccgcatacatgcatgcctccccttagactccattgttccaaaaggtaatgacaacaaaaattagtcggaggcggaaggaaatgcaaaagtggacatttactcgagaaagaataaagaaaccatgcaggattccatttcacaaacctctacagctgttgctggggagtcagtggaggggtactggaggaaggcagactttgttctaagctacttagcagccaaggaaagcagaagaaactattattattatttattattattatgtgagttggagtctccttgtgtcatccaggctgaagtgcagtggcatagtctctgctttctacaacgtccacctcctgggtttaatcgatcctcctgcctcagcctcccaagtagctgggattacaggcacccaccactacatccagctgacttttgtatttttagtggagacagggtttcaccatactggcccagctggtcttgaactcctgacctcaagtgatctgcctgcctcagcctcccgatgtgttgggattacaggtgtgaaccactgcttctggcctagaaactattattaatagaagttctgggacaacggccctgctctcattacttgcccccaatccatgcaatgaaatactggcctgtgagtatgtggtcccttcagctcattttctgaagctgaccaaaggagcacagtaatgcataacgggggagtaaaattcctcaagacgagcaaaaaaggcagaaattaataaaactctatgtattagttatctatcactgcataacaagttacctcaatatttagcaggttaatacaatgcacattcattattttatagcctttgtagattaggaaccagccattgcttagctggaccatctgctttagagtctcacaggctgcattcaaggtgtccactgggctggggtcaacttcttaccgacaaagctggtgccccaaaagaatggggtcttatcctgttgggtgtcatgaagccaacacacaaaaccgaaagtagtgtcaagyagtacaggctttattcaatggccatggaattgagaagcaggagcatggctcacaaattcacaaatcagcttctccactaatgaggggtgrggaagttaaaatatagactttgttgttgktgctgttttaatgaagaggctggacattaaaatcaaggggaggaataatcatgtcttctcttgaaatgggcagtgaacttcccggaaccagagtgttgccttcctttttatccttttatggctgcttctgatcattgtcatggtgattgtcaactgtcttggcgctggtgagggggctgtttagcatggaaataggattataatgacacctgaggtctttttgaagtccttgggtcggctatcttgcttctaacaaatctcagctggtctggttacagagggaactttttatcacaggtgtcctgtttcttaaagataagcagtgttattacagggtagaaattcacctatgtcaagtaggcattataccaggtaacaatctcaagactcagcagggaaggatccacttgcaagcccacgtgsttgctggtaggactcagttccttatggcccagtggattgaaggcttcctttcctgcctggtgtttggttccttgccacgtagggatctccatcatggctgctggctttatcgaagcatgtaagccaagaaggaaatagaatccattggtaaaatgaaagtcacagttctttgtaatgtaaccacggaagtgacgtcttactgcttttgccatattctttttgttagaaggaaatcactgagtctgatcgttgttaaaggggaaaggatttcacagtggtatgaatcctgagaggcaggggtgatcagggccagctaccacactctacaacttgaattttgttttagatttcagtgccttttggggaccctgctacattgtggtagatttactcacaggacttgatgatttttcttgacctgcctgaagccatagcatttattacggataagtttgtcttttcttcgttctttttctgtttgcatcctttcgtcatccttttcttccctctttctggactgagagaggcaccaaatgcacccatttaaaacatatatgcatttctgctttctgatgggaggtaagatttagtcatttaataagaaagcttatgaaaagaataaacaaactggtagataatgtatcctaaagtcaagtatttgctttcatgttgctttagtagaaggggcccttgttaatcgatggcccaaattgtctttctcaagaaatgtgtattgcagaatttggatttgagttacaaaaactagccagaaagcgtgaactttttttttttttaagccataaagcttggtaaggctagccaatcatttcaaagcctgtgtagaatatctagactatwtgtaatcctaggatttgttgttgttttgttatgattttttttaagcaggaagctwaaaaaaataaccacccgttactttgctgcttttagaaaataggtttgagattgattttgaatactaaagtatagttttcatgttataaagccaaccatgttaaaaatgtataataaagtatctaatttagcaaaattcaaatttcccctatgaaatatcaagctctttttatgcttcttcacatggcaccttgtgtagaatttgaaccactttaaacattgcatccttgagttgcatatgatgggatctcttgaatcatttacattttgaaaaaagaaagtgaaatattctttaagaagccaaagtamtccacgagaatgtatggtgtttgttcagctggatatcttatttatttgaagtactgagagagaaatcttttctgactgctcaaaacagggaataataaacagtcagagtgtccaagtaatctgagctagaaagttccttctttcagagaaaagttataaaaagtatwtttgccggatccaaaaaaaatactgtgtatsaactmctgagacctgcataatgttttcttagtattctcactctttaaaagaaaaaagaaaacctgtaaaatttgggaacttaaactttttttgatattttaatatttctaggcaggtgagtgcaataagtctgttttttgatcttagaacataacatttcttgttggctattgtgtgtgctatgtgtatgatttgtctctttgttaattctctataaatataaaagagcaagtaatgaaattaccatggctgaattctgaatattaacccagagcagatttcctctaagaaagatcataagaagatgcttaaaagaaaacattatatttcaaaagaattaggttctgaaatatacccaataatgaaaacaatacaattttcttctgctttttgtccttcctgttccaagcactgggaaggagctggcatatttcttatgtatgaaaagtagaataatatattggattcctttatccctaacccggaagagtctttcttggactgtggtttgctttcccgttatacttaagcttgtttattgcatcttccgatgtcacattatctcattgccaagctaaaggctctgttgggttcttagttgaacccagagtggaggccgatttcatccaaagccattttttttaaaattagaaattaaactcacctttggcaagtcctcctgaccagggatgggtcctcatgttagtctgtaatgtgaagatatgaaatgtatttgatacaataggagattcactgtgattttcactgaatgagtatacattctgcagaactagaagataaagataataaaacaattcacatttcttaggactaatttattttccacagtccactaccaacatggtgggatggggaggagctgagaagagcatatttggctgagtttggttgcagaaggatgcaatgtgaggtagcagaaggggctgtaagaacacaggattttgaagttgaagaaaccagcctggaatgaatcccagcccttccttttagtgacctgctggccagccacattacctccttgggctttggattttctttttcactgtaaaatggggaaagtagctcccacatctttgggctgttggtgggaggtgtgcaggacacagctgaaacctttggtgtatagtggatactaaagcaatgctagtcttcttcgtgtgctaccagttagaatgaattttrctgacatcttactggtttctgagggtatacagacacttattgtcaaagatattattgattatctgatccccaaacatatggagttacatcacagcaggtgagaaatacccttcaactcttgattctaaggaaaatccttggggagccgccatcattccttccacgaaggaatgaaattataacgtaatgtattgttggagcccttagttcaacactgtcttttttcaggycatattaatgsaatggttagcatatcaacttccttctgtttttagtgactctaatacattatattcaccttgttctctgcatgttctttctttaagtcatgttagatcccttttttggaagcaggtcaaatttgaattaataaaatgatttatgttgaagtacaggcatatcccacagaatctcttaataccaggccaaaagtaactttatcttgatctgtagttcggacatatttcttggattgtccgcactcawaaaaagagattgcgtaacaccctttgaacaaatggatatttgagaaccatcctgtcttcagatttagattttttcaatttttttttactgtcatatgattcacatgctagttactgattgctatcatgcagtctgccagcagaccagatggcagatcttttaattagatatgtttgtgtgtgtatgcatgtgtgtgtacatgtaatcacagttcatcaaggacctaataaatacttttttctctctctctctttttttttttttttttttgagacggagtcttattctgttgcccaggctggagtgcagtggcggatcttggctcattgcaacctctgactcccaggttcaagggactctcttgcctcagcctcccgagtagctgggactgtaggcatgcactaccacacctggctaattattatgtttttaatagagactaggttttaccatgttggccaggctggtatcgaattcctgacctccatgtgatcggcctgccttggcctcccgaagtgctgggattacaggcatgaaccactgtgcctagccttaataaatacgtatttatgtctttcgatctttttctgtttttctacattccgtttcccctatggctgctattgttttccagtgagctatttatatatatatatacatatttttgagagggaatcttactctgttgcccaggctaaagtaccatgtcaagattatggctcactgcagcctcatgagcctcaaccttcttggcctaagtgatcctcctctctcagcctcccgagtagtttggattacaggcacctgccttcatgcctggataattttttgtatttttgtgaagacgggtttcatcatgttggccaggctgcagctatttatatcttatatgtgtatttgtaaaaaatttattcctcagccctgtgtggtagctcacttctgtaatcctagcactttgggaggctgaggtgggaggattacctaaggtcaggagtttgataatagcctggccaatatggtgagaccctgtctgtactaaaagtacagaaattagttgggcatggtagcggtgcctgtaatcccagctgcttgggaggctgaggcaggaaaatcgtttgaacccgagaggtggaggtggcagtgagtggagatcacgccacagcacttcagcctgggcgcatgagcgagactatgtctcaaaaaaaaaaaaaaaatttcttattcagttgatttaagatggtttataaagacaacatgagctagcggtagaaatgcgaatggacgcttgtagacagtaaggactcaatacgtgggtttgttcaagttatattgtgcagacaggcatatgcagttagaaaatctgtctagggtagggagagataaaaccagctacttcagccctgctatttttatcctgaagattttttttttactctgtttatgaataaaacattttaatcagtgctgtatcaacactgatcaatttttttcatggaagtgtaatacagggtgaattccattaagtcaattaaatacttagatccagtttttaaacagtgcgaagatagttaagctcttcttttattgaaagcctttttaccaaaaccatttttttttattttatagtgaagatttcatgtatctgttttctgtacatgccaagttttacagctttttgtatcatgagttttcttttgcatcaattatttctaccaagtccaacttgtagattgggcagatctggatttcaccacacctggtttttgttgtcattgagtttttgtgatggggtgatttcagtgagaaatatatgccattaatttgatgaaaaatcagtatttatttattaactaatacccaagaaattccccagcaagcctcttccagtattctagagtttctcgtttcttgaggattggtctccgggcatactcctaatctaattgtttcccaaactttcaatgttttggatgactttggaagccttgatttctgtaggctgtagcaggacaaattctgatggacagatcaagatgttctatgttgctctaaaacagcatctctcaaacttttttggaccactatctaagttttttctgttaaaacccaatacatttatacttatgtatattcgtgtgtgtgtgtgtgtgtgtattatatgcatgtgtgtgtatttgtctgaaataaaagttttacaaaatgatacttttatctgagcagtgtcctgctgttttttttcccctaggttgtgtttttgtgtttttgtttgtttgtttgtttctttgtttgtttttgagacagaatttcacttttgttgcccaggctgcagtgcaatggcacgatctctgctgaccccaagctccgcttcccaggatcaagcgattctcctgcctcagcctcttgagtagctgggattacaggcatgcgccaccatacctggggaatttttttttgtatttttagcaaggttgttgatcaggctggtctcgaactctcaacgtcaggtgatccatcctcctcagcctcccaaagtgctgggattgcaggcttgagccaccgtgcccacctgtgttttttgttttgtttttgtgtatgtgccaatgatgacccagtttcaataccaactgttgctttcaccacccactattggtttcaccaccccgctagatcacagtctgttctttggcagtcactgccccaatactgtttgatgtgctcccctctgataaatgttcattgagtgccccacatgtcaggtactgacttaaggcatagcaaatgcaaaaatgagcaaggtgttctcttggctctatgggtgcctaccttagaaggatggagatgggaagaatgtgaaagggaggtgagatgagcagcactgggatgtgtggcttttctgtcttgaggatagatagaagaggagtcagataaagttgcagaacagagatgacgtctttactgagacttgaatgatgtgtcggaggcaaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggygtggtggctcatgcctgtgatyccagcattttgggaggccaaggtggacggatcaccagagttcaggagttygagaccagcctggccaaaatggtgaaatgccatctctactaaaaacmcaaaaattagctgggtgtgtggtagtgtgtgcctgtagtcccagctactctggatgctgaggcacgagaattgcttgaacctgggagtaggaggctgcagtaagctgagatcatgccactgcactccagcctgggttaacasagcaagactctgtctcaaaaaaaaaaaaaaaaaaaaaaaaawtcaaaattgatgcaaaaaatatgataacatttcaaaatttaaatcaagacaaattcaatattatagcaaaggttcaagtaatgaacatgaatttgtaatgatgcctgggggaggtgaaggttaaaaaaaaaaaaaaggccaccaaggacctcatgttaaagttgatgatgacggaagtgagcagtgatgatgagatttaaaaaactaacttttatttttacattattttaactagtatttgtgttaacattattttaatctcctgtgcacttaagggagctggcataggccggcagtggctataggccaggacctgtgctatgtagcttatctatttctcatgctgattctacttttgttactaccgaaggagcttagagggaatcagtgacgtggacaaggctatgtaactaaagggggtggaggaggattcaagccccttgcaacggactgaagtgcccaagctctaaatccctgccacccacagcctctgttggccccaggttgtgtctgarattcaraggttgtttttatagcagcaacacagtaagttgggaagagggacacatttttaacatagacaccaaaagagaggctggaaragttgaccacttaraaatgtcacgagtgtctgtgaatagtgttgggggctgagaggcaagagaagaaaatagtcctaatgttgtacaagtagcaatggaaacaaacttgttaaaaaaaatttaattttgtttatgcatgtgtgcataaacaaagcaatagaaaatatttgatatttaagattgagcacttaacaaaatactttgtctctttttggtttgctgtcttaagcaatagccttaaattcttgtcccagggatacctgatagagctaatatagaacaatattttaacataatttgaagtatttttttcttctgatgggtatgtagttcatttttataaaaaaatttaaaaattctgaatctgtggtgtttctgaaacatcctgatatattttttgttgatgactcttaacaaaggatgtaagacagattctaagaagagaaaaggtagaatatccacatgtctcagtttcataatatgtgtaaaaattatcatgcccattcattatttaaagtgctgtggctttttagtgaataccaacattaacaaaccatgttaacaygatttaaaatatgtaatgaaatttgcaatgcatcagatgatggaactatcaaattagttcacgtggcgttggctgatcacccttatgaagagttacttgcattgtttgaagagggaagatgcacatccccttgtgggctggcagcatttttgctaacactgccttaaatgatgctactggcaggatggttaatttgatgttgaaatgtcacacaatatgtgcccaccctacgatttgaatcttctgtgccgttaagggaattggcagtgttcagacagaatggtaacattctctctgatcgtgtctgtgtctgcacccttttttgttttgtttctgttgtcttcattaatagacctttcaggaaccttcctgggatctcagataacagttcttctggaacaggattatccagaggtagcaaaagctctcctgcaaatattccattgcacgactttaaataaagcagcaagaagtcttttcattcagttcagatttgctacttgttctcttggttccttcaaagtaatgactaagtacaggtctttagatagagagctgcaccaaccaggtattgcttcgtgtcttccacgtacgtcctgagaaagcgaaggtgaatttcaccaattggtaggtggaaatagaaaaactgttgattctttttttcattcaccaatcttttttttccccaaatgctaagctttatttggggaaatcttaacagccgtttttataagactctgcatttacaacatttgtgggggctgcagaggacgcacatgaaaataacatgaactggccatgtacggtggctcatgcctgtaatcccagcactttgggaggccgaggcaggtggatcacctgaggtcaggagttcgagaccagcttggccaacatggtgaaacctcatctctactaaaaatacaaaaattatagctgggcgtggtggcgggcgcctgtagtcccagctacttgggaggctgaggcaggagaatggcctgatcccgggaggcggagctttcagtgagccaagatcgccctactgcactccagcctgagcgtgagactctgactcaaaaaaaaaaaaaaaaaaattagctgggcgtagtggcaggtgcctgtaatcacagctatccrgaggctgaggcaccagaactgcctgaacctgggaggcggaggttgcagtgagccaagatggtgccactgcactccagcctgggtgacaaaaaaaaaactttacctgggcttagtaagttgcctgacttctcatcctggagttcgkatccccttgtttctagaagagaaatccctcagatgtgaaggtgtgttccatgattttgycgaacttgccctacatactgttttattatatattctgcccacttctattccctgccaattaattaattgtttcattggtatagtttttttttttttttttttgatacagggtcttactgtgttattcaggctagagtacagtggcgtgatcacagctcactgcagtcttgacctcccaggctcaagcaatcctctggcctcagcctcccaagtagctgggactattggcaatgccaccatgttcggctaatgtttttrattttttatagagacaaggtttccctatgttgcccaggctggtctggaactcctgtgctcaagccatcctcccacctcagtctcacaaagtgctgggattacaggtacaagccaccatgtcaggccattggtataccattgtttttcttaaacatttatttattttcttatatttacagcatatgtggtcatttaaaattattttatagcatataaaastaaaaagaatataaattaattttttagcattaatattagggaagataatctgacatttaaaaatacatgtctatatgtgtatacatacatagaagtatatatataaatacmagtactagtgtctgctaataggtggcgccactttttatctgtgtgtgttgggggtggaatkagcatgtagaggttggcaaaggggacaggagactgtgggatgattagtatattcttatttggcctgggagggaaaaaaartctttcatttccaacaatattcwttctctgtgtcacctcagcatttaatttacttccgtcacaaaactacttgaagttgtcccaggctagttggtcctattaattacaacctagagggattctattartaaactaatggattacagtacctaaatggaagccagcagatgactttggaaggactgatccgcaagggccttctgtgtgaagattaaatgaagcttcctttagccttctcaggtggccacagtttcccataaccttagagattatctaggccaaggctattaatttagagattaagaagccaaacccagaaaggttgaaagactgtcgtaagttcacactgaaagagagtggtgtaatgcccttttcaccaggctccaagaaatttgcctattttatgttttaacggacatggtatccccagcatttttaataaatgcccttttcttgcataagtaactggatatttccgagtggcctacaagtggagcgtgatttcatctttcatcaagagaagcagcttttcctcctcttgtatccgttttcttccttttctaactatcaaggtcatgcggtatstgccattttgcatattcttgctttgcttcatgttttccttaaactctgtgcacatgaatatttgtggtatatggcttaattgtaagcgatcaggcatcaatggctttttatgaggcaaaatctactttctrcatttgcgtgtgccattattatagattgctgatgtttgccaatggatattcttggaagtcgtcttctggtttaaatgcagttaagtatttaaaaataataccagtgacatgtttgcatttacattcagcctgaaggcctacttgatgctgcaactgaaaaattgttagactagattttattttattttaattctttttgagacagggtcttagtctgtcacccaggctgctggagtgcagtggtgcaatcatggctcactgcagtcttgaccaccctggctcaggtgatcctcccacctcagcctcccgggtagttagggctacaggcacacgccagcacacccagctaattttttgtattatttatagagttgggtttttcaccatgttgttcaggctagtgttgaactcctgggctcaagcaatccgcccacctcggcctcccaaagtgctgggattacaggcatgagccactgtacctggactccactatgccttcccctccccttycctcccttccccaccctaaagagtctcgctcttttccccaggctggagtgcagtggcactatctgggctcactgcaacctgtgcctcccggattcaagagattcttgtgcctcagccttccaagtagctggttttgcaggcatgcaccaccacacccagctagtttttctatttttagtagagrcggagtttcaccawgttggccaggttgttctcaractactgacctctcctcggccttgcaaagtgctgggattataggtaccccgcctggctgatactttccttagttgttttcagtgtaataacctgtcttcagtctactytwtgtccttttctctcctttcctccctgaatactcaagcttccagtgcacagatttctccaaccctgaatgtgactgataccaacaccatactagctcttccacagatgcctgtttgttttgcagaacactggcctgaatgactcagacttggagcttgaaagagggagaactgatgtggcctgtggcagacgtgtccaatgacctgctgtgtccttgcttttgaagaactaaagagtagacttgaccactttttaaacatgacattcgatccacgtggcatagcaaggatgggatccacaagatggagtgatctttacgccatcctcctgaccataaatactaaaygaatactctatttcagttgagtttttagtttgctctgttacgtgaggacacatcacttgcacctcagtgtgagtttgaaagtgttttctctggagaataattctgaagaaataggccctccagatatcrgtagtgacagggstatcagtaatgttgattactaagttcttgccacaggtagaagccatgctactgcacaagtttcatacttgaagagtggacatctgacacagtgttggtggttgttgaagtgtatgactwttactgtgttgctttggaagcttgatgccataacaaaagtgcagaattccatgtttgataactttctgacttgatgaaaatgaattgtggatacagatttcactatccatgaattgtggccttaactttctcatgtacttactttaaatcagagagcccacctgtccaattctagcttctcctgggcatyctgtatttgacacagcccctcccagcattctgagtcaycgtctgctgctcttgcactgtccgttttccaaatgaggaactcatcggtaaggccagaaaggaaagggagaaaaaacaaacaaacaaacaaacaaaaaataggaaaaaaagaaagagcgtatttatagatggtagagaattctgggcatgagaaacccagccaaacaagtrgaatgtgtgcataggtgggactgctgatcttgttttatgaaagaaataaaggcaagtcaaacagatcctttcgcaaggatccccatgtgtgtatgtctaacccagtgacaggtaaggcagccaggagctgctgttatttcagtgcaaagctgttttcacaatcacagacatgcacagctcaraaaccctcacaggtcacgcctgaataccttcaatgtgccccatgtaaaaatacactgcaagtcgattggacatgccctatgaattataccttatttatgatcgtcgagccctcccttttcccgtcatgctttagaattatgggctggagcagtttttaatactctatttattttaggggaggaaaatgtttttctttaaccacaacattcatgcaataccaactgctggcagtttccccagcatttaaggaaatattgttgtaagacttttatgttctgtacttcaatcagctagagccagcagtatcccaatggaaggaccctcaacagaccattttcagcattttgctacaattaaactcctctggttttagccctcaggcaatttagtacctttttacatatgcacattatgaacttttgaccagggtctagcagtcatatattagaatgctgctcttgaaggcaggcttaacaagttcctctgagtattacagttggagtcagttgtggaaaaggtaatttaagcaacttgcagcgaggccattcagaatctcagcgatgatcctaaatatctttctctcttgctcacgctcttttttttttttcttgtttcctctggaagctggtagcaggagctttcaaagtctgtgattgatcttttattcagtagctaacgagggctgtgattctattagcgcactacaaggcaagagaacagtgatttaatgaagtgtctagtgagccggccatagatttatcctgttgtcgctaatttgcagcgcacttgccagcataaaggaaactgcactcacactgctattaagcaggtatttccttagtaaattgttgtaaggtcaggtacagttatctgagcaaaagcaatgccttacctcttcagtgtctgcaaatgacagccgccgtgctgagcgctcactgaagtggaaccgggagatcagaggtccgtctccaagtcgcccttagcggaggcaggagcagatgaactgccaagtaggagtaatagagtcataattggtgattagaactggaaaggtgcaataacatcttaatacaaactggcgtatgttatagttactgtcagttgttgtaaactcgtcctgccgcctggactagttacgcttcccttgattagctctgagaaacraggcagcgggcactggggcagccacatagacaacatcyaaatttttgttgctttcctgggtcttgccctgtccttactgtttcccttgggcacgctgttcaccccttaggacatactacagtaaccttttcccaccaccgtgggaggactgtgattttgtaaatgtcytctgatctctcctctttgcaggcgcagtgacatttatgcacactggctttgaggctcattgatcttttgttttatttgcctttgctgaggcaggggcaggtctttgtttcatgtcagatccgtatcccactgcaattctgtgttactgtaggagatttggggttggcatgccagagtgaaaacgcgaaagaaaataaacaggcagcactgaggaattatacacttgagcttggcatttttcttaacgcagggctattttaggtgcactgcgcatgttggaggtgcccttgcaggtataggtaggcattgtccatccrtggtaaaaagcaatagaagaaattcttacccgatgcttaatgaattgccaggctggttaaaaaggataacccttgaaacctagggtgtccaactgctaatttatatagactggagatatttccatgcctcgcagcaaaatttttctttaaattcacagaagcagcagctatccagcattgtccarttgtgctgagtagctgtcattattgataaacatgtaactggtcatttgtattgttttgagtaggatatggcttatcaggatgcatagtagagaaaaatgagatgaggtaatgagatcacatacactgaagcatcttacgaatctggcacatagtaggttctcaataaatcttttttgattctgtgactgttagaatctgttggctgatactctgtcatctggctctcactctgctccataaaacttgggtaattctaatgcttacttcatcccagggctgatgtgtgttaggttagggtttatgatcaagtaaagagtttaaagaagtgttttatgagggagttytgtttgcaaatgatcacctggtaatttaagagggtgagctaaacttcctcmttttctagtatggacctttggggctcaggatgaggatgttcamtttgtactgctggtggagctgcctttccattaagtgagtctttctccaagggaacagaagtcttaggttgttgatctggckgtcagaacctaggacaggcaaggcagtgggctgttgtagagkagatgaagctgatcagagcacacccacaccagtgacaaccggtcaggacctgggaagggctctgacccattcatctgagagatgtggcatgaggaacactgagacctaatgcttattgcttaatattgtggacaagggactctgtgggttgtctagtactaagcagaatggaagggaaggatggaaggaagagagggagagacggagggagatggaggatgacagggagatggagggaggcaaaaagaaaaagggagaagkawagagaggaragaggggaagggaggaaggaaagaagagagagaaggaggaagagaggraagkaggcacagaggtagagaggcagggagataatggagatcctggccaaaagttaatgctccgtttctagtagtccacagaaagcaccttgaccaagtgactgaatacaaatcgtatcacaaactactaggatttcttgggtgcttaccatgtgccatatttccttgaatcttcatgacgatccttcaagggatccttgttttctaaagggtaaaggtgcaggttagaggctatgtcagaagcaagtcaggatttgaaggcagatctgtctgcttttgcccctctgtaaatccagagctgctgcctcatttcttacrttgcccccacccrtgcagcaattcttcctgggaggcctcattgttcatattcataaagggccccattcagtctcctttttggagaaatggccactgcaactctctgttctgacctggggggaaatgttagaccctcaataaggagaatcagagaaagaagaaataaaacatattactccattcccatacttctgtgaagaaatacccgagactgggtaatttataaagaraaagagatttactgaactcagtcgtttcacctggctggggaggcctcaaaattatggcagaaggcaaaggaggagcaaaggcacatcttacatggcagcagacmagaaagcgtgtgcaggggaactgccctttataaaatcaccagatctcatgagatttattcactatcaagggaacagcacaggcagatcccatggctttgactcagttacctcccactgggtccctaccatgacacatgggarttctgggaactacagttcaagatgagatttgggtggggacacagacaaattgtatcatagaatcataaaaattgctatttctaaggcagatgaataatcctggttggaaatcatactgatttagacttaaaaccattcagccttctttaccatttctgaatgtggccctgagggaggatttgtcttttgctattttctttttttaagagatggggtcttgttgtgttgcccaggccactctccaactcctaagctcaagcagtccgcctgcatcggcctcccgaagtgctgggattacaggtgtgagccaccacacccagcctgggggagggtttgttaaagaactgtctgttttatcacatgaccacaagttaaaatgttgggcaatgtccctgaatgataycttttcattagtractcacatggacccataatctctgaatttaacatgcttttcaggaatgtgttcatattttccacctataaaacctgttttagtaatttactcccttgtaaatgttccttggtatgtaaatttagcatatttccttttaattgcccaggtaaataatacccaccatcagagggcaccagtagtgtaatcaccttattttttaaaatgtattctgtgtttcatgattttttctgaataactgatctttacagtctgaattgcattctgttgggcttgacttatttttaaattaaaagagactaacacattaaacactaagaggtcacataggatattccatttatataaaatatgcagagtaggcaaattcataaagacagaatacgcatcggtggtttctggggcggcggggagtakggaaagcctgttaatgagtacawgtttctttagttttttttggttttttgttttttttttgagacggagtcttgctctgttgcccaggctggagtgcagtggcaccatctctgctcactgcaagctccgcctcccaggttaatgccattctcctgcctcagccttcctagtagctgggactataggtgcccgccaccatgcttggctaattttttgtgtttttagtagagacggggtttcatcgtgttacccaggatggtctcgatctcctgaccttttgatcagcctgccttggcctcccaaagtgctgggattacaggcgtgagccattgcacccggctattgggtacaagtttcctttggggtggtgaaactgttttggaactagaggtgatagctctacaacactgtcaatgtactaaatgacactaaattgtacactttgaaataatttatgttatgtgaatttcatctcagcaaaaagaggctaacacataaggagacatattttgatacatgtggcatattaagctgctgytgttgttttttaaatattccagctgcgtgcagtggctcacacctgtaatcccagcactttgggaggctgaggtgggtggatcacttgaggtcaggagttcgagatcagcctggccaacatggtgaaaccctgtctctactrtaaactccgtctctactataaatacaaaaattagccaggcttggcgctgggtttctgtaatcccagctacttaggaggctgagacaggagaatcacttgaacccgagaggcagaggttgcagtgagccgatatctcacctctgcactccagcgtgggcaacagagcgagactccgtctcaaaaaaaaaagcacaaaaaatttttttcttccatctgtatcacacagttgcaacgttgtagcatgggcaggaaataattgggttgtatgtaatgcccagtaaagtaaacagatcttagagagggacaccgatccctaccctgcatggggttattcacagagccatggggacactaaacgtaccttatctcttgaccatgcyattgattagttatgtgtttgcctgtgttattaataatgtatacattgaaaaatctatgtgcattatagtctttgatcttgtcatgaatttcaaagccaaagattccattttccttctttttaaaaaaaatttttcaaagaggtaggctggaagtaaatttaaaaattttcccctttctggcagagggcttttttctgatcaccacccatgttaattagatatgcatgtatgtgtatgtatgatgtatatacccatatacacwcagtctrtatatacwtgtatgcgcacatacacatattttaaggaragaattataaaatgatcaattcaagcttactatatgctagaggtgaggaatatttgaatacaagtcttatctagtagattaaaacagaaattaaagactgtagactaaggcaggatcaaaggacctcttttcattgttcttttattgtttattgacttcaaaaaagactttttagtttaaactgactgtaatgtctcttgaatggtcttttgtaaaatgactttgaaaactcggggataatgtcttcattaagtggagaaaaatcttggggaaaatataactgtaacttggctttcattagagtagaaagagataaagctttgcttaattaatgtctgttttccctctgttcagaagtataaggaaaaaggggactgaaattagtgctgataaaagcttgaattagacattatagcactgaaacttctttttcttccttacttagaatttggaagaacatacttcatacaaagctatgaagcatattggaagattttaggtgccctgtcttcctggatataaaatgactccaaactcagtgatactgatcaccctggcttcttttccacctttctcacttcattgtctttttgtgtgtttctgacatctgttgacaaatgggcaatcttggggatggggggttccactggtatattttctttactgtttaagaaagctcaaaattctctctgctcttttccaagccaccaatcaaaactgacattttctaagtgtcctcattgccctctgggaatgttcatggcctctgggagtccaagaactacctttacactggatcttcactgcttttactattgtgtggctttctaccagttctctgctcagcttctcttttctggagacctgatatgctttgttagcttagcatgctgttctaggctgcctttcttttttttttttttttttaaacttcatggtgagcagaacactgtactccagactgtgaggccccacctgtgcagcctgctggcttctcataccagcttccttctcaccttaaccccacgtattgttgcaacggcaaaaaagagaattgcacagaggaacaccacctatcagagttcacactgagtttgcagattcatccttttgcttccagccatcccatggaatgctgttcttggaagggtcatctcatggtccattgtcggccctcttagaagagatttcaggccttcccttgtagcttgatagttacagggagtgctagggtaagtggaaaaagcacatgacttggaataaagacttagtacacatcccatgtctgatttatactaactagttcatggacctagcctacgttactgcacctgtttgagcctcagttttcctgtctgcaaaggagggatgatggtacttacctcaaagaattgtagttggatcaaatgagttggagtgggatacagcaacaatctatattctgatttcagcaacactgtgcagtgtaattccatattatattayaccacatcttctgtgggtctttctttgggggaagctaacattttaaaaggtttccctttgtaacctgtaaccccctctaccccaaaagtatattcaagagcgaaacttttggtatgacgatgtcttacatcagtagttctgaatgacttgacttagctatctttcttgagtctctcaaaagacagatggatggatagattgattttgttgtaacacctgttcagttttgctggccttactcgttttcaaatactcaaatgccattgagtcagatttcagaggcaaatggtgatacctcaggtttgaagttgcaagaagtcaccacatgcttrttatggaaatcgtcagggatatttattccctctcctgagaagcataattgagcctccaaaccacccatcaagatatccacctgtaaaatatttaagaactggtactatgaagacatttcccttatgcaatttgttttccatctaagagcagaacaaggaaaatatagctgactataagttacaaaggcasactcttaagctacaaaatacatctcttcacaggagcacttggagaagggctgaaggcaaaccaaaagtgagcaacaaggagactagtgttctgaaacagagatgacaggctccgcagtgagggtgatgatggtgttacgaattacccattcagtttaaactagacattccctggaagcatgtcatggggtgtgcagaagggcttttggataaaaggggtctagttaagagatgttaaaaaaacaaacttgaaaagcatagcaggctgccaggacatgtctgagtaccgcgcagatagtggggaatagtctatggattctgcttacaccatggacarccaggctgggccatgggttgtgttttttttcctctcattttatagaaatgttaccaggcatattttccctgtttccctaagaagagcttcctctcagtgctagccagccacagggccaagtgacacctagaggtgatcctttggttatttgctaaacagatctaagacaaaccgatatctgtaacctgggattagatagagccaataagatgtaactgaaattctcagggattctaagacatctacattgtatgttggtacgttattgaaggtgatgctagctgctataacaaataagcacgcctgtgcacagttgctcaaagatagtagaagtttatttcttgtttatrtaagatccataatgactcttgccaattagcaggctgctctcttccaagtggtaacccagggactcaagctcttttcatcttgtggctcagccrtctgacacatgtggcttccagcactgccctgctgttgtctgcacaaagctggtggaagaagtaggaatttgcaggaccatgtgtggagcattttaaggatgaggcctgggagtggcacaaatctttgaactccaggaggctaggaaacagagcataaccttgtgcccaggaagatgcggggcatagtacatctttgcctcacctgatgtattgtttgtttaaaatcactttggattctcatttaccttttccccctcaagatctttgtttttgactttggagataaccagaaataactaagcatgcttcsttccctctacgatttcatcctcatggggaagcaagaccccactcttttattttcatgtatgtatatatgtatgtatgcatgtatgtatgtatgtttgagacagaatcttgctctgtcgcccaggctggagtgcaatggcaccatcttgacttactgaaacctcctcctcctggattcaagccattctcctgcctcagcctcccaagtagctgggattacaggcacgccaccacacctggctaatttttgtatttttagtagagatgggggtttcaccatgtgggccaggctggtcttgaactcctgacctcaggtgatygacctacctcggcctcccaaagtgctgggattacagtcatgagtcaccatgcccgaccagcaagaccccactgctattgtccagtgtggtaggtacctttgcctaccttctactctacaggctggaacaggtgatattgtgcctacttcacagccttcctagcaactgaggatggctgtatgacagattctagccatcaagtaaaatcagaaaccaacagcacgtttccttgaataccttttgctttctataaaatggtgtggcattgctggtattttcactcttccttcctaccctggatgctgatttgatgcttccagccttagcggtyttcttgcttctaggactgaacagggaagagggaaaagtcaaaagaatgacagaaggtcctcacgttgcagaacactgaccaatgttggcaactacaagacaatcaggcgtgattcttcatccaggatctgcttttccctgtcctgccaattcttgagctgctaataaacattctgatgcaaacatggaatacagatttcagagggattctgggtagccctcggagatgaggatgctttgcgaatgtaacaggcatctctcacctcatttgtctggtggaatgtttacaaatgctaattaagttttgcttcaaatggggaacagtcctgtgcagtgtttctaggaagttaccagcttcatcataggaagacgttctccatcgtttggatctttttcaccagcaccttttgrttgtggtggtttgggatgtgatgatctcagaactttacatcctccatgaaatctctgcagcgatagttgaatgtcttgccttttctattattgccctttttcttctgtgactttgtactgagacacatttatattagggtaatggcctcatgctatttgaaaatctttatttgggccacattggttggaagataaaaatatataagcaatagtccctgaacatcatttggcctgaactaggctagagtttctcttaatcaaaataataacgatgatttttccatgccaaggagtggtgtcrtatcatgaagtagatttatgtacacattaaataaacttttacattttaatgtaccaatttgcaatttttttttctattcaccaaaatattccagataacggttatcagtttttgattctacacatacttcaaatactattaatgcaaaatccttctttagaaatgttacctaattccaatgtttcactttattcagcgaagacattcctttgattattctggttaggtgttatgatgccaatttgcccacacattttttcttaggcgcctatgcttgcagtagacagagagttgaggaaagctcaaggttaaaacaggaaaaagtaacacagtaaatacctatttttgtgcataattcaaattaaaaccccaaccacctagaagcaccaatacaaggaactggctgcatattgcattcctgtgacctgctgtcttaatgatggaatgactaacgaggatcagagggaatgtggtcagcctcttatctcataagccaaatgctgcatattccaagcctgtcaattctgaaagcccttgttcatttttaaataatgaaaaactttggggccttgttcattgtttctaaaggaagacatttagaaaatttagaatataaatttctgttagtagaaactaatttctcttgcttttctctaaagtatacttgatttgaaatatgtgccctgaagttttgctatgttgaaaaaaatgatgagccgggcacagtggctcacgcctgtaatcccagcactttggaaggccaaggcgggtggatcacctgaggtcaggagtttgagaccagcctgaccaacatgttgaaaccgtttctctactgaaaatacaaaaattagccaggaatggtggtacacagctgtagtcccagctacttgggaggctgaggcaggagaatcgcttgaacccgggaagtggaggttgcagtgagccgagatcttgccattgttctccagcctgggcgacaagagtgaaactccatctcaaaaaaaaaaaaaaaaaaaaaaraattatgtcatttcgttgtcacagcgtcagcagaataaatcttagatcaagatgggattactgcgccactcccttcttcccagtctgtggtttagcacgggaaaaagcaaactagggcccttgggccaaatctgatctgcagcctgtttttgtgccgcctgcaggagaacatttttaaattgctgaaaaaatatgaaaggaaaaatatttcaaggtgtgtgaaaactacatgaagtttaaacttgagtgtccttaagtaaagttttataggaacacagtgttgcttatcttttatgtaatgtttgtttgctttgagaccgagtctcactctgtcacccaggctagagtgcagtggtgcgttctctgctcactgcggcctgcatctcccacgttcaagcgattgtcctgcctcagcctcccaagtggcttggagtatagacacgtggcaccacgcctgggtaatttttgtagttttagtggagacaggatttcaccatgttggccaggctagtcttgaactcctgacctcaastgatagacccacctcagcctcccaaagtgctaggattacagacatgagccgacctttttatgtattgttgatacagtatgacaagggaagagttaactgattgcagcaggttagagcacagcatgaagagctgacaatattgaccgactggccctctcagacaaagtttgccaacacccaggtgagcagatayacttatctgtgagcagacgtgattcaggggagattgttgtccctcctttcctaagaaaatgtggaaagatgagaatgttgccaccagtgctgatatggagcgttttttttggaattgtcttaaacaagtcccaaccttgactttgcctgtgtaccctactctttactcccaggtctttgcaaggtaagctgtcaggtgttagctgaagatacggcagcccaccagtggtcccctgaatgccaacaagagtcacctctaagatgatccagctgttgcatggtgtagcatgcctagtccttgcagcacacacgctgccattcttcttcgccgttgttaccgtattaatttagggatgatgagaaagtggcctccctttccctgttaattccttggaggaacttctgttcgaaatgaatagtcttgaaatatgtcataaagttacctatcaggaccacttttacagagatttaaatgtgataataagaataaaagaaaatgaagtgacattgaggacgtcttcttttataacagctctaggtcttgcctgttaagcacgctgtaaaatgactgttacacgtttatggattgaaatggttctgctgaaattttaagtgttaacattgttcaaattttcattactaacacctctcacattgttagaaaacagtttyatgtttgacattttgatcatactaacctgggacattttatgctaaagttctcatttcatgccttaggaatcccctgcttattttgatttcagcacctttctgtaggacgccaatagcttatgtttgcacatcttaccccgatgcactctctaaaccgatcatcacagaagatattttgtagtgatgaagaaagcttaaatgtctcatttgtcagattggtttaggtagaaaataaggatttccaccccytcatcgtggttcccttttagattttcttgtttgcttttctttaaagctgctgttactcaaacgacagtccgtaaactgcactttattttttataacagctttattgagagataatttacatgctatacaattcatgcatttaaagtgtacaattcaatggctcagtctattcagagttgtgcaaccattgccacagtcagttttcttacctgaaggagaaagcctgcaccccatattttttacctcccattctccacttcaactcttccccagcctctgcgaaccgctagtctgctcttcatctccatgcgtttgtatattctggacatttctcattaatgggctcacacgatatgtggttctttgtgagtggtcctttcactttgcatgcatcatgttttcaagatactgcacctaatttttcagttccttgttttttcttacaaatacatttttcaaaatgagtaaacatatgtacaaaaatatttaatttatttaggcacgccaggtttatgagattcatctttgtagccaccaagagccactaacagtgctaacatagccaggcattctaaatgtgtttgtcaggtgcataaatctgtgactgataaaaccactgctcattacttggttcttaaactctccctcaatatagctgtagggacatgcaaaacaaaggctggctcattaataggatatgtctagagttctgctttagaaatcataatgtggacatcattgatttctctgatgctggaagctgctgctgcttcttcatctttatcttctcctccctgtgtattgagagcagggacctccttgtgctgttttgggctctccttgttcacccagattggctgcatcagcaccttcttaaaatattagtgttgctgagataggagcttttggtagatggataaactgggatttgtaaatattttgcttagtttttttcccagagttttgcagaagagaataaggtgttggtttgttataaggtggtcctttataaagtttagacctattttaataaggctgacttgggttgaagataactagagccatgacttycatcttgatggacaatgagtactcactctacttttttaktttatatttttattttagttcatttcatttaagacagcgtctgttacccaggctggagtgcagtgacatgatctcrgctcactgcaacctacaccttctgggttcaagtgattctgatgtctcagcctccccagtagctgggattacaggcatgtgccaccacaccggctaattttatgcatttttagtagagacgcgtttcaccatgttagccaggctggtcttgaactcctgaattcaaatgatctgcccacctcaacctcccaaaatgctgcgattacattttaaaactctaccttttaaaaattagaacctggacaaagaggtattaaagaatgtgtctcttattaatttattatggtaatgagaagagtttggatttggacctacctaggtttttctttcctccagctccgccaccccaactccttactcatgcttcctctgtaaaatgatcactccccagtttgacaggaattgcccctggaatcccatctggtgttctaattgttaccaaatycaggcaaatcttgcctgtgatacaggtggtgaagctactggatagaactggagcatctaactggtgtgagatggtatctcattgtggttttgatttgcatttctctgatggccagtgatgatgagcattgtttcatgtgtctgttggctgcataaatgtcttcttttgagaagtgtctgatcatatccttcgcccacttgggtsgatgaagctggaaaccatcattctcagcaaactgtygcaaggacaaaaaaccaaacaccgcatgttctcactcataggtgggaattgaacaatgagaacagttggacacaggaaggggaacatcacacaccggggcctgttgtggggtgcggggaggggagagggatagcattaggagatatacctaatgtaaatgacgagttaatgggtgcagcacaccaacacagcacatgtctacatatgtaacaaacctgcacgttgtgcacatgtaccctagaactgaaaatataataaaaaatacatattaaaaaaaaaagaactggagcatcgactttcgttttcatttcaagacccgtcccccatgaycacagaggatgaaaagtctgcttaaattataagctagctaattgcttcttcagttgaagacctaaatgagttttaaagtgaaatgcatatctctaagggctaagtagccaacacaataggcaattgagataggaaagactaatttagaaaaggttgttttgttcgtttttctttttccttccctcccttcctgatttcccatcttcttcctccctcttctctcccctctcccccttctcctttccgtccttcctccttcagttccctctttcctctttttcrcccttttatttaacattataaatacgatgggattgtgtctgcgcttttgttggtaattaaataaattatttatacatttaacacaatcttgaattaccaggtgatcatcttaggcactcaaaagcataagagcccttgaaagcaatatctaagcatagatattccatagcacgtcttacaatctaaatattgcttttagtgtaatcgaagcagcaagagtagtcacagcagttgatggactatttttcaaattgatttcaaaaatgtatttaaggggatgatcttctagtctagattacctattgatttttaatatgaaaagctcattatgtaagcagtaaccgcatataaaaacctagcaaacctttgcataaatcctttaattgaatttccagagcctgtggttctactttttttttaattaaatctatttctttttttaagtgttactgtgtaatttgcatgctgtgaagaggccctgtcccagataaagtgccattgatccttattaaacctcacctctgggcttgcttaaaactaactggaaaaattaaagtgttcatgccgcaatgcacttatagcttgtgtgataggattatggaaaaaataataaaactaatttccaggggagaatttctaatgtgagattttattttttttcaatttgataattaatagtgaaatcatatcatatatataaatcatattttagcctataaactgaaatggcaattaggaaagataatatatacttgatgtaaaaccatgttacgtgcggataatcttttagcactttaattttttaattgtagaaggagagaattatgaattcaagtcaaacacattaaatggtgggtttcatccaaaaaatctgattcttttactatgtactgtattagtggatttataatattagtgggaggaagtataaaagatatggaaaaagatattctggttatgttcgtgctaaaatgtgtgtattagaattaccaggggaaagaaaaatataaaagctgcaataggtttttctattttttaatacctaacatttgttattttaaaagcaataaaatcccctaaagaaatattcgtaatcaataagaacacaaaatatggaatatattaactgagttataaaaatgtttgtagtatagcacagaatgaaaaacacagcaagktatgtacggtttaaagtgtaatcaattttgaggttgtatacaaggatatacatgataaatacaagtagtagcatttttagtaaaggctgttacaaaatactgtatttatggcctattccattctttttatagctcattaatgtagaaaacaaacacagtgtatccatcttctcagacggtttaaaattcccttaaatgatgtttttaaatgtaaataactgagctcatttgatctggttcttccttaagccaatgttagcatgaatggccatatttaccaccccggggttccttttcagactccggaaagaaaaagcgatgataatgacgtatttccctcccttccacaaaacagggccaggtgtaacacactaagaacaaatggcttggcagcctactctcctctctcgaagctccatgcccaccttgctgttgcaccccccaccccaaggaaagccttcccacctttggaagctgcattaattcttccaggccacaagggggccgttgagttastggttcactgcactggctggcaggaaagagttttaatgcaggctccaaaggtgcttaatttcctgtggtccttatgaatatgcatacagtatgtgctcagcaatctagcagttcaaactagacagctggttctggtggtgagggttttttaaatttattttttatttatttattttttctctcccctttccttggacaagccctttctgaataagctgaatctgtagtataatttcattaactcatttccagtatttaatttggttttgatatttccatcatggccccttttctcctttgattttgtcattctgtagaagttgataatctgtattatgatcaacaaggcatattgccatgactgtaggaatcaccaatttagatatccaggcttcctaaaatataagtaagtcagatttagcattactgttttcctgaatgtaggagtatttggaaaaggaaaaaaaaataaacatacatcttggaaagcagagaaaggtgttttgttttctttctgtttggattaacatattctccatcactgtgtaacttcatccaatacgtattgaatacctactatgtgtctggcaccacttcagacagtaaggatatggatatgaatttgtatcagtcaagcyttccaggatcttattatctagagagaaagattaaaacatatgcaaataattttgatagaagcaaagacctaactcagcctgagaggaggttgggtttagagaatgctttcattgtaatgttttaaagctttttatttataactatagtttatttggactttatgatttaccaagtaactttagatgcaaatatggtagtactgtgaagattatggtttttgaatgaagtcactttgtggcatgatggtatagaataagatattttcatagtgaaaatggagataagacatgtcccattccctagaatagactgtcactgctctcgttgcctccaaggaggaaactgttataggaatgattgacatggaggttcatctgtagaatatggacagccctctacaaattgggaacaagggccaggacacgaaatatagtgacagcctctggcctgggagtctagacagtggtgaaaggcaggattcatggagttttccaagataagattcaagacccaaactatgaatgaaagccaggctgaggctggcaccaagtagaggcctccaataatgttgacccagcggggctgcattgttcactgccccctcctgggaaggaggaaccaatgacaatggagcatctaagagacaagagaaagggagtgtaaaggtgaggattccatggctttacactccagaaactcaggctagcttgttctcactgaagcagtcataccttctcgaaggcaactaggtggattacagaattgtgctgggtcctatggagtgtcagaaatagtgaagcttctggagcttcactgtccaatatggtagccacgtgtgactattaaaatrtaaattaattaaaattaaaagttcarttgctctgaaatagcagccacatttcaaatcttcwgtagccagatgtggttattggctaccwtattgggtagcaccgatatagaacatttctaccatagtagaatgctcttttggatasatctgctttaaagcattagtccccaaagtgtgaaggatgaaccamttgggttccgagagraaacattataacttctgtttatccattaaactctttcatttattattaaacatctcaacacatttattgggtggcaggtactgttttaagtgttttgcatatatttacatgtactgtcctttcaaatattctttgaaataggactattgttgtccatatttcacagatgaggaaagagatgtgctaagaaaagaggtggcagagtagggattccagctcagtagccactttcagggtcccrtacttttcaatgtaagcatattggctctcaatttaaaaatgttattttttacagatagtacacagatgcactgacacaggtaccctctccagtcytctgatggtcaggaattgtgtgcagtatgcagtacattccaaagtcaggctggccatttccccagggagagggtccatgttggaacctttgctccttgtggactttagctttgaaatgtattgtagttttgcatgtgtgcttagttggatggattgagacatcagattatgtggtctgaactaaagcaaccgtcacagaatgaacaagagacttacaaacatttgtgcaaaaagatcagtgtttggatatagttcttagaatagcaaatagtaagaaaagagcaggattggtacttcacctactcctaataaaagcccttcatcttgtgcaaagtaaacacaatcacagtttgatcagaagtggtcaatggaaaaacaaaaatctaaattagcaaagagaaatttgaaattgcatgcattatttttaaagatgaacattgctttaacctataccattcctggaggtagtagctaatagaatgatccaagtttataatttgtaaataagtagacatcttttgaggcgtatgcccttaatttttctaactgatgaaagcgtacttccatcaactcargacagttcaaagcagcttggagcctcttggattttaaaaagactctgtggcctctgtctctcttggttttcagtgctcagctgaggtctactctgtttatcctctgcctactagaaggatatcctttcaatagaggtgaaaatcctgaaataaaaggtttcataaatggggaaaaaagtcattgattgaaagagtcatggcatagatgctgaasttttgatgggaactttgcaggatgttcgtttgtttatcattagccctgggagagtcatccctcrcctcccaccaccccttaatttaaagggatttaaaatattttcaagtacatcctgatatcagcacgtggtacactgagcctagttgatggaattgtgaaaaaaaaaaagaatgttttcccaacaatttggctgtatttgccagaactgtttcaagaatgctatgacttttgctcagggcaagggaagtgtgtgtgtgtgtgtgtgtgtgtgtgtgtgtgtgtgtgtgtgtgcgcgcgcctgcatgtgtactgtggatgtgataagagctgtgtttgtgaaaactgtgaagacataacacatatctatgaaccttttctattaatcttcttggggctggagctttaaaataaaataaataacttttctgcagagasagaacctttccttacccaaagatttcgtaactttctcacatccttggttaaggctgagctgcctagctgtctgcatttctgataggttttgctttcatacacatttcaaggacttaagaaatctgtttctaaagaataacttagaatgtgcttgttatggtcccacctattctggggaataggtggatattatacatttatttaggtggaatggtgggtcagatggcttcatgtctttttacatcacagttccacagccctcattagtgaagcagaggttgaaggaggtcacttgctttttatcccaatgtcaaataactccataattttttttattattttttgagacagagtcttgctctkttggccaggctagagtgcagtggcgcgatcttggctcactgcaacctctgtcgattctccttcmtcggcctccgtagtagtcaggactacaggcatgcaccaccatagctggctaatttttgtatttttagttagacaccrggtttcaccatgttagccatgctggcctcgaactcctcacttcaggtgatctgactgccttggcctccgaaartgctgggatgacaggcgtgagctgccttgcctagccaaataactccattatttaagaaaaattaaccagtatttattgaatacttactgggccctgtgctaagtgctttscatgtgatttctaatttcctgaccattctatgaagtggctactataattatcctgatttcccaggcagagaaactgaggcttagagagttgaagtaatcaactgggtgttaaaaagctggtaagtggcacagcacttattggcgctaagactgtttctcaggaccttgttgtacgagagtcaacgataagacgcagaacgtatgtttcatttttcttgggaaggatctatctcactcatctgccttcctgtgtctagcaagagggccaggcacataaaatacacatggtacaatctgttaaaaggcatgaaaaagaaacagtcattcatatctgttcgtagaagtgggcgtcaagattttggggcactgagatctatgcatgttgtgggcccactttaagaaaaggagtcaaacatttagtgtggaatactggaaggggtccctagacatgaagggcctyttcaacctaccttttgttggcttcaaggttatgccatattttgcaaagtcaagttggagatggctctcgatatkcatgagtgtgttagactgcttttcttctattttttaaaaatgcacccaaatgtaaaagacacttttacstttttgatttgatgttgaaggtcatttgaaaaatactctgtctttattctttgaaatggatttactctcaagaaagttgcatgtcactttacttggaagagacgggtctcagkgaggtgtgcctccgctttcatgaaaagtctcccgtctgcagaagcattggctgacatggaagattttttttttttttaatacttttctttttgccggcatctgcgtagaatttttttttttttttttggtagtttcttaatggtctttagcaaaggaagtaagtgacrctgatcggtgaaggcagacagtaagatttataatgtatttgtgctagctgattgccaacagaaccggcctttcccagtggtgctgtacgcagactcggaaaatcaatagggattaacctttgacccccttcacatacttatactgtgggctgcatcgcttaccaatatttcatctgtttcacttagctgctgttacttactcaataatgtgtggccaatctcamaagatactaattcwttttttcaaatgcagcatcgcttgaagctgtgataaaatatcacacctttggaaatcaaggctcttctkgtttatttatttaactcacattaattagccttaatttwaaaaaaatgagaagagccagcatcatgatgcaagcattgactttgctcacaaaaacatcttgtggtcaacagtggggcttagggggcaggttttgtggctgtgacagaacacgtggcccctagtgtgtctgttgaaagatgggcccctttcaggaaaatkgcttaccttactttttagacataatttttgttttctgttaaagggtcagttatagataagtatgctcccttgcaatgaaatgaacccactttatcaaytttgaaggaatcaaaattaacttgaatacattgtctttttgcatatgtatgtagtgctttgtataaacatatgaatttgtaggagctgctcttaatgattattactgcataggctggaatagaagcaaaatttgcagtaatacttttgtacctttctctttaggccttggcatrtattaaagtactatacatttgtcttaaaaattgaaattgtagattattttcatctaagacccttttgttcacagatttttttttccaagtatacctattccccagagtttacttacagtttgctattgatccagcagctggtatttgaattggtcgatatactctgtaacttgtttaagataccctacctgagctattagtttaaataatgtattcataaattgattaatcattacagtaagacttattagctgcatttatatctgcgtgttatccacaattgacttatagtctaataatcacgtatacttaagcagaagttgggttttacgttacaatttaataattatcaaggtggcaaacggtagtatttgtgtgtagaagttgagtggatgtggggctttaaaggcaggagtctctaagcaggttgctaattttacttttcctagataaaataattctctctcccaaaatgaaatacaggaagtggaccaaattgtgtcagcctgaaagaagtgattgagtttgcggaagctgtcctgaagtcgaggttctggaagatgggtggggtggggggaagcgaatgtgaagtgccattgcatttgtctccatttctgtcccagttacatcaaggctgggaggaggtctttccactggttttccgggctgtttgtgtactacacagcctgtgtacctggcaagrcacgctctgctctgccctgmcttcygatgagctgactaacaccttatagatgargttcccttagaaccaaagatgccccatgaaactccctaggatgaatgttggaagtccttccaactgggattcccagccggaaaggaaacagttcatctgactacagggtttaggtttacatgtactttaaaaaaaaaaattaataaagtttatttttacagtaattttaagttcacagcaaaactgagtgggaagtgtagagtttcatatactccctgtcctcacacatgcacagcctcctcyagctatgcacattttcaatgaaactacatgttcattgaaaatgatcttttgggtggttgatgttcgattttggctctgtgttgggcctgcccagtgaggtccttttgactccctaaggraccctgttttgggtttcttttgaggttgaagatatttcagactctttccccctcaacttccataggaaccaaactctctttmttcctcccgtttggttggaaagttattttgcctcactgcgtgatttttctactgcaccaaytcccctttcaaacgttattccacaacatactaaattaatgtatactgtgttctttgggtaatggggaggggagcctgtctcacagcacgcatttgttcagctctgtgttgaaagagcactgcccgccgcgtgaaggacatctgctcacaagtgagcaattgtgcttctgatttggggcagcacctttgcttgaacgctggctccagatgaaagaacagattgccgcggagccgcttttccaaggatccctctccccagcatggggcttcatayattattgagagcaaacctactttccaccgccactcctggatgcacttattttgcgagccttattcagaatgtcagcatggatcacttggcracaaaggcctaaagggcaagccaggaagcttccatggatacgttatttatggtgtttaattattattgtacagatttattaaatgactctgttacctaggagtccatgtagttgctgaaaagagtttgctaactttgaatcgtagatgttttatctgaaaacaaaatttccttgtgaatgctgttaccatattcctggtgtctatgtgagggggtgtgtggtggtatgccggtaagtgttgaacaacctgctctgttggcgggarctaggggaaacaaaccctgttttgtagtatttgctgattactgtggtgtaaatactcacaccttggctgatttcaagttgcagcttggaacttggagttrgaaagagatgygtagtcccataccattttatgtatgtaaagtatttgcactatgccgactaatagacataaataacctcatgagcatagataatagtcacatctactaagattattcagaagtattgagctttgagtatgttttacctttttaatatagcttattgaatcatacatttatctactttaatacttaataatgagtgtgcccaacaactaggtcttaaagttcctgatagtttagcagtgtgctctcttaagccagtcggacctggttgttgtacactactgggtgtgtttaattgacttccagttttgttttgttttgttttgttttgttttgttttgaaacagtctcactctgtcgcccaggctggagtgtagtggtgtgatctctgctcactgcagcctctgcctcctgggtttaaggaattctctgccttagcctcccgcgtagctgggattacaggtgcatgccaccatgcccagctgatttttgtattttcagttgagataagsgtttactgtcttggccaggctggtcttgaactcctgacttcgtgatccactcgcctcggcctcccaaagtgctgggattacaggcatgagccaccgcccccgaccattgtctgtcaggtttaaattgcaccttgggttcgggtgaagttgatgatctattcctaatgcaggctcattcctaacagggcatccctgcacaattttccgctggggtgtgatgagctgcttcgcatcctgctaagtgtcctcgacagcgagcagacacatgtaccctgcttggtacatgccagatgattctgttgtagtgatattaaggacaacagtattttgccagaagctataacgagatgattctataacaacagcatggtgacatcagactatgttttgcaattttctttaatatttatgctggataaataatttatcttttttctcagttttttttcccttttctttttttttctccccatcttgaacatgttgctgtagacaggtgctaggtttccctgaatgactaaagcagagatttggttattttcytcccagaaaaagtagatgcatcagcagagttgagcccctgggcattatttccccaattccgtatcccatctactaatacaaactaatgagatctattaaggatgagtccacaagtttgaagggagtctcttaytaatgttccgtctttgcatggtgttacaacagcgggaccattttacactgagggtttgcgagaggcatggctcccctgttatgtatttgggacttactgcagatgcttcctctggttcagggtgttgaggcttcgtgctgttaatattggaaggtgggtcrtttgtactgggcatctgtcctgtatcttggagatgtttagtaacatccctgrcctctagccattagataccatctctcccagtagggataataaaaacatgtctccagatgttggcaaatgtctggccttctggggagtaaaatggcccctggttggaaactagtgttccagagctacattcttagctgcttactgcatcattgtttttagccctccttttctctggcttccaggaaccaccaatcccccaacactaggatagggcataaggcaaccttatgtcaccaaattaatgtccgcctaggcaagctggactgcagaaagaaaagcagtatttctaccctaggatcattatcccaccttccccaagcttcgaaagaggtacaggagtcctcagaaatggggcttctaaaataagtggaactgggacctcttctctctcaggctgttacttgttgtggttccagcctattttctgagctgtggagcagggagrgatctcacaggaaacttggtaatgtagattttggaggacttgaaaggttcctgctacctttggctggggatggagggaacatggaagatgggtctttgtttagaggaagctcttyatcctggtacsctrgaagttggcatagtcttagcagttagtccagatgtgaatttcaggattattctgtgartcttccaagtcctgtctcagcagtgaaataggctcagtgtagcttatgtctaggtggctgagttcattttctagtctaggtaaagggcacctcctgtaattgaattgtgtaaaacctgcacagtggtacacctgagcccttttttaggacccaagagtgctgagattggctcttcctgagattccctctttaaggataagactttctgatttttcaactggatttaccattgtggcatctgcacatgagcagactgactgctttttggccctacctggagcctgrgtcctcaggtagctgacccgagagaccgtggagctgcttgtgatatacaatgtcagtgctctgagctcattaggcgtcatctgagacagtggctgtaggggaggggaggtaggctctgagtcaagcagacctggaattttcttyatgggccattaggaactgtgtgacgctggggcatctgacttcacctttctgagtcttagtttccttacctgttgaataggtctaatgatatcattatggcagatcagtgggacgattgagtcaaataacatgcccaatgcctgtttctcagagtaggctttcagtgggccacatctgttgtcactattattttgttctttctgccatttgggatgtgctttctgataatggcactaggctgccttgttgcctcctgcatgtagaacacagaacttcgcagtctctgcagagtatctaaatcctgctctgggccagccctttcagaaacacttcaggagatcaatagttatctgcttacctttctagctgagatgagattttatgcttgttactagcagatcaatagtgaaagcaggttctgttaagttttttataggagtcattaatctccctcagcctcagtttccctatctgtgaagtgagtctaaccaggatgataatgaagagttaggtcaagtgagrttggcagccagacacccaccaccagctgtaacataagaacagatgttctctccagacccccaggtcagctgaggtcgctctgcttggaataatgaactgccacattgaggatttttttcctctctttacttggccaaatatccgagtgtggaagctctcactgtgaacctgctaacatacatttcagtgtctacaaaatgtcttttgagagaaaacagcagggacattygtgagctcttttttttttctaaccactttcccagtgagacttcagttttcattctccccttagcagctttcaaatatgtacgtaacacaaatgttacatgtttgagmatttaaactgaatttggacagggcttctatttccagaaccttctaactctatttctttgtgacctgatagtcttgctctccagggtaaaagaagaggatggaaatggctgtggggcgcctgaggtgggccctggcatgatggcaagttgccgttctgggttcactgggatggctcaaggggagtttggaaaccctcctaacatgtcatctgaaatctgggaccacagttccggctggaacacttgtcactaaagctgctgataagcaaagggtgtatcactggtatgggtaacwgttgtgggaggaggaggggtctgacagatagccggatgattttaatgtttatattccactggggtaagctctaacaaagacccatcatttcccagataaccaattcttttaaaagaacatctgttgaaactggcaatttacattcttcttaaaatacggagcgacataattaaccctctggggagactaatattagtttattagagacaatttctagttctgtttatttttaacactaaaygatttgttcagattggggaaaaaawttttttttttttttttggttgtggtggcgttggcttttacttggggttgacctttccttatcaaggacrtacaaggtgaatagctgggtgataatatatggtcccatgatcatcaaccaagcaccaacggaagccttttggaagtgcacagtattgtttaacacacaaataactcagcgtttagtaactttcaggtacaatcagtctattttaaagggacctcatgtgttattcatgtatgtgcacatgtgtttatgcagttacctttgtcttcattgatttggactcctttggtgctcgtaattggtgaaattctcttgtgatcattgttgtagttcccgcaaatctatttacggttttcacaaggaggtcacgaacatgcgttgttttcaatgctgggctagtttcagacttctggcttgttgtgggayggaggagaaagaagacagggcattttgatgtggcccagagaccaaatgaaacaaacgatcctctgattgctcagatgtcctctttgacttggaaagcacccacgtgaatgttgaaccatttggccctcagttctccgtcctgcagcaaactgcattgactcctgttttctacacagtggtcttcagctacaccttaccaagcaccccttacccagcaaacgtggcttctcttccccaggcagagcagtycgttacttagactaggaaatggctccgagaagctcacccatcaccatttgctctactgcaaaacaggactcattagcaggagctcataaaatgaaactggcagtgagctcatatggaagargcatcacgggcaactcggcttggctcaccagcccctgagctgcccccgagtgaccgctccagccttctttccttccacctctccctcttggccaacttcatgcttcagccaaagtgaactgagctcaccaggctgagtcatctgtgccagctgtgccctctccccgaggctgcctgccatgctcgtgctttcttgtctattggcaaaaggctctccatccttcaaaatccagctcttggcctcatatcttccacaaagccttcccagacctttactcacctgggccattaatcaccttccctctcagtyagctsctacaccatgagtgcttttgtatsgtgactgtctggttacaaggtcatcttttcccctggatgagacgccccttggggaaaggaccaagttttattycctgtttaaccttggcctgacaacctaataggtgctcagtgaacagttcttgaatttaattctctccctttccccacactgatgkgtatttaagctccagtggtactcgatgtgttgttttctttgttcttttttttgagacagggttttgctgtcacccaggctggagtgcagtggcagagtctctgtgcactgcagcctccgcctyccaggttcaagtgatcctcctacctcagcctcctgagtagctgggactacagttgtgcgctaccacacctggctaccgtgtcttgttttcaatgcagtatataagagggtgcattgtgtacctgtgggagtgattacagaatcccatcaaaatgggaatcactgactgaaaactggagtttatttgtaagctgggagatgggagctgaatttgaaaccccaggagaaaatagcatataaagtcattttaaataactatcatttgcagaggaggggggcacagatgcctccagtggcccaagactcccctttacacattgccgttcccttgccttctactcctcttttcattacccttatcaagattctgcagcccagggtgctgcttgttgatggacatcttcacctgactttctccctggtccaggtgcattttaagcatggaaggtgacacttgccattctcaatggacaaagggagtggggagtgtgggggtgtgctttggrgttagtctctgggttttcgaaacttagcattctcagattcccagccaactggtttcacatgacaagtaaatgagcaacctggaagatgagtggcgtttccacacacagggaagcagatagttccattasgtgacagtgtgtgcacagtttatggaggatgaagcggaaaacctgagccacaakgcagtakaggttggacgagacactcattccgaaggsgggtgtgtatgtgcaaactgtataatttttttcttcttttctatctgctagcaaagtggrtaagttgacccatgacatsgtccactggagggaccacatttgtgactctagcaattaagcytcccttctcatctgtggataaaactgacctcccagtgtgctggagtcaaacatattcagcatccaatccacattggactgtttgcatgtaacgtacagaacactcattcatctacatctaggaccataacagcgagcaggagacagtccctgaccctggggactaagcccaggacctgccactaggagatattcatggaatcactgtttctcctccttttcaaagaagactgaatttatgatgaaactttcttcgtatattggctttgagaaattctgttttggtgcttatgtgctctggataattctcaatgactttcaaagttatgattcagggagtaattggttctgagagaatatgcataatcacatcaaggtgtgtttgttttccaccatttgtagccttttgacaaatttctgggggcctcatgcctgctaggccgaatacttgtgtcccttgagcctggagacggcaagtacccagtgtgcatgcatgcactcccaaagtcctttattcacgacagacatcactaatcaatcagtcatgcttagcatactactccaagtagtcattactaatcatctctagtcagcatgggagatactctttaccatcccggtaaagtgacgttttgatgaaaacagcatggatcttcctgcagagaacagactagccccctgtacagcacacaactcggggaattttaggtytggtgatttactgctgttggagcctggccttcttcctgggagaaggctsgaaaaacttcawgtcagttacttaatggaataatacatgtttcctgcttccattgtcttcctggacctgacactcactctttaaccataagcagaagacacatacamaaatgtcctatgttaagaatctttatttaagacaggtggctagcattatttgggtccagaagcttccctggaaagaaaggattcactgcaagatcgacaggcttacccagttcatttaggcgtggctcgattaatgcacacaaagctttgggaacatatcagtcacatcaagctaggtccacctgtgtgagtaagtaacgtgtttatttatgattttctttaacagcacagaagagcaattgcatttggtcattctagtatcaactgagttctttataaaatatctttggggtgtttaaggagaattattctttttacaagttctgattaatgacaccgcaaaaatgagaataatgagctaatatgtatctagtaattgctatgcacttatatgtatagaagcgtataatccacagcactccttctgaatacgttacgtaaatggaaccctcgcaacagtcttatccccattgtagagatgagaaaactgaggcatacagaagggatggaactaggccaagagcatagaggtggaattgttgtgtgagcctgtagagtccgtgttcttacccactgcatgatgtctgatcatcgtcaattttctttccatttggacagatgaatggtaacacttccctactaggtagagcaatgattccagaagtttataataattggaaagtgtattagtcgattctcacactgctataaagacattcctgagactgggcaatttataaagaaggaaggtttagttggctcgtggttctgcagactgtataggcttctgcctctcgggaggcctcaggaaacttacagttatggcagaaggtgaaggggaagcaggtaatgtcttcacatggctggcastggaggaagagagaaagtagggaggtgstagatgcttttaaacaaacagatctcaggagaactctttcacaagacagcactagggggatggtgattagaaagcacctcatgatcccgtctasttcctgcagagaacagaytagccccctatgcagcacacacctttgtgaggtccctyctccaacacagggattacaattcaacctgagacgtgggtggggacacagagccaaaccacactggaaggtaaaaaagttggcaaccagaggcttagaggaggttcaaatctcaaagtgatgtctttccttttgcattttggatggtttaataaataagattgatacaaacacaaagcattaagcaaacaaaaggaaataaaaacggcaacaaataaaacttctgtgctttttgaaattytgtttttggcaggcaacattccaaagatctttttcatttaaagtccaggagtcttctgtgtgaaccccacacaggtaccttggaaagactgcatctcctggattttgcatggttctggcttaatggacaacatatcagtcattttttgaggaaaataaatttaaggcttggtyatcggtccttgagtcagcacattgagcgttttgtcaattagctcctcccccmatctktatggtatggcttttcctgtaattacagtcaagatcctatagccggaggaaggcctgtcaattgagtaagaggctgatgttcatcgcacagtgacagcccattcggagggttttaggcctgtccttagagaggcttgttatttcctctttcggtactttgttgcaacctagttcaccgccatcagatgaatggaggtttcttatgctgtggcgaaacccagggggtcaagcccctcggacatgacgtactgcaaagtgaggatgtttcattgatttgtatttttaaaattaaaaataattatttaagctgcatctgtgtgcttataagaaaagatatagaaagattagtagtagactgttgtgttctttttttttttttttttttttttgagatagactcttgcctgtcgcccaggctgcagtgcggtggcatgatctcggctcactgcaacttttgcctcctagattcaagcgattgtcctgcctcagccttctgagtagctgggattacaggcgcccgccaccacacccagctaatttttgtatttttagtatatacggggtttcaccatgttggccaggctggtctcgaactcttgacctcaggtgatctgccctccttggcctcccaaagtgctgggattataggcgtgagccactgcacctggccagtagtagacttttgatagggtttttttttctcaaggtgtaggtttggctaggaagtcatagaaaatgctctttttttttttttggagatggagtctcactttgtcacctaggctggagtgcagtggtgtgatctcagctcactgcaacctccatctcctgggttcaagtgactctcttgcctcaacctcccgagtagctgggactacaggccaacgccacggcacctggctaatttttgtatttttagtagagccggggtttcaccatgttggccagggtggtcttgaactcctgacctcaaatgattccctgcctccacctcccaaagtgctgggattataggtgtgggccactgtgcccggccaggaagatggtcatgttttactttgaagcaatctgtgcttggtttatttttttcagtgagtgtggattacgtttataattttcagttactagttaggtaaagaatcaaaattaataaacacatttatagttctcagagattccttgagagaggaacatctttaaatggataaccacagtcttctaaacacctgaaagggtgtcttttgctgaaytatggagttttagttttgctttagaatttttggatgattagacttgtacttcttttaggctatttttccacctggtactatttggctttactgamtgccctcattccccatacaccaccttgttttgttcagattcccctaartcttcattctcgtcccacctccccatcactcctgactacttgaaacacgacttctgtcctcagaaggcagcagtgttccctcctcccgttcatttttcattttcccgttgcttaaaaaaatcaagcatatgtttgcagtcatcactgatgttctgcctcctcttctaaagttatagatgagtgccaagttggcagagcatgtagaaagatcactgcagatgtccttgtcgtgttgaccttattggagaatttcctatctgtgatgacctgtaaatggaatttaagggaggaatcamacgtgttagcacggggttggcattgcgtggctgttttcaattaacttgaccactatsataacatcaaaggtgtgtgtaccattctatgaccattgaatctccatggacatgttttgggaaatggatttgtcccattacactgctttctttagtgcataagatcttgaagggagggatgcattctatgcaccccaagtttctggtttactcgtggtttcaggwgtccctttagacaacatcactgacaactcactatgtaaaaccaaacaaattattagctttcttactgtgtgtttgcatttgctgtgcccagggaaatgggaagtgcattgaggaagaggccccaagacawggagaagtcactccaactttccggraacmccttttgctgtgccatgtgcatggaaggagaggaatgaatgactgttgaagccagatggccttgctcattgattctctcctttcccgccctctcaagccatccagaaggagaatgaaatgctcaaatcaagggagttaactatggcmaagatgttagtaatgggaaactttggaggaaggcaaagtcagaaattattctgcagggagatttggggatgttggatgctaaggcccaagccgtctattgtatgccttttgctttggcataaaacaacagatgaccttctgttaggtgtatstctgctcatgcttgagagtggtggtgtttggaaagactcaatagcatatgcacatgaggaagttgaccaaatgattccacagcrcatactcattttttgctctgattctagcttttcctccaattttattcagaatttgttcttttcttacctcacaccatatagaaaaatcaactcaaagtggattggagacttaaacataagatctgacagtgtaaaattagtagaagaaaacaaggaggaaagctccatgacactggtctgcacaatgagtgtttttgtatatgaaccgaaaaacaggtagcaaaarcaaaaatagacaactgggattacaacaatctaaaaaayttctktacagaaaggaagcaatgaacagagtgaagcagcatcctacagaaagagagagaatatttgcaaaccacacatgtgataagggattaatattcaaaatgtacacacagcgtaaatgcaagaaaagaatctgatgtaaaaatggcccttccaacatctagcattattgtgtgttgaataaatacttgttcgattaggtctaatcactcttcatgattggatttccaaaatgtggactctcagcagkacattacagggacagtggttgggtctggagatgtcacccttagctgtttttcacaatgagaggttgttttatcataaataaatcaataaatggcagattatacaccggagttactgagaaatataaaaaaaaaaaaagcccacattttaaagggaatttggtatttttaacaaagcatcagggggccgggagcagtagctcacgcctgtaatgccagcactttgggaggccgaggygggcggatcacaagatcgggagatcgagaccatyctggctaacatggtgaaatgctgtctctactaaaaatacaaaaagaaattagctgtgcgtggtggcgggcgcctgtagtcccagctactcgggaggctgaggcaggagaatggcatgaacacgggaggtggagcttgcagtgagccgagattgtgccactgcactccagcctgggcaacagagcaagactccatctcaaaaaaaaaaaaaaaaagaaaagaaaaaaaagcatcagggttgtcaccatgaagcaggaggagaaaaataatgctgttagacttcttaaagcgtattttgtggtttattttattgctctgtaaattgcaggctgtaattcatggggctcaggccagtgatttcacagttgatagaccaggcacatctcttcccaccccttccccacctaggggcaaggttttcaggaagagccccttttctaaaccacacatggcctgctcacaaatcttatgataaaactctacccactgagaagcacaaggtgtgaggctattgatgaggagttgaaggtgacagagactgagaaagggctgcacacctttggcctaaagggtaatgagcaacacacaaggattgggagatgttcatggcaagaaaaattcasaagggacattgttgtttcactaattctgtaaaggagagcagcggcatttacttakgccgattccccattctctctttctgtttttaaacagagacagatcttgctctgttgcccaggctggagtgcagtggcatgatggcatgatcatagttcactataatctcgaactcctggtttcaagtartcttcctgccttggsctcccaaaatgctaggaatacaggcaggagccactgttactggtctgtttttttccttaaatacataggcaacttcctcgattgtctctcctttattggcattgagagataagcacaataatgattgttaagatggaatattatgaaggctcaaggaatacttctgaaggctttttgtctatgaagtacacgaggtttcttaatagtttggcctctggcaaaaatggttttattgtagtttcatccttgttgagtcaataattaactgagtttgattaaagctgaattttcctaagtatgaaaaccatgtgggyccttctctttcctcgtgatgcacggtgatagtgcgtatctaacacttgaaggtgtccacgctggccctagctcagtgagatggctttgctttgsgggggtgagggggcggaggtggtggaaaggcagcaagctacgatgttcttatgtgtgtggccttgcttctggtggtggggtggcacacatgctctgtagtctttctggatgggtttggcccacgggagaccccctggctgtccaccagcccctttgtgatagtctcatagtcttatttgtcttttggcttgtatcccacctgttcactttttaccatagctaacctttctmagtggtcaggtgggactcatggagattttccgttctttggmractagcagcgactgcagattactcatcagctgtctccttgagtccacaatgccgggcggtggaygggcttcctgcctcctggcccagggcccctttgccggctcttagtgtagagcactagttgtaccatctggtagttgtttgtgcctgcgactctcttccctattaggctttgactccttaaggataagaaccatgtcttattttttttaatctgtagctccagtatccagcccaggacttgacaccagcctctgtcaaatacatccgtggaacgcatttgtaagaaatcgaggccaaggcactggaagtcccattgtctctggatgctgagaccttgaatttcatgccatggacccctcccttacattccgtctttaatgtgctataaatagacattcctggccttgcctaaataggattaagtagtaccaaatggtccttaccgttctgaggcctcactgagactcattttgaatctttaaagaaagcagtagagggatggagaagaagtgggtcaaaacctggtttctgcctgtgggaaaatacaaaacaacacaacagcaaagcagactagcatggttcaaagcacacattgaggtttttggtgtgccattctaatgcatgagctcattttgagccaaggatagctttttggtgtagaattttgccagtcctacggtcaatgcagtactaattgtgtgtgtgactttgtgcagtggggaaaggtggggctttaaaataaaacagaaggtatgaattgcttggcatttgctgtggttcctaagtctccattccgcttgccaagattaaattgaattattcccgctgccattcagttttactctgcacaaaatacagccaacatttttgcatttctttctyccttcctccttttcttctttctttcyttccttccttcctttytcccttcatctatctttgttccgcttttgtttgtttttttttagatcgctgcatgctgccgcgttgggttaaccatggtagcattttaccatgagaagccatagcaagatgtgccaggtgcatgctgctggaacacctggctgaggctccaacagcattttcctatgactgagggtagggtaggtagatgactcattacaatttataaaatggggggcttagcttgggtatcatcgtggttattccaagcagtcttccagctggactagcttttcgggaacacgtgtgtgtttgtgctggaagccccagtaatatcatttaattcgaaagcttttttctatgatgaattattcaggcagtgtttaccaaaattgtcattgatcagtacagacccagagagcatgtacaacagcgcctgtgctgggcctgctaggagtcgatattttctggctcaaagaagttccaaaagaattcaaagccagtgtgtctctttctctggamggccaagtgatgcaggtaccacgcttaggtctgctggtgtttagcttgacttaaaacccagccagggaaatatgtttcactttgctggggtgcaggtggaggaggctattattcttaggcatttaacagtgaagaatgttgggcagggcagagggtcagctgaatggcagggattccaggtctcagttaatgcccacaaatttctgaactttgaacataaataccctcactgcaatacatgtttttctttctctctctttctttctttctctttttttttytttttttttttttgaaaaacttttttggagcagcacctgcatgttgtaaaaacacaaaataaaaaaaaaataaataaaagcagaccccttggttcagatatctttgtttgtgtaaatgttttggcattctttrtgaaaatcttcagattttcaagagcttaagatgacctcctctagccggctgcagcagtgtctaggtatctgtgaatgtgtaagaaattgagacagcctgcaaaatagctcacccagcttttctttaaagttccaacctttttgctgsctctctttcaaactgtactgctcactttgggctgtacgttagaaccacctgagaagttctttttctttcttttttttttttgagrtggagtcttcctctgtcacccaggctggagtgcagtggtgggatcttggctcactgcaacctctgtctcctggcttcaygccattctcctgcctcagccttccgagtaactaggattacaggcatccgccaccatgcttgggtaatttttgtacttttattagagacagagtttcaccatgttggccaggctggtctcgaactcctgacctgaagtgatccacccacgtcagcctcccaaactgctggaatctgagaagttacgtgaaactagcgatgccctgggctaatgaaatcaggctccatggtggggaaggatgttgcggtggggttggggtggcaatgaaaggtgaaaaccactgtggtcccacctgcccatcgtcagatttcggttcctctcagagtyaacgtagaaggtttctgggggcatggacctgagtcttatcccctttgcaaaagtaagaattgtatcgtagcctgactcagggttttagccaacttctctggatgctaatgctattctcttctttatacttgtcttccytcccaggcacacatccactggagctttgcagggcctatctgcccttagccctccaatatccttttcattttctttaatagttttattgatatataatgtgcctaccatataattcatctgcttaaggtgtacaattcaatggcttttagtgtattcagagtttgcatccaccatcacaatcagttttagaacattttcattaacccaagaaaatgaccccttagtcatcaccccaaatacctcctctctccagttcctggcaaccactaaccaatctacttgctgtttctatggatttacctattctgcgtacctcatataaatagagtgatatgttagtcgtctcttgtgtctggtttcttcctcttagcatcatgttttgaaagtttatccctgcgacagcatctaccagttcatcatttctttttgtggctaagtaatacgccattgtatggatataccacattttgtgtatccattcattagttcatggattttgtgtctattatgaataatgctgccatgagcatctgtgttgtccacaagtttcagcatggacttctgttttcattccaatatcgtttgatgacatgtcttggcagtgatgtctatgacactgggcaagtgtcttaaaatgttgtgcatcagaaaaaagtcatcattgccaaggccagcagatctcgaaaagggggctgggacacgttggtgatttttttcatgctctacttacagtatgactcgtaactgttaatggctgagctcctccttaggtgaagaaggaaggcaatggcgttttctattctgggcctccctgcttccagcgatagcaaggagcgaaatgagatgctgtctaagaaaggaaggtgctgcgatctttgattactacacagcytcggcagtgtttgtatgattaatgagtccatgtttcagacgttcccatttaatgtatttgagccttctaacaacattgcctttcatatgttgctgactgtttttgagatttatgaggcctaactcgcaagcgatgtgtgtctggattaagagaacctgagaatctctatttatgtctgaccccaggaaattccctttaagctgcttgtcagaggtgcatgctgagagcatgatgggaagatggagtcttccatccactggtaaaatctggaatctgctctcatttcattttcactgaactgaaaataaggtaacagaccctcaggtctacctataagtaccttccaactgttccacttttgtaaatttagttcarataatacatatgctgaaattcctatatcccccccatactccagatcttcaktgtggaatttaaatataattccttattgtaaaaaaaaaaaawttttttttgatcaaggtgattttgataaactaaatgcatctttaattttactcacagcaaagcgattctttattttctctctaaaagcataattgatgtgccatgatctttgtctttgcatttttaaaactgaaagaacatttccacaccattagaaataagatttcttcttaaaaatattcacaaggtgcaaacacttacatgtgtatatgcatgatttcaccaccagggggcattgtggtttgactgtccagttaaagagcctgtgttctatcagtttacccagaaactagaaggcctgcgagtatttctgattccttccaagaaggattcatatctggaagagaacagatgtcgactctttttcctctctagcaaacagtagtgttgtcaaatttgctaaacttagccagttgaagattaacatgcaatatataatatgcatgcgactaagtgtacaataaatagtaaatcacatttttatgctttctctgaacttggaagctgcaagttatgttttttttattccctgggtgtgatgaaataaataacattcaaatacatcttaaagatgtcagtcagggggaaaaaagtgcttggcaactgtgtttgatagatttcttttatgattaattctcctattaagttttaatgacttcaaagatacaaagctagaaactacaaaactaggcatggttaataaataactgaaataccaggtgtatagaaatgcatctgtggaaaaatgaaatcatrtattctctaggatatattaggaaatggctctttggcaagtctagagggtaaagtatccctgaagggggaaaaggtttaaaaacagtaaactaaagaagattgtttttctgaaagaaattcccaggagaaaggtactttctgagattcacatatgtagattacattgttatgaaccaacatttataagcaagcttgatctctcagaatgcgtttgtctatctcagattttcaagaatcctcrtacaaattgtccagggtttccacctcgcagttttcttccagggttgctatggcatggaaagtacattgctattttgttatgtaaatgctcaacagactggctcattccagaagtgggcgtcgtgatgccagtgtcttcgtaatactatctttctttcccctttagcacccagaacttatgaaatatgactcggtttatcctgaacacatstctgtgcatcagggaggatgggagaattaattccagtttctcaattgcaaaagtgaggctggtcatggggcttggaaccacgccacggacgcatgaagcctccccgtttacatgccaaatccagagcttakgcatccrtgctcagggctctctgtggtaggcaacagctggattatttactttctagaatatctcgagttcttaatctgagcagtttcgaaaccaarcccacattaattaatataaataatgactgggaaacgttgcaggactccccggaaaagaatgtataarttgatgtgtttttgtatatgcttatgtatatgcctttgtgcacgaaaggagataaatggtgtatttcacacagttccttctcctcctctaagggatattattgttcctgaatttttctgagccgccgaagcacaatagggtttagagcgttcacaccaggcagcccccactcttcagaacttcaaatctaaagatcttttaaatacacagaacttacttttgaaagctgtggcccatcccaaatgaattctaatcctcagcctctagaatgcctggagtgagaaaacagaatattgttcttttctgtttatattatttcatactgagttaayacacttgccaagactccgaggcagcttctggcttgacaatgccttctttaactagcctagtttctagaataaagttcgggtccaccaggccctctgagtggggctcaggacactctgagatggaagagactggagaaagccaatctgtttctccctgaaaatcatcttacttttttaacgcttcgtacctagatttggcctgggcagcccagggagactgttcragcactggatacctagactctgctgggctctagagaagtgctgggctacagcgcccagtgccctacctcttggggccagccagcctcaccaaaaaatcasgcttctggcttgctccaaactcaggaagttgctgggaagtctggctagcaacaccctcattcccagtcctggccatgcctctctgctctccctagcacagggagcatgcaggcttaaggctggaagaaaccccaagcatttggccaggaagaggcaactagttccagctggcccacatactacactttaaaaattacccagatgatstgattctgtagagagagagtgggtggagaggactccagggccatggaggaagattcggcctttctctccctaatcatgagcaatgtgatttggagagagaaggacccggttggctctgcaaaccgcatttccttggctgaacgccagaggagagaaatgatccggcaagaagacacaccattccccgtcagcccctwcccgwcccttgcacccctggatcttctgctgagtatcggattggtctgcgtccaagagctcctcgcttggccagcaggggctgcctggagaaggggaggacaggcttcgagttttttgggtagkgacttctgtggacgtgaaaagactgcaccagaaatcggaggcagccctccaaacataacttggcctcttcgttctccctgtggacacacaggctgtgttctcctggccaagagtccaagcgtgtttttggcgcgtgctgacactctatatcgcttttgcttcggaaacgaatctggtcagtgacttagccactctataaaaatgaagagcagagctcgagtgcttataacacgtcatttttacccaagacagagaagaaaaacgaaagagagcctgagcattcctttgactccctccacccccggaaggtatattcagagtctccaagactgcctccgcctactcacatgtttatggcccggtgagaccgcatcctccctttctctatctgtcccttttctggatgcagggacacagaatcccctaagtgggaagagctttggagtggaggctgttcaaagttctgtggtgattaattattacctacccaaggtctggtcattgctatacttgagttcttttcaggctcaagatctctacctttttgtgttttttttttttttgtacagagtcttgctctgtygtccaggctgtagtgcagtggaacaatctctgtatgctccctgcaacctctggctccaggtttaagtgattctcctgcctcagcctcccaagtagctggaactacaggcacctaccaccacgcctggctaattttttgtatttttagtagagacgggatttcaccatgttggccatattggtcttgaactcctgacctcaagtgatcctcccrcctcagctgcccagggtgctgggatcacaggcgtgagccaccgtgcrcgacctcagggtcccttctaacctgtgctgttgtcataaaccctggaggagaagcaagatctttctagcaggagcaacatcatcccaaataaagtgatagactttgatagtgttcttctattcattcaaccaacagagaacaaatgaaaagaatcaggagtctattgaggagacagaacatgagtgatttctgtgtgctgactatatttaaagacaagattagcagtaatatataaacgtaaataagaatttttttccccagccaagaaccatagattggacttcacattcaaaatgtaaattgtgcctaggaaacatcaatgcttattttaagcaactgacccttgggataaaaataaaaagtcaaaaggaaacaaacaatgttgctgagaagtgatagaatattctagtttatatctcagtcatwttacagctctggcatttctgggkaacactttagaatacttccactccggttggtccataaaaagctgcctgtgtttttatgttttgaaaatacacgcagagagacccactgcatgtcctattaggcatcttatccttgagtaagcaggcatgcaacatcagtgtcacacacatatcacccccatactcgacattctttgagaaatgccttggtcccgtctccagccagatcagcattgcacctcttggcatgcgttcttacctgttgaggatttgcttgaattataatatggtagaggaggaaacacagtcttactgtgccgtgtgctgagcgcagagccattctcagcatcctgccttgattaataaggcgtgaaagatcctccgaattcgcacctgttcagacaagcttgtccaacccatggcccccgggtcgcatgtggcccaggacagctttgaatgtggccccatacgtatttgtaaactttcttagaacatcaggatttttatgcacggaccttttatgcatggactgtggtgttttttgatttttggttgcgtgtgtgtgtgtgtgtgtgtgtgtgtgacggagtcttgctctgtcactcaggctggagtgtagtggcatgatcttagctcactgcatcctctgcctcccaggttcaagcaattctccgtgtctcaatctccctagtagttgagattagaggtgcccaccaccaagctttgctaatttttgtatttttttagtagagacagggtttcgccatgttggccgggctggtcttgaactcctgatctcaggtgatcctcctgcctcagccacccaaagtgctgggattataggcgtgagccactgcgcccggcctttttttttttttttttaacgctcatcagctattgttagtgttagtgtagtttatgcgtggccgaagacaattcttcctccactgtggcccagggaagctaaaagattggacacctgtaaacaaaaacaacacagccatctagctgcaagacgtagctaattgctctgcagaacagggttggccagcctggccttgatgtcggagtgttctctaracctcacacccagtccctattcttaggttttatttctcaaaccaggttttgcctgagaaattacagcaaatgattcakagcacaatgatgttgctcatttttgataagtagttgaaagctgatggtgccctccatttcaaagcaacagaagaaacgctggtggtcatggagaaagagttgggaagcagagcgtgaatgccgggatctgcagatctgagcactatgcctgcagccgatgtctctccacagggctgatctggtggctggggtgcccctggtcagaaggggtgattactgtttcctctctctccttggtctctgtcaaacctaccaactcttttcaggaatgcagatatttaattatcttctgctgttacatctgcatcatgtattggctggctgttcaaaagtatcctctctaggcaaataacgagatttcgccagcaggatctcccgttaaaggcgtgcatgtgtggctttgtagacacgtatgtgtgtgtgmgtgcacacctgcctgcccttgcacagtgggcactgtttccagtgtgcagtgaggccctcccttcgtgtagaacaggacaggacaatgacaaagttattcaattaataattgaagcttgccgggcatggtggttcacgcctgtaatcccagccctttgggaggccaaggcaggcagatcacctgaggtcagaaattcaagaccagcctggccaacatggcaaaaccctgtctctactaaaaaatacaaaagttagccgagcgtgatggccagcacctgtagtcctagctacttaggtagctgaggcaggaactcgcttgaacccgggaggcggaggctgcagtgagctgagtttgcaccactgcattccagcattggtgacagagcgagactcagtctcaaaaaaaaaaaataatataataataataataatcgcacctcaatactccgtagccattttaccgcatgtgactattagctgtgcttttgcggttatctacgtctgttgtgtctatacggtggagtatttgcagacgctctgccagtgtgcaatgcttcccagccctgcattcagggataccaacttgggtgctgaaaagcagcgatggcaggactatttacaccacggaaacaggcaaaaactactgatcaagccttcactgttttgtttatattgtcttgacttagaaagtgattgcaatgttaataatgcagattaaattgaagcgtacagtgcctataaaccattacattatgaatagtataaaaaattgaggaagccgtgtggctcacaaattcagcactttgggaggccgaggcaggaggatcacttgagcctgggagttggaaaccagcccaggcaacatagtgagacctcatctctttaaaaaaaaaaaaaaaagaaagaaaaattagctggcatggtggcacatgcctgtagtcccagcttctggggatgctgcagcgagccatgattgtgccactgctctctggcctgggcaacaaagagagatyctgtctccaagtctgtctgtctgtctgtctgtctgtctgtctctctcggaaatattccttcagtgtattagtaaagaagttacttakgagtcacttatgcccttgaagagtgagtgatgtatcaaaatatgtctgtctttattgtttcactttcatccttctttttttggagatggagtcttgctctgttgaccatgctagaggtggcgcgatctccactcaccgcaagctccgcctcctgagttcaactgattctcctgcctccgcttcccaagtacctgggattatagacacccaccaccatgyacagctaatttttgtatttttagtagagatggagtttcacccttttgattggttggccagtatggtctcaaactcctgacctcaagtgatccacctgcctcacctcccaaagtgctgggattacagtcgtgagccaccgtgccggccactttcatctttctgattaactgaaaagtatcaagcaatgcttacatgtaactgcactttctcatcaactgcaaccataatttagctatggatacaagagttgggcacaaatccatgaaagcattgagtgagaatcaattggctctgtgggatttacaataaagaatgttgtttatttttatttgtaaattgtgtgctacagatccttcgtatcagtaaaatgtatgataaacatatgtgtgtatattcacacacaccctttcattttggcaggagtgtttgttaaacatttaccacagcagtggattcacttccatcagctgctaactttcaaggatgtttgaggatgcatgacctgtgcaatgcacctgcttcggtgcctggcacagagtcgcaaagccacaaagatggtgcttgttggttgtatgtgttgtttccatctgataycaccattgaggggagcaagatgacatgtgcctaccccacgtgtccagcagcaaagccacctggcatagtgggctgctcagcgtgcctggttcatactgcgtatttatagtcccagggtgttttcagagagtaaaagtcctttatgattagcaaattgcaggtcctcccctttctgatatttacagcccttgcaaccgcctgtacaaaaatcgggaaaaggcagaagmsggctgtcattaatgtaaaagcagctggttacctccccctccccagcgcacacatcacctcctagtacaattagtcaccatgtcttttcccttccgtcaagccttttagcggagttcacagggatgccttcggtccagacactatgaccgttgacgaaggatttgaaatattttgagaactctgaaataatgcacaccagaaacgtccagctgaaaacaaaaagggaacaagatgacattttgcaatcccatgcacgttgcaggcrcgttgaatgtgaaggtcagtagtacttcagagggcaggcctgttgcccccaagcctgttgcctaagaaatgcccaggccctttgaacaaaatggattcgagtgattacagcacgtcctcacttacatctcccaatatatttcttgttattctcgttgagtactgcattcagacagaggttgccaataaagtttattgtaggagctaagtgtcaatatctgtagtaccccccgcctagggtgctgctaataaaatgccacagatagtctgggagaggcatgaaaatttgatggcaaattgatttcaggttcatcttgaaatttgtcctcagctggactcgatacttctggcagacatgggatggcttttgtcagaagggtctgctggaatgagacagagatgtcttgatctgaatattaaatacaacatgctgtttatgacattatccgtttactgctaaaatacccagctacttctgtttacacattcttctgcgttgaatgggtaagatagcatctcatagatccactttacatatgaaaagaagttgtatcaaacttgctgggcatcagaaataaagggttttagagacactggcttcaaacacaagttattccatccaagattctaaacttarcaatgcaacttgcacttaattttaaaacgctggaaaaataatgataaagattgtgtgatcaagtatagcagccctgtggtgtttcctcagaatggtgtattacagaaaaggaaaaagccatatacatggagaaraaactcccgatatttaatattatcaattgctggttcctgtaaatttgcatttatggatcacattataaaagcaattactcttatggattgttcatgcagaaatgcaytatgatgatamtatacttttaaaagtatatttatttccagaattcaatttgtaagaggtttgagggaaaaataatactgagttttgagtgtttctgattttaaaaatgtgttcagtagaattaaacgtgttcaccaaaacccattttatcmctttaaattattgggcaattaattgtatttacttagcattgaatgcatgattagaaatggaatttttaaaaaagcaatactcaagtggagtgagttcatttgttcattcagcaaataggacttgagtcccctactatgtgcggagccttaaaggatgagaaagatttctgggtgggacttcaatgagactcatttcgcaggttttcatgttattatgtatatgtggtaaataattaattttttcacaagtacttgcactagtgatgctaaaataagcttgactggcttgtaaatcaatgaaggttactgttgcattgctttgaaattgaatttaaaaacagaaacagagcagtccctttgcttccgaatgcagccctcccattggaatcactttggaagaatctggatctgcgtgttacccagtcttactttkcaggcagtcccaggcaggaaggcccattagtgaaaagagccctgcatatgctgtgggtcatcacagctgctgctttgcacatttaggagatatttgtggacctttcattaggacaatttttatggcccgagattaaaagttaaagttaagtagtaaacgtaatgaacatgtgcctttggagattccaactggtttgtattttcattctctccgttggtcatggcccattgaattttgatgatagcattaaaacaaatgcctcaaatcatttttggaaggagacaggatatgaattgacaaattaataaaataaattatacttcaaagatgctaaattatctcttctatgtaagtaggaggctctcttttcagatgtggaatttgtaggagcttgaatattctcaagagagggtatgggcaacatttgataaaagatgtaattattgggtcgtaggaaataatgattgagatagggtatccactgccctggtgggggaatcagtgaggctaggaatcactggaaaatgacattccttgagactccttcaatgggtagagtttgctttagcttttcawgtatcttactgtatgatggttgcttttgggttgaattccaccttgggttcaattcaacatgaaagttaaccttttggtgaaggaatgatccasgggaaatagtaaaatattagcctgtcctccaatacaaattgcctgtgagtcccactgatacttacaaatatacagaggtggtgtaaaaggattctgtgtcaaaactattaatatttgagaaatacaatacttatcagagcctttgtatgtaaatgtctcatatacccctctaagaasgggagcgaatagtattttccaaacttacgtcaccacttaccatccacctgcatactttacacrtcttggaatcaaccttacagggaacacttggtcgaaaaacagtgttttctaaatttatattacagttcccactccccccscccccacttgtatcactttgtatgacagtcttcttgggaacatccattgggaaactcttcccttgcaggtgtctgttacaagtcctggttcacacagtgttgcgaaagaatagttgtatgtcacaattttctttatatagtatttattgagaaacctattctgttaatagaatgactcaaaatcagccaaccccataaatactgctcaagcatttagaaagactttctctatagaggcttcagacgtcagaaaaaaacttagagagtgactttcagatacagcaacctagtctatgttatagaacattctaaaaagagcagattttaatatctttcctcccacacttgctttgactccctcctttagtaattagataattatgtataataagcacattaattatgtgcaacagctgccrttgagtgtgtgcatgtacaactgcttgaaaacagcttgtgagttcactattaggtccatgaaatttttctccttggcaggttttcactattartttgcttgacaaaggatagatacattttccatgtgtggaggtaaaagcagtgcagtgagctaaaaagttarcaaaggtgaagtggtcctaatctgcggccctggtacacttagataggcatcattgcctttcctctgagctcttggtgctgataacagcttccttgaccgataagtgtaccagatttccttacctgtcccagggcaagatagcaagagtttcttgatgcatttaaaaaatgcatttagtgttggcaaaaggctkgcaatttattattaagtggaataagcagtttaaaaacagtatgtacagggtggttttctggctatataaacacacaggcatwgaaaatagatatacataaataatgttactataatttgtctgcctcccttctctcagaaaagaccaatgaattatctattatgtgccactcactatttgagtgctgggaatacagccccataaagtgaagtttcatatatcaggtagcaagatggccatggtctgtgttttgagaatcacaggcgtttttgaggctcatggctataatcccagcacttggggaggccgaggcaggtggatcacctgaagtcaggacatcaagaccagcctggccagtgtggcaaaaccccacctctactaaaaatacaaaaaaaaattagctgaacctggtggttcaygcctgtaattgcagctactcaggaggctgaggcaggagaatcacttgaacccgggaggcggaggttacagtgaaccgagatcgtgtcactgcactccagmctaggcgacagagcgagaccctgtctcagaaacagaaaataaaacaaacaaaaaaatastattccatagctgactattttctgaaatgattttgttacttttctaatgagaaaaaaatagatctcgtgtgtggagggaattgaagatgtaatttcagactctgcgtacagctaagctcatcgtagttacttaactaacacttaaggaattaaatggcatatctgtgtttgagaggcacactgagatgagacaccagctctttttatttatttctaatggtttgcttggtgtactggtcatttccccggaagtgtgcaagaagaggtaggtgacttgcatgttgtctatgaacgtttttagaaacgtctggtggaaccatccgggcatcacatagctatctctgtgcagagccaggccggatgcctaggtgagatggaaagcttccgtcagctttcttgccggcctctcctcgcagccgctcccttccacacctgccttttcacctgccagactgcgcgttgcccgttgccctaggtctgcgtgttcagcacttctgcaacagtttcttctgcaaaggtaacttagcggagggtacagggtcttcttccaataagtcagcaccttcagttaaaaaaagcaataacattctccaatcttggcagtctggcaaggtagaaagacacctgaaggtgaacatctttggcccatgtgaaattttgttacgtgttgttaggtttcatttgtctctcagtcaatcagtcaatcartcagtctctctccttccatccccccttgtcccccttttctcttctctccccttccctgctccctctactttaaggttttctcacagattaagagagtagcatgtgctcatcccaattattgaaaccgtgcaaatgaatagcaagaaaaatagttcttggcgtgcccctttctttccgcagtgcccaggccagaagtacctgctgcccaagaccacagctgacagcgccccgggagtccttcacactcttctctgagctcttccatccttaaacagacatctatgccaaatgcagggagggtttgctgttggcttttacaagaacactgtcctgttatgcctgctgctctttgcttggttttccctggacggtcacaaacatacctccaggtcaacagttaaagagagaacccacttcttctaatagttgtgtaatattccatactacagatattctgttatttatggtagctagatttctattcatttttaattcccatgctcagagctttccagacatttggaaacattttagaaaattgacatcatctcttcaaatatctgaactcagatttcctctgtgatgttggaatctttaaaatatcatgcatacttggcctgtttctacaattttgttccccagccatcgttctccattttgcacgtgtattgtctcctcctattcctctgtacccttcacacgtgcctgcagggtatatacttttgcacaggcaaaagtccagctgaaatgatccttacttagcataatttaaacgcgagggtttcctaatgctccttccatttaaataattcaaaaatccgtggcaaggtacctgaaaactactaagagaagagaggtgttaatggacacatcattgaggctgaagccaaactgtgtgattctgtctgcagttgagaactgtaagaaaaagatcaagattaacattattattattggtgttacctcatgtctgtacctttttggacacktgggtctgtttcccgagaaatcatttttcctcctccttgaaaatagtgaatttcaagtggttttaattttaactgcattatttgtttgctttatatagtttttaaagttttatgaaaaagtcttccatgtgttttttatttatgaaatcggggcagccatccttcaaatatgaagcaggtatctgagaatactaaaatcttacagtgcattttataggagtgtgaatgatttttctgcaattgacatatcaaggagcttatcatctattattaagttaccttttcctgaaacaaaatatttgtcagatgtaacttggtacccaaatgccttttcttgctaaactaggaactgtcacacacacccacccacccacccctttattcttggttctctcctatattttgacatttgaagcatccacagaaaagtaatagaatgagcaattgaaaatcaccagaactgaaattatttccagctatgtttaaatatgaatgtcttgttcgacgcttcgcatatgtatttatggctgtgtgatatcattatggcatcctaatgaatgtctactgaattatgtgggattcaacaggggatacaaatggatttgaattctgtaactgtcatattgtggtccggagagggtggaaactgaagtatccctctgcgtcgccacatctgtcaaaagtcctcagcgctccccgcaatccatgtctggtggaagcgcgaggtggtgaggatggaaagggcatgcgttgacttcatgttgggacgggtcttaaactaaacacatgtcacgttatggagctgtttaccttggctttgaggtttatttccttctggattaagagtgatgtcgttttatataacaagaagtgaaaaaaaaaaagaatgatgttacacaacctattttttttttttttttttttttttactctgaatgtgtaactttaaatgaagaaccaggacacctcatcctttagtcttttctttactagtgagtggcagatatgtgtggaccacagagatggactgaaaagagaagtaacagtccttggtttgtattccagcccccaccttcctatgtctttgrgcttggtaattagatgcttggagcttcagtttccccatctgttggatcagaacggcagtatgtgctctccagtattttcataagagtcacatgaaatatgtacctacagagtctatcactgtgctttttaagttggggcttaatatgtggtagttgttgctgtttttgttrttattattattaatgttattttttgtttgtttgttttttgagatggagtcttgctctgtcacccaggctgaagtgcagtggcgtgatctcaactcacckcagcctccgcctcctgggatcaagtgattctcctgcctcagcctcccgagtagctgggactataggcacctggctaatttttgtattttatattagagatgggatttcaccatgttggccaggttggtcgtgaactcctgacctcaagtgatctgtccgcctcggcctcccaaattgctgggattacagacgtgagtgaccacgcctggcccataaatgttatctttatataacatactcacagctcccttaggagtacttttgtccatttctacacaatggaaacttayaattttagccttagcaacatgtatttactgggcatctagatttcatttatttaagaactttttattgaatgccgattgttcagcagccaccatgcaaggtcctggggaaccagtgggcagccacacagagaaggtcccaatggcaccagaacaaggccagcttcctaggaggtgtctggcttcaagacagggatttcctttagctgggtggtagagaaatggattgcctgtgatttcactgtgcataaaatgacctttcagcccttaacctgcgacatccacatgtgttctttggtactcacgggtgttatggttcatagctgtggtcttctgaagtataggaaaaggcagcttacagaaaaaaacttgcttgtttactgtcttctgagctgatttctcacctactggcaagtggataggtctastttttgtttagctgtttttctaatttaatcttrtacatgagacagctatagatggatgtatagtctttgaagtggggccagttggctccgtctattagctgtgtggcttttgtgcaggtgacttgtggcccccggcctcagggatctcatctctaaaacgaggctcttgatgttacctgccttacccagctgtgaagattaaaagggttttgtgtgttaaaggacttgcggagtgcctagaacccaatgagggccacagagcttgctccgattgctttcctgaaggcagtaagcatgttgctctggtaatagtcatcttcacggccatcattttgatcacattttggcttagtttcttcctctaccctcttcccacgtcagacctttccatggaaggtaaaacatgttaacagtctaatgtgtttccttctaatttttttcttcatttatattatacatctatgaaatatatatatatatattacatatggatatatagacatacacagatgcatatttagggtgtgctatggttagaaagtttgcatccccccaaaattcacaggttaaaatcctaatcctcaaggtcgtgacggtactacaaagcaggacctttaggacatgataaggtcctgggggcggagggtactaatccccatgaatgggtttagtgcctttataaaacagacccaagagagaccgttatccattttaccatgtgaggagcccacaagcaggtgccatctatgagccagagtggacccttacccaacaccacatctactggcccctttatcttgaacttccagcccccagaactgtgagaaataaatttgttactcataagccacctaagttatactattttgggatcgcagcgtgaatggactaaaggtttttgagattcttttttcagtagtttcacctaataaaacatggaatcattctacgcatgctgttctgtattgtagtatggttttccacactgagaacatactgtgaccatgcagtcatttcccagatggaacttattgagggacattcacttagtttcgaaaggtttctccctccactcccatcccggccacagatagtgatgcaataacatccttgttcgcatgtccagtctgaagcttttattcctatgggatgagttcccaggcataggattgccaggctggactctaaattttgaaaatggatttttatcattctgatggattacggtgaagagagccaaagtcttgatagaaacactcaacgcagtgaattttttagatgtaaaagtggatggtacttaaggatacgcacattagaaggagtaatttgaccagcccatcacagtattaattgattttcatgtctcgaagacttctgatttcgttttcgaggctggaaaggcaggtggaaagcccatcagttttacacacatattttgcagacaagtattagaaagtaactagcctgcttttactaatggttctgtggaagaaacacagcttgaataaatgtcgtcttggatgctcagcacagattggcagtggatgtcaggattgtctggtgggaaggctgctgggactcactctagactgggagtggggtggggtggggcagggcaggacggccctggctgattaataatgtttgttatgaagtctagggtacgtggggagagcttcatgaatccctgcattggccacccctgtaccacggccaatgattcaccctccctaaatcccagggccagatattagaacatctgtgatgaggactgattttctgttcgtggcctctggaagtccagtttttctgagctcaggggagccttggttgtatcttataggcaagagacgaatttacattttgccatggtgttaacaagcaaaagaagacaaaagagctcaaaatagacagtggcgtgctggggtcaggggtgctggtcaccagggcgagcagttatgggtgaagggctgaatttgcagggtcaaggagattgcctccaggccccttctggaaacacactccctgagccttgtagaattgagttgattctgtttaactgcccagtgaagaaatgacttccttgctttaaaacatttgacagctgtcttatataacttaattcttcattccagtggcttttggagcagcctcaaaagtcattttatcttcttggctctttgatattatttgtagtaatttatttaaagtaattagagacgggatcttgctgtgttgcccaggctggtctctaactcctggcctcaagtgatcctcccacctcagcctcccaaagtgctggaaataaggtatgagccaccaagcctagccttgatattattttttaatgggggtgtgtgggtgggtggtgatggggatattccagcagaatatcagaaacagagatgaggaaggcagagagagctcaaagacaaggctcaagttcatattccaacgccagtacctgccacctgtgtgaagctgggctaattatgtgtttaggtttcctccttcgttaaatagagttctacttatattacagggttgtcatgcaagttgatgaattaaatacgctaatatatataaattctgagtaagtattaaccaaagaaatggaacatcaatattggttcccagtctagttcacaggtgttatcaagatggttacctttctaagtgtctttttatttcactagttccaaaagagtatctctcaaaatattaggtagtatttagtcaacactttaacacataacttgtttttttttttggcataagaagcccatgtgaaaacacagttgaccctaagcctatgaaaaatgacttgtgtgtgggactggggtggctcataggagaaggaggatattcgtctggatttttactggtatgtatatatttttgggtactggagatggggacagtgagtatttgaagctcacagcaggcccattttgcaagttttcaggaaactgaaattcagagagattaagtattttgccatgaatcactttgtagtaagtgggagagctgttgcaaacccacgtctgtctacatccacagcctgtgctcttttcatatacaagggaatatggaggagaagggaagtgatggaaggctttaaaaaaaaaaaaaaaaaacttcagaagctgatttgagatttattcatctttggtgtactttctttactaaggcaggttgtagactcatgaaacctagaaggagttgaaaaataagggttaggattaaaaaaaaaaactagtgaaatcaagacaccattttgcttaattgaaggcttgcggaacattaaagcacaacaaaaacctaattctttgagtgtttctgaggccaagccttttcccacaaggcactgtgtacacggttctggaagctctcctctgtttgcacagtagtcactcatcctgctctcgggctctgcctgcagtctcttcctctgtctccgatgtcactcttctctgtcttcttcagaagctgtcatatgacctccagatttctctttgactccctgtattaccattagaagacatctacactgggaaattgctcagttcctgtttttgattaatattttatcagccgcaagaggaaatggtattctatagcaacactaataagtaattgagcagatgagatgctcttgctagctttggtaaaaagtcggggcaaggttacaacagaggagctctgatgagacttgggatgrtaaagtcaagtcgaatatctggtagggttaaaaatctaacagtgggccaggcgcagtggctcacgcctgtaatcacggcactttgggaggccaaggcaggtggatcactcgaggtcaggagtttgagaccagcctggccaacatggtaaaatcccgtctccactaaaaatacaaaaattagccaggcatggtggcatgtgcctgtaatcccagctacctgggaggctgaggcaggagaattgtttgaagctgggaggcggaggttgcagtgagctgagatcgtgccactgccctccagtctgggtgacagagtgaaacccatcccccaaaaaaataaataaataaaaattaaaaaayctaacactggtacgagaagaaattatgctctaaatccttctttgagcagtggcttacagacctaaatttatcaaaggtggtggcagtaatagtaataattaccatcttcatttaaaggcacgtatctaaaccaaaggacctaaataaaatattaatttttcatagtgtttaatatgtgccagtatatataaattcaaggtaaggtagacagctgtaaactggatsccctgctgtacccagcaaatgctgagagccctgcttcccctcttgtattcaaatggctctataagagaggaagtagtacagctatcagtaacaatgccatccggtaattaccgaatcataaatgtttggggagctgaaggtcacgggcttagtagcaattctagtctgatgtttgattccttgtgaattttaaatgcttgtactctctatctgggtgatggtgttttagttgccagtggacagtctgatggaggtgggggaagagttattcttccatatttatttttctccaccttgggtgaaaaaacttcgcttttcgtaatgtggtacagtgtgtgcttctgtaaatggaaatggtttcagcacatcacagtcatgcttccctgttgaaagatgctccgttttcccgcatacatgatgtccagcacaacgtctgatttatgagagcatgaccctgggggcctctggaacagctgctcacacactccctttaggaggcccaggctctcaggggaggcccatagtgcagctaggagctagagttttaggatgaagaaattacaggtaagaacacagccccattttaagaaataccagtgatttctgtttttccttgttcttctttccctcagtattttattaacatgtgctactatacaaatacacaattcacttaggactctgtttcgtgtggatcacatgggagctttcattaaattgtggtgattccaatgtgagtggttatcaagtcaacatcaaataacatgaagtgtgttttagtcggcaaacatcactttgtaattctctgatgtgtttgggttgattcccttctttctgctctttttctctttataaagtaaacatttttattgcaaaggtactgctattgttagtttctaaaggcacttgtcatggtgtgactaatattagaagcagacacagccatgatgagcaatactctttttttgtttatttttgwtgttactgctgtaagccactttcttctccctctccrttaaaatgcaacttaattggtaaagtttagttgactagagatttcatttatttatttatttatttatttatttatttatttgtttrtttgtttgtttgagatgagtcttgctcttttgcccaagctggagtgcagtggcatgatctcggctcactgcagcctctgcctcccgtgtccaagtgattcttctacctcagcctcccgagtagctgggattacagttgtgcaccaccaggctctgctaatttttatatttttagtaaagacggggtttcaccatgttggccaaactggtctcaaactcctgacctcgtgatccacccgcctcagcctcccaaagtacttggattaaaggtgtgagccaccgcgcccagcctgtatttatctttttaagtaacaaagtattagcattgtgataaataatatttaatatatagtaagggaggtcaaagtatgaactattttgattttttatgggtttttttttttttttttaaagaatgcgttgattttgtttttctttcttttttttttttttttttgaggcaggccttaggtctggcacccaggctggagtgcagtgacgtgatcaaggctcactgcagcttccamctcctgggctcaagcaatcttcgtgtttcagcctcctgagtagctggaattacgggctcatgccaccacacttggctacttgtttaattttttgcagacatagggcctcactatgttgcccaaactggcctcaaattcctagcttcaagcggtcctcctgccttggtctctccaagtgctgggattataggcatgagccactatgcccagccaaattttgtttttcttttcttttttttttttttttttgaaatggagtcttgccctgtcccccaggctggtgtgcagtggcatgatctcggctcactgcaagctctgcctcctaggctyatgccattctcctccctcagcctcctgagtagctgggactgcaggcgccagccaccacgccyggctaattttttatatttttagtmgagacggggtttcaccatgctaaccaggatggtctcgatctcctgacctcgtgatccaccagccttggcctcccaaagtgctgggattacaggcattagccaccacacccggcccarattttcttataaagtcaaatgggagatacttgtttgcargaaatagttcttttggttcttacttttccataaggattgagtctcaaaatgtctggtagcatccactgcattttgtaggggacaataacaaagaagatgccagcaatatcttctatcttttccaacattattcacctctcccacccaaggacaatggtgggctggacagagcattcaatgaccgagaatctaccataagctactagggccacatcttcccctttcttctcccccaggtttgtcccatttgtactgactctgacccaggttgtcatgacttgagactcactagaagtttcagaaaratgcasactgctttaaaaaaaaaaaaaaagggcaaggggaggtgtgagaagaaagtataattctttttcttctaackggagatataaaaatcatataagcatgatttatsatttgattggaacattgtattttatggttgcagagcacaygtatcatcctatctgcttctgacacccagtaagcagctctggcttttataattttgatgaaagargtttcccaacagtatttcggtgtgcatgctcacacaccagccctggtcrtcagtgaacagattcttccaggtcttcattgtrgcggaagaaagtgagatcagagatcccgaggaagggcttcagtttcaccagtagtggagctagggagtagsggggcagaagccgcaggaagtcagtgcaggacgccggaggccactcctaattgcttcatgtgttgttgccgtgctgatgaccttggaggcgctgctggtcctggatccttgcgaccttttcttccaagaggaaatgtggtgctgagccccccttccactggctgtgacaaagaaggacccctcatgtgggggcctaattctagtgaatccccaaaggtacatgttgaaatagggaaaaggcccaggtgaggctgtctatgtaatagagaagatccattgcaaaatgaaaatatggggttctagccaggggcagggaacttaatctcccttttccatgggcccaacacctgaatctagggcaaacagstgtcccccagattggatcctctgctctaggacacattcttgtcctagagcrggttgggcaagaggcttttctctcagtcaccagccccaaaccctgtggtcttgccagcccaggacgtgtcaagactgcagcctttgctgacytgtgaccatctccaagtccatgcccaggcccctactaggagttgagggcaacaggggcagtgggtctctcctgcttaggaaatttgggttgagggtggcagtgatcttgaggggggtctgggagggaggagccagcctggcctggtctggcctggcccagtgtgccagckagggcaggtgcaatggctcaygcctataatcccagcactttgggaggccgaggcaggtggatcacctgaggtcaggagttcaagaccagcctgaccaacatggtgaaaccccatctctactaacaatacaaaattagctgggtgtggtgatgcacacctgtaatccctgctacacaggaagctgaggcaggagaatcrcttgaacccaggaggtgaggttgtggtgagccgagatcatgccattgcactccarcctgggcaaaaagagcggggtaaaaaaacaacaaaaaaatgatgtaggaatgaacagatgaacaaccccacacaacctaaggacractttgaatcaattcttctaagctggtagcagaagccacctttccatttgacttstatctcgctctttttttctttcttttttttttttttggagacagagtctcactctgttgcctagactagagtgcagtggtatgatctcagctcactgccacctctgcctcctgtaatcaagagattttcctgccttgggcccctgagtagctgggactataggcatccaccatcacacctggctaatttttgtattttttgtagaggtggagtttcgccatgttggccaggctggtcttgaattcctgacttcaagtgatgagactgcctcagccasccaaagtgctgggattacaggcatgagccatcgcgcccagccagacttgtatctcttaatgagtttaactacatttaaccatgtatgtgtcagtcctactatgcaccttacagctcactaaccctgtttaataatgtatgttgytacatttaatctttatggtagcctcatgaacaggytcttatttagttcagtggttcttgatcaggagtgatattgcctgccagggaatgcatgtcaatgtctggagacatctggggttgtcagttcaggagggtagaggataggggggaaaaggtgctactggcatctagtgggcaaaggccagggatagtgctaaggatcctgcagtgcaaaggascatgcccaccacaaaatatcagcagtgccgaggttgggaagctctgtgccattgtgcaaagattcaaggtggctatgtcacaggactggtacatgtccttttttttttttttttttttttgagacggagtcttgctctgtcgcccaggctggagtgcagtggcgtaatctcggctcactgcaagttctgcctcctgggttcgtgccattctcctgccttagcctcccgagtagctgggactacaggtgcctgccaccacacctggctaattttttttttttttttttttttgcatttttagtcgagacagggtttcaccgtgttagccaggatggtctcggtctgctgatctcgtaatccgcccacctcggcctcacaaagtgctgggattacagacatgagccaccacacccgccctacatgggtattctaacccagtctagtgatagtccaacctcctgtactatgagtaattagcaaagaattaacagcagaagatcgctctcaccaaagcccatccagaaagtggctcgtattcaaggtgctaattagggtgttttgttgccagtaaaaacatgagtcagatttcatgattgattcatgatgactttaaaattaatgctgctgttatcatacaaagtagtggtaagtggaggtaagagaatgtttttgctttggggtactaagtcatcgttataataaacacacagtaaacccatttatctcaggcttaatgctttcttgtttcttctaagcacttcttaggtgcctctgggctttttaacattctttggcagttgtaatttattaattgatttttaaatttggccggtgaaaatgaactttargtaggggtttgaggaaaatgaaaaggcctattkgtttttcagtggctggttcttcgtgttcagcattaaggattggtagaaatcaggcaacctctatgtaacctcagccatcttggattcccagcttactcacatcatagatggagagtcagttgtttagaaaaaaactttcttttttttttctttccttttkcttttcttttctttctttctttcttttttttttttagggagggtctggctgtattgcccaggccggagtacagtggcacgatcttggcttactatagccttgacctctctggctcmagtgatcctcccacctcagcctcctgagtcactgggactacaggtgcacactaccatgcccagctaagtttgttcattttttgtagatacagggtctgactgtattgcccaggctggtcttgaactcctggcctcaaaggatcctcccacctcagcctcccaaaatgccgagattatgggtatgagctactgtacccgaccaagaactttctattatatagattttaattaaaaacagtcctgttgagtggcctctttatcaaatgcattctcacataacctcatagaagtgagccctcttactgaattatgtggctggggttcttgggtatgttttgttctattttctggttggtggttttctttctgtcgggtcccgtgggctctttytggacctcttctcagaatgtttttcgttttttttattttttgagatggagtcttgcactgtgtcctgggctggaatgcaatggcaagatccctgctcactgcaacctccgcctctcgagttcaagcgattcttctgcctcagcctcctgagtagctgggattacaggtgcatgccatcacacctggcaattttttttttatttttagtagagatggggtttcaccgtgttaggcaggatggtctcgatctcctgacctcgtgatccacccacctcggcctcccaaagtgctgggattataggtgtgagccaccatgcccagccctcagagtgttttaaaatgcatactattaaatacctaggattataaagggagccagctatacttacatatagttctctctgtgaccctgtagaatgcactgaagcaaaaataacaggtaatgctaatcataaagttttacaaatctcctgaagagtcttgttggtttcygtgttgatgaagcaggaaatttccctgacccctttgcaggcaggaagtggagtgcggatgctggaactagctggctgctttggtgccagtagaggtgaactgcactcwcttgaaccccctgcactccaccccttctgggaggaagcatgcaggtgagcaggtgcaggagccagggtaaatgcttttgggcactggcaggaatgaactctgtactggccctgggatagcatctggcaggggatgcccgtgacccctgaaaccctaaaaggagtgttacagtcagtgctcttttagttttgccatccacggacggcttaagtgttaacagttsagtggagggtcagcgtgacagccttttgcacccacatctgggttcttgtccagtgtccaggaggaaygaggtctcatgagcaaattttaaggatggcaratgtgggggattttattgctgatgaaagtggctttcactgggaagataagctaaaaagaagacaaagcaggaaggtaattttcccctggagctatgccatcaagctgttcttctgaagtccagccgcttctctccaactgtggtctctaatttccagctgcttctcctcttttcttcaatgtgccagcggagcctggggtttttatgggtacaggattgggggcaggccgggccatgggtggttgtggaaaaggcaatatttgagtggaaaaacagggatatatgttctcactttgggccacagttccaggcttgaggatggggccctcaccacggacctgccctcttctgcccagaatttccctgcctcctgtccctatcattgatacctgcaattctttgtacatatgaaatttaatatggtgagattggcatctagctgctgctagagatagtgctcatartaatttttaacattgattgagtgtrgataataatccaggagctgtgctaaacgttttacaacacattatctcacttaatttcacaactccataaagtagttttcacttagttgagggatgaaaaaagttaggctctgagaattgatattactctgcaaatatggaattggaatttcaaagcaatctatggtctttatcacttctccattaactgtccttgttttattaatgctgattactttttgatttggtttggttctttggagttgtttgcatttcrtgagtcttggcatctttttggtagagaaccttgctaggttctcacaatgtagaaattaarcagaaaacagaggtctcaatttgccttttcagcgtgaatgcagactcttacattcagtgctgggagtctttcttgagggacagtgagagcgaggaagggtttccattctccgagatggatggttgcattagtatttatttcctttttgtttttccttaggatgagaaagaaggcagtggagcccttttccttaggttagaatggttctgttggttgaattgtgcaccctgtttggttgaaacaattggacagtaaggatgtgactattattgttgctctctaatactttattatgtcataccaaaaattatcttttgtattttgctaccagttcttttagtttctcttacatgtatgaagttggatagttagaatgagatgaaaataaatgggctgggcgtggtggctcatgactgtaatcccagcactttgggaggctgaggcaggtgaatcacttgaggtcaggagttcgagactagcctggccaacatggtgaaaccctgtctctactaaaaatacaaaattttttttgtattttgggattcggtttaggtgatgtgtgtctgtaatcccagctacttgggagrctgagacaggagaatcacttgaactccagaggcagaggttgtagtgagccaaacttgcacaactgaactccagcctgggcgacagaggaagactctgtctcaaaataaacaaacaaataaataaataaaaattgtttaaacctgccaactacaatawctttttcagtctctttctccctttcccaccttcccaaaagggtgggaaatttttaaagtaaagtaataaacaaataagttttgggttgggcrggagattagttagagacaggatctgtaggtcagaagtggtatttgggggagtagggagttttktttttttttctttttcccttatgcatttgggagtggaagagctgtcagattctgaatttagttagatttataatgctagagacattcagcagtctgcctttycctttctgttataaaatcatgtttttattgaattacattttaatattggtatcactttaaaatgaaaatgagtacttgcaaamtgtatttttgaaggagttkggtggtggtggggggatgccattttggcaacagatgacttcggttcaagtcctctctctgtctcttacttgctttgtggctttagaccagccacccactcagagccttgaaatcctcatctttgaaatgaccatagtaagttcctgcctaggctctcccctgaagctgaaatgcatgaacatgctttgtaattttttttaaggattgatactagctagggtgttgataagaaacagcaggcatagttactgggtgattgagaagagtttaacaaaagactrtattagtctgttttcatgctwctgataaagrcayacccaatactaggtcatttacaaaagaaaaaggtttattggacttacagttccttgtggctggggaggcgacacagtgatggcagaaggtgaaaggcacatctcacatggcagcaggcaagaaagaacttgtgtagggaaactctcccttatgataccrtcagattycttgagacttatttgctattgtgagaacaccttgggaaagacctgcytccatgattcarttacctcccacctggtccctcctgcaacatgtgggaattcaagaagagatttgggtgggtacacagccaaaccatatcaaaaaccatttayaaaactctaagcagccttaaaggaaaccaccaagggaccaaggcctgatgaagcaagagtaggagggaacagatgcttggatagggcaggtgagtcacaggctgatgggagctgccaccgtcagtagaggtcctgatgacctgggagggtgggagccagacagatgggagtatcctagcctcagttcctttccatcctcagaactcctcccagtgcctctcaatggctaaaccaaccaaaggttggagctcaaggaagctcctgaggctatctttacaggtcagccagttgggaacagagttgacggagaggggacaggaggtgactagatttggaaggaaaattagaaaacttttggccgggcatggtggctcatgcctgtaatcccagcactttygggtcagttgagtctaacataggggtgtccaaacttttggcttccctgggccacattggaagaaaaagaattgtctttggctgcacataatatacaattgttgatgagctaaaaaaaaaaaaatycccraaaaatctcataatgttttaagaaagtttatgaatttgtgttgggccasattcaaagttgtcctgggccgcatgtggcccaccagcyatggtttggacaagcytagtctacaggttcttcaagaggggcttgagcatttgaaagacttctagtgggagagatcacaaggkacaastagaaaatcctgggctggcctgagaggcagacctgtgattattttgctctttgaaagttgtccttctgcacccattttccccagacctaacctcgatttgtgctccaggtctgagcagaaatgttattccctccaraaagccttcccykgatgttgagggatgaagttgtagscccctcccgaatgcrtcctcagaactcgctggttctcgtcctcgccctcagcatacttgctcattgtttgtttccatctctatcatctctgtgagccctttgaggatggatgtgtgtccatsttgttaacagttggmtccccagtaaccagtacagtgccagatacagagtagtaaccctacattstagcgtaggcaaatattctagtatttgccaaaactagaggatgaatgagtgatgggtaagagagttctcagaaaaatggatataaacaatattgtaaatcatatttggaarataaataytagaatcattgaatccctgagttatagaaaaatttattaatagcgctatctggctactttttaaagtgtggacatcctcgatgtattagctatgcatctgtggataggaggcttacccactctgagtcttgtcaaataccaaacacaggaaaacaatatcttcctgagaatgttgtgaagaatatatcatccagtcagagtgaatcagcttgcccagtgcttggcatatagctgctcaagaaatattaggcattctttgttattataaatcccctttgtattttaaaaycctcatgtatcactgaaacaaccaactgaaaaccattgagaggctcatggtgaaagaagacagacagtgtaatttccctggaaactcaattttgattcagacgtccacagcatctcatttctgcctttaaaaaatttcaagagtgrcattttggcatgaytggactcacaggtggagaaggtatgacaaacattctggaaatcttggaaggtgaaatatagggaagatggcccctatggaggttcattgtcccccaccttattctaaataatgactttcttaaaactacatgttttgggggaatgtcctgcaatattgctttacatctttttatttttttattttattttattttttttgagacagagtctctgtctccaggctggagtgcagtggcacaatctcagctcactgcaacctccacctcccgggttyaagcgattccmctgccctgatcagcttcctgagtagctgggactacaggtgcgcgctatcatgcctggctaattttttgtattttagtagagactgggttccaccatggtggccgggatggtctcgatgtccttacctcatgatctgttcgtctcagcctcccaaagtgctgggatgacaggcatgagccaccgcacgcagcgtattgctttatattttaagactatacactgatatccccgagcmcccaagttcctgtccgctggtagaattcacaaagctggttttatgtctccttctcttcctcttccagtgttgtcttttccctgcattgagatagcattgcatggagatccttgtactcytcgaacagaggctgcagatggacacaggatctgctcagggagataagatcacctgctaattctgctttctccatcagagtctgaatgatcagtgatggggaccagagctaggttaggtctctggaaacgccctctgtctgagtccgggagatggatgatatgggtaatgacttgctgctttatcttctctccatctccttacagcagctccaactactgacttttattgtgtggcagctaattgtaggattctatttctgtaaagagaaggcaagagaggaatgcagtgtccaccatccctgcagccctttggcgccttccccctcccattaccttgaagtagagggaaaggggacgacagaagaacccttagaagtaagactttttctgtctctgatgccacggacctttgaaatatttttttgaaaagaaggcctcccttggctgataccttctgactgttagtgaataaaggaagtttaaacaatctcttccctgtaatcattaatctcgtcttctttgttacaatgtatgttgtggtctttgttacaatgtatgttcacgaattcctagaacactgttcccgttggccatgggatcaggggaagagagaaggaagagagaaccagacacaagttggagggaatccatctccagtgctgctcagaggtatgacctagagcaaggggtttaggctttcttggactcattttcctcggtggtgaagtggggataatttattgacagtggaccgtgaggttctgcgcacaaaattcgttgcatagcacctgatacacacaaagctttcaggcaaggttagtttcgggtatttccagccttagtcttggctgtgggagccataatggagttgttcagaagtttacagctagtgtttataaattgcttgccatggggccttgtatacagtaagcattcattaagtgttccctcctattatatccttaggtttaagatacaggcaccacaacataaaccacccccagagtacacatgcatgggtgtaatttggtgccattctcctcccttttgcccccaccaaaatgaagtttttagtgtaaatgtcatgtagattttaaccaaaggttgattggagggtctgagtttctcagctaaatgaaggcatgaggactgtatccctcctgaagggtgtgatcagttccatgagaaagaagctgcgagctgtggggcatccaagataatgtaatctgccccggggtcctgtgagggactggccgacaaggcaggctgaatgcagccttgcccactgagctgggttctctctgctttaggtcctctctggaggtgaagagggaagtccgctgattgtttttctcttggtgcaacttcgcaccacccttacatatcccagtgtatatggtagccaaggacagtactgtttgagcctcccccattaagtgtcaacattgaatcaatgcaatcccatgcaaasaaagctgagcatgggattgtgccggtttagccagctaaagtgtggtctctgatgctgatcatgactatgaaaagggaaaatggaggagaatgatgacgaaggaggaggaggaggaaaaggtgacttgcctctagctgatgtggattatttctcttttttaatttccatgtctgygtagcttcatcatagatctcarcttaaggacaatgaaagtcgtttattgagtacttagtatgtgctggttgcagagccaagtcttttttttttttttttttttcctccttttttgagagagagagtctcactctgtcacccagactggattgcagtggcacaatctcaactgactgcaacstgcacctctcaggttcaagcaattatcaggcctcaacgtcctgagaagctgggactacaggcatgtaccaccacactcagctaatatttgtatttttagtagaggcggggttttgccatgttgtccaggctggtcttgaacacctgacctcaggtgatctgcctgcctcagcctcccaaagtgctgggattacaggggtgacccaccacacccagccagagtcaagtatttcaagtattagagttgtctgcctgcctccctgtctccctgccttccttccatctgtttgttatctgacttaatctttgaaataacccaatgatacatgatatgcattttctaggtagatagatgaagggttaggaagatgtaacttgtcctaaatcacgtgtcttctaagcggtggaactgattttctcactgactatagatgttgagcccattamtgtgatacctactgccttttaattttaaaagttctcattgttttatcgttttcatcattatcatatgatttacctcttctcttgtgtcttataatccgattggtcatgctgacatactaaaccatattgtttgccactgggaaccaattcatctgtgaaaagtcatacagataggctcgaagaaagagcttggttgtgatgttgttgttgtgacaactgtctcgggggctggagttagagccagggtcccagctgccacagttcatgtaggggtagaccagtgcttccttttgggtgatgaggaagctggatttggcagctggttttgtctggatttgaaagggaggtaatcaggggtgtgctgggagggccagaacgatccacccacgtgttggtgccacccggcartggaaaagcctctggcctcggccttctccggaaggttgtccgcggtgccagtgagagctgcttttcaccttacagcagccccggcctatctctcaggaggcctgctgataatcagtaaatgaaattcacctttccccgattcttgaaaacggaaaagatgagggttgaattatagggcaaatcatgaacactgtcttttttccagcatggtattttgagcggcacagaagggggtaattattttatttggaagaacaaatttaagtttggcagttacctgaaagaaaatttagtgattgccagtccattctctagccttctgaagaagatagattgtaatctttaattaagctatcactcacaccmaaaaaaaaaaaaaaaaaaaaaaaaaagyggggcaaggggttggagaatgttcatatcacattattttggatgtctggggttgcacctggaagctcagatagcaatatctaggcacggctgccagygctctatacattsacgtttgtttaatattttaatttccccatgagtcttaaacctctgcgtggtgtgcaagttgaggcctggtgtatgcacttcggccacgggctttcccaytgtaatgaagatggaatgactccatggatgacctttccgtgcctttgtctgtagcctgccctcctctttaactgaacaccttccagacgagcatgctctgaactcctgaactgstcattctgttctctgagagaattgctcaagctgcagtttatcattatatgcctccaaagactttgtgtttcctrtgtttgacatcgagatagaatttttcataaccctttactagtaataaatttgattgttaagggaccrggttaatcttatttctaataccagcatctgattttaaaaccctgatttaggagcattttctttctgctaccttcctaaaacgcatgggtggaaatgtataaaatatgtcacctgatattggaggattgtttatttctgttcatttggtcctgaatagtacctatgagatgcatttgaaaacttaccttgtttatatgtttcttctgttgcaatttcttccattacctggaatagctgctttggacggcaaaccaagcaatgccctttcacagstgtgggatgaatggggaaagaagtcttggtaaggaagcaattcagagaacatggaagcatctcatggcagcagtcacaattttgtgttgcgtaatatttcaggaacttgcaaccctgataacttgtgcctgcctgtctgtaggcctttaatgatgttttattgaattttggttttccmctagactttgcagtgcatgacacatagtaattgctcaataaatatgtgttcaactgaactatggtggttaggttagtaattagatgcacagacaaaatcacaggaatctgcgtgagccttgtcctactggtaaaggagtcttgtgaggattaattgaaataactcgcaaaaatatccagctctctgtttccctgctaggggctcttgtcataggagccattgttgtagccttagaaaacatacrgcattattttagggggagaggttagagtagaattttaaagagtgcatttctcttccagtaagcaattctgcatcgataaaaagtggagaaagaataagtgaaaaaatatttagttaattcttgttgacagaagtaggacttcaggtccacatatatttcattgtagagtgcacacatgcatttttaagaatttcccgattctcttccacgtgtggacagattggcacatatgtgtgtgtgcaaattgtacttgcagtggctgcctgggaaatgaaatttctgcaccttgccagarcatgttttccctctaaagagaggcagctsataattagtaatgctaatgtcggggtgagatgcaatagataatctaacaccagcaatgatgcccagagcatttatctttgatgctgggaatgcgttcattttctttatcttgccattactgtacctctattgggaaatttactctctcttcatagataggatcmgathcagtacatattyakaaaaccacacttacatttaaatacaggcctttcccatttcacagtgtttctagctcccctttccaatacatctctctctctctttctctctctctctctcwcwctctcamacacacaacacacacacacacacaccgscaaatcagacaccaayataaactgtagagttaacattctttttccaccctcacactttttttagctccgatctgtgttcaatttctgcctgagagagtgawatattcatatatttaggtatagttagaaaaagcaaaatggtaacaatagaatcttgatgggattgatctcctgcagcaaggagcaacagaaaaaaaaaaaaakggaatcaagaacccaggtgctttttataggttaattgtgcagggttatcatgtatctctttaaaatcaccatcttgattctgagctttggttctacacattagaattgttgcctgggcctggatttttccccttgcatgttgcgtgtggtagtccagcacatttgctgattgcaaatatacttgtctcttctcatgggcattactagtactcaggaaatcattgatgtggggtaaaatgagaaaaggattagttttattttggacagataaacaacatgtcattttaccaattgctcattaatgctgatatttcccgtgggtctctgactctgaaatctgcatggagtggttacaccctgggcttgttagctcctacctgagctctgagtttctgtggatttctataggctcctgcaaattttatctagtggatattttgttaaaaaaaaaaaatggggtctcattctgttgccccggctgcagwgcagtgacatgatcataactcatggtgacctcaaattcaygagcccaagcgatcttcccacctcagcctgagtagatgggactacaggcatgtgtcaccatgccaggctaatgtttaaaaatttttcttagaggtagagcctcactttgctgcctargctgatctaraactcctggcttcaagtgatcctcctgccttgagctcccgaagcgctgggaccaatagagatttctctgagaattaggtcccccactattaataaggtcattgtcagctgarttggggaggtggcgtgggtagatacaattaatttagattttttaaaaggcttttgagaatattcggagaacctaatatattttgagacctgacatttattttaaacgtgaaaagcaatttacaaaattgcacatactctataaatacacttctgttataaaaatagacacgtacggccgggcgcggtggctcacgcctgtaatcccagcactytgggaggccgaggcgggcggatcacgaggtcaggagatcgagaccatcccggctaaaacggtgaaaccccgtctctactaaaaatacaaaaaattagccgggcgtagtggcgggcacctgtagkcccarctacttgggaggctgaggcaggagaatggcgtgaacccgggaggcggagcttgcagtgagccgagagcccgccactgyactccagcctgggcgacagagcgagactccgtctcaaaaaaaaaaaaaaaaaaaaaaaaaaaaaaaagacacgtacacagacaaatgttctgacagaaatacactgagatatctacagtgcttgtctctggataggatagggtataatttaattgtttatagttaagttaatgaacttggccagacagacctgggatcaaatcccgcctctatcatgaattggctgtgaggtgtgacattgaaaaagtgatttagcctttgttcccctccaggtccttatctgtaaggtggcagttacaataatacccacctcccagggttatatgtcaatgggttaggcacagacctaggaactcagcaaatggactactatgaagtattagctttttactgtttctggttttctgatttttgtctcctgttgtgaacatacgttgcttttgtaatatgaaaaataaaaaataaaagttaaatttgttttgtttgtaagaatcagttgaggacagatgggactatttgcatggattggtgtcatgtttgaagtcagttaccagagggtttctttcaacagagtatmccmaaaaaaaaaaaaaaaaaaaaaaaaaaaaagtaaattgcacagaccccagcttaggacctggacttaatcttcatgatgtttgtaaagtaatacttcttggagaaacctcccaaatttctatcgacactagacatctcaggatttgaaatgttaagctaacraattgttcatcaggtgtatctccagccctycgtaaacactgccggatggatgaacctacgtaatgatctcctggtgccattttcctgactgtagatacttgggtaaggaggagactttgactctagatgacatgatgtaccctgtgttctgcaagctggagaacatcatgtaraatctgaaaattaggagagagaggcaatcagaaraagacagagtggtgttgcagggacctgcagtcagcctagtcccccagtttgcgtttgaatttggtcccagattttttttgtttttgttttttagtagttaaagctgagagcaaaccacattgcttactattgtcagggaatgaaaactatgcaacagaagccgatgtgcagaggtgaccgtgttcgctggaattgaacttaagcaggttcctaccgcacagatccacacaggagggattgcgtaatgcacccagcagagttgtgctcaactgtgattttataaaagacacagaaacacatattaaatagacaattcttctatcagccctctaaactggcataaccttgaatcataattcaatgaatgcatttctgtgagaagtgaaggtaataagctccaagtgctttcgtttcctttctttctttcttaatgcagggaaaattgagatgggattctcagttaaaacccaaacgacgggcctgggggttgtcacaatgtgatccctgaggatgttagccccaatgtctttctgtagccagaaccaatagaaaaatgagaggaggagagtagaagcagaatagcaaacaatttttcctttcatggtctacctgtgtgactgtgtatatgtccagaaggggatgtggttggggaagggcatagtacacatatttgagcagagtacatgtgtttcatttcttgctcatacgacatgtccagtgtgggctggcatgttcttctgcacagtccctgagggacccggacttatagagtctgtgatctcacagctgctacatctggcacagatggccttcttgatctccagttagggcgagtcacaacagcaattaaatggtttggtctgaagtgtcacgagtcgtttcctcttggctgcctactggctaggccagtcacgtggccctgaagagggtgggaatgtctcatccccctgtgggcttagaagaaaaccagaggtctgtgcacactatggatttttactacaatgatgccctttyacatacagcgagaargattaagaggtactgwattgktggttrataaagtcaaacttgtgaacagagcaaaagggcattgcttggtcattgcagcttccacccatgcaccttacacagaagtttgggccctaacatggaaacttttcaacactggccaaattctgtttgaagcactgtattgagcataccatatgctgaaagacttggaatgcaaaaacctaaggccaagggcacttctcaatattaaacccycagttgtaakggaggcatcaagactataagayccaagaccttaacttttgtgctccttgtcttgtggagggaacatccatcctcaaaacagaaacctgtgagatcccttgaatatactgacaatacactgatgagaattgaatgccccataaattgcatctcccgcagggcctgataggtgccctgtcttcctgcttatgactctgaaaccctgtttatttgtatcaaggacggttggtactttaatcatcaataaactaacatctcaacagcctgccataaatttcttgtcaaaaaaagaggttatgattagaatactgtgattaaagagaatttgtagatagacttacatccctcagtttcaaagcttctagtagtagggcttagaggttcctagagtaggaaaagcctagccaagcagaaacccatgtttttgactttcaggatatttgtgaattaatttacttgcatatattggccaagatctagcataatctcttaatattcartgaataaaaaattgagttttgagagcaaatattttggtaggaaatagagaactgacactaatattctctctgactataattgtaaaacagtagatgtctttcaccaagcgctaacattatattaattattaataaaatccaactccttaataatacwatcatagttaccatttattgagagcactcttctgaacattttgcattctttatttaatcttmcctacaaccttattaagtagacattatcttcatcttattaagtagtcagttcctcatttgcagatgaggaaactggctgactgagttaaatgaatgccaaagtcacagagctgctgagtggcagagttgtaattcccatgcagaactgtgtggcatcaaagccatttttwaactcattgcaatgcacagtgggttaaaatgagatgattgaaaatgagatgtggctgggcatggtggctcacacctctaattccagcactttgagaggataacttgagtccgggagtttgagaccagcctgggcaacagagccagaccatcyatctctacaaaaaatttaaaaattagctgggtatggttgtgcactcctgtggttccagctactcaggagactgcggtagggggatcacttcagcccagaagttcaaggctgcagtgagctgtgatcgytccactgcactctagcatgcgtgacagagtgagactatctcaaaaaagaaaaaatgagattatggccaggggtggtggctcctgcctataatcctagccctttgggaggccaaggtgggaacatcatttgagcccaggagttaaagaccagcctgggcacatagtgagacascagctttacaaaagagagagagagaaagaaagagagagagattatttctagaataagcaaaccaaacgtgaattaagttttcattctcattttagtgattctctaagtacatacccacattctgattccctcagcactttaggactgactgattagcagtaactgccctcccactggtaccactgtggccagggagtgactgcaagggtcaaaacttttgttggggagctgtttggactaagtgaatgtccagccccaactcagggatgttgtattggttctaatctctgcttctgaggaaatggttacctgcagggcgattgtggcctgctcctcgtgggatatattgagatggttccttttaatccatttcttttaaaaaaaaaattctttttaaagagatgggatttcattatgttgcccaggttggcctcaaagtcctgggatgaagagcttctcctgtcttagtctcctgagtagctgggacgacaggtgcctgcaaccatgtctggcttaaatccatccttaaacaagttcaatgttttatttccttcagataaaatgagagtggagagaccacagtgatgcccaggaatagtcatggttggcgattaaatagccattgagtctctattctgaaacaggcaccgtgttcatttgctatggctaacatgacaaaataccacccactggggatattaaacattagaaacttactgtctcacagttctggaggctggaaattcaagacaaagttgctggcagggtctctctgaggcctctctccttggcttgcagacggccgccttcttgctctgtcctcacgtggccttccgtctgtttcttggtgcacatccctggtgtctcttcctcctcttataaggacaccagtcctcttggattagggcaccacgcttatgacatcatttaacttagttaccctttcaaaggctttgtcttgaaatacagtcacatggagggttagaacttcaggatataaatttgagggggacgcagtttagtctgtaacatgctctatgctgggcacaaggaatgttatggtggataaggggaaaatggtccctaccctctgtcagttttttatggaagaagaaagacggtctttaaagaaattyacataattaatcacaaaaagctaatactatgacaaagaatgtaagttactaatacagcttagaacagatgactctaaccttgtgtaggagctagagaaggcttctctgaggaggtgaggttggaactgaagcatgaaagggaacagaagggggtcaggcaggagaaggcttgggaccaggaggtagagaaaacagtagtgtgatcagaactttaaggcccggttctgtatacaacaggtttcgggacttgaaaggcagcccacattgagtgtaactagaaagtgagggcaagagattgttcaaaagaatactggacccagagtttcatcactttgttaattacatctcatattgtgggattgcaattaccttgcccaagaaaagattatttacgattccattgtttatattgtttgttgaaataattaattctcaaaacttctggatacctgagactcagctaggaacttatttttaaaatataaattcctagtcccactccctaaagattctgagttagtacattcaggatggggtctaggaatcagtgtgtttaagaagtgcatcaggttcttctggtactgattgtccatgaaccacactttgagaaagctccatctaaagagataagttactgacgtgtgttaccagagagagcctagaaaacctgggcacaacagtagttgttaagaactaccagacctgggccaggcccggtggctcatgcccgtaatcttagcactttgggaggctgaggcgggtggatcacttgagcccaggggtttcagatcagtctgggcaacatggtgaaaccctacctctacaaaaaatagaaaaaattagctgggcatggtagtgcatgcctgtggtcccagctacttgggaggctgaggttcgagggttgcttgagcctgggaggtcaaagctgcagtgagccaagatcatgccactgcactccagcctgggagagtgtgagaccttgtctcagaaaaaaaaaaaaaaaaacaactacccaaggcctgttggaatgtctgccagtttcaacccacggggatagggtgagatgaacattgattgagcctttacatyggagacactataacaaatgctttgygtacatcagctctttcaaattaatacaattctactagaggggrcactattagtatccccaatttacagatgaaaaaaatgagggacagagaggttagatgtgtatctaaggtcacatagctcacaaacgacacagcatgcacccaaatgccaggtttcaatgaccctgtggtgaagtgtgattgctggcatttgcctagtgttgactgtgctctagacactgtattagttacaagtgattctacttctcattcattaggccatccagaaagccttgtgctttagtctgtcctggctactataacaaaatatcataaactaggtggcttataaacacctgaaatctatttctcatagttcttgaggctgggaagtccaagatcaagctgctggcagattgagtgtttggcaacggcccactttctggttcctagatgttcacctccttgctatgtcctcatatcgkgggaggggcaaagggtctctctatctggcctcttttaagcccttaacccattcatgaaggctttgcctcaatgacctaatcacctcccaaaggccctacctcctaatatattatattggtgattaaatttcaacatatggctgggcgtggtggctcacacctgtaatcccagcactttgggaggctgagatgggcagatcacttgaggtcaggagttcgagaccagcctggccaatgtggtgaaaccccgtcttttctaaaaacattttaaaaattagccgggtgtggtggtgaatgcctgtaatctcaggtactccagaggctgaggcaggagaatcacttgaacccaggaggtggaggttgcagtgagctgagatcacaccactgcactccagcctgggtgacagagcaagactgtctcaaaaaaaaaaaaaaaaaaaaaaaaattcaacwtacsaattttgcgaggacgcaaacatttaatccgtagtactgatgtggatatgatttgagctaagactctgctgttgattctcttcaaaaacttggcagtagcccttggatcccattaattgcattcaacagkcatgtattttattaatttttgttcctaaagaaaaaaaaaaatccagattgcttagaaaataaatgtgactcacgcagagcagaatccgaattttctaagtgatgaacatgttaacatattattttaatctaaagacatcctatccctgaatttagggggagacatttttttaagtaaggtttatttttaaaattgttttgcaaacattttaacagtacatcactgcctcattggatgaatcatatttttaactttcacttcccatcaatttaaacatcatctctcaaggaactgatgggccggttgactctaaatgattttgcctttcatgcagtattgttccatccgcctgccacagaagtgattccaggtcattccaatttatttaattaattttggagatgaaattattttgcccaataactagaatgctaatgggacttagtgtaatggtttagttcaggtttgttggtttgaaaataaacgccttcatttcaatatttgccttttggctgcagcccgttaactggtcacatgctgtaacctcattaacatcaaggcttaattgtaagttaatgtgcacctagtttttgtaaagaaggtttctatcttaactgccaagttttgccccccaaatatagccccaaactggcatttccaacagatggatgggttggtgtaatataattcatgcttttaaacatcatacttttatcggtgccttgataataaatatttgaacttatttttagaagttagaataaagtgaggaaaataaatctcagctctctagagtgtcactgtggtattgagatttgtggaggtgtactacatccgtaattgggagagattgccggtcgtaaaggagggacaatagaacctctgtagaatcaaaggcagaattaaaatctgcatgttaatagctttcctgccagccacgaatagattcattcttcacgtctcaratatataaagcttatttcaaaataaattctggggagcgttcaacctgattgaatctgctgtaagctctgttaatatatttgttcgagtcacttgcactcaaaaggtttttagacagaatatcacttttttatattattcatggtaatgtaattcccccctttaatctcttcagggtttcccattcagtcatgatatgcggttcaragaaagttggatcgaccattaatcatgctatctcgacttctgtgtgtctcctttttgtccatctcttaaatcagtcacttggcagcagcaagacatgtggccactccagaccawttgatcgaaragctcttgttaggagattaggctgctaatctgcaagcgagctaatggaaatcattctgggcaaggaaacaaaactgaacaacattagcaaaatcactacatattataggaatcaagtacattctgaacggcttaatcctacagtttagatatgaascctaagggtaagatgaacgtcttagatgatctgagatatccaaatacctgtaacaaacatttgtatggtgtatgtagggcaggaaccccatcagaattggggaatctttaaaggattttttatttagccagataaaataaacaaggacagagttgactgagaaaaaagaaagaaaaaaaagaaaagtcaggagaggaggactgaaaattcccatcccacccccgcaacaatgaagggaaatgcctaggttgaaaacacgcaatacacattcaataaatgttcatggttgaatgaagttacctggtagggatttaatctttatttcaaaaagagtggctgtgaatctttaaaaatttctttggttctttaacattctcttcttcactaaacccaaattaataattccttactattgkcattaaaagttctcactggatcattccatttatactcagarkaacaaagcaaacccaattatttgagagacactgaaatgaattttgagtctagaacagcatctgcaaactttgcaaaggttcacatgataaatattttctgctttgtggcctacaaggtacctatcacaactactaagctatcatgcattagtgaaagcacatagataatctataarccaatgggcatggttgtgtgacaataaaactttatttagaaaaacaggtggtagactggatttagcttgtgggttgtagtttgctggcctctggtcaagagcacttgtttgtctgggagacataatttcaaaaatcattttcttttttgattttcatggttttagaacatgatattttctactatggatgaatgctcctcttttgaattttcatttttgtctgacataactcaaagtgcttgctttgggagttcttgttaaccctgacaawtcttgtcaaatatcttactcctgggctgtgctggggatggcagcagagtggggtggttggatggraaggcgggaaagagctagcttggagatgatacgcttttccayccttgaataacttgggaaaaagtcaggagtgtggaatgaagaattggaatataaaggctgagggcggacctaattttttttttaaggattaagaaaaaaggagtaagagagatggtatgacttatcacttggctggggactcagcattaattgataaatccactgtaaggaatgcatgacactgtcttttgaagaaagacattgcatgttaggattctgagtaacagtcaatatattcagtgaaacaaatacctaatatattccatgaaacaagtatcgtgaatatattccatgaaacaaatatcatgaatatattgtgtgaaacaaatatcgtgaatatattccatgaaacagatatccagtatattccatgaaacaaatatcatgaatttattccatgaaacaaatatcgtgaatatattccatgaaacaaaatactgtgaaatcataccastgatttttgaagaaacctaatgaaaacagcatgctcctatatcttttttctgggtgatctttagatatctcgtcttccaaacttttgtgtagcattgtctgaattttcccaagaaaggaggatgttgatctcctatttatttatatttatttaaatttttaacctttacattgacccagtgttgtaaggaaatgggagaatattgccctgatgtctgggaaattgggactcccatcctacaattcaagtgttggaatgttgcagggaggctgggctaaggtgttctgttcctgtctctggttcaaaggaaaggaatagcctagacctaaaggattctgtctggtagctgkttgctcttcgcgcctgtgctttgaatggtgaataccctcggcgggaggcaggcacctgatgccactgcccccgccccacctgcccccgccccgtttctcagatcacacaggcaggctgaggagygcttaacaccccagcctcccatgaagcatcctgaaaaagcagactttgtcttcctccatcagctttgtttgtcctctgccgagactccagggacatgattgctcttcattttacgctcgagatcaaaataaacagaaaccactttcagctttcccgttccagggttaagtgcccaagcaggtgttgtttctgttatgtggtttgcagtgagcaaaaccaccccctcttamctgtggcagcaaaggcagggagactttgagacctggggagggctctctgctgtgttaacagaactggctcttggttggggggtggggggcacccattcttggcttcttataacacttcctttctcatgcattacctggggctccctctggaaagaaaatggtggagaggttactggcctgatgacccagggacccaggcagtccttacagggacccagaatttcacawgcaaatgtgacctccaattaaagctggacttgattaaccccatttcccctcaaaagatgatacttgtaatgccgttccgatgaggccgtctcactccgtaaactgtcatctgatttacacaaagccatctgcttccatacggggtgttttatttgggatccaggaggggagaaggcgcatctgccccctccatagcatctgaatcttaatgaataaaagcactgacacttctttaaaagggaatagcgtgatgctatttacagtttatacagttttgtaatccagctccatgctggatatttaccgtcagtcatttgaggaagttcacttctctgctggttttctgagtgagggagcgatgagtagaggagcagctggagggtccaggagccccctgaactgagtatccggtgggaggtcagatttccgcattcagaacgagagctcatacggcatccacgcgtgtctttctcaygcatatccccagcccgagtagaagaggacttctgcatctctgttagttctttctcctcctaagaaaaagcagattttaagtaacttatcatttgttcatttaattactcattctttattccttcttcattcattttccttttctccttcctttctccctctgttctctctgttttaacaggttttattcttattgtggtatggtaaggccaagatgaggaaatgactgctattgcaaagatggtttgttactcacagatccatggggactccacatgccacagggagttacctgggaaagccccagggttgggcaggaggcagagggagagggggagaactgtcaagagttttgagctggaagctattatcctcagcaaactaacacaggaacagaaaaccaaataccgcatggtgtcacttgtaagtgggagctgaacaatgagaacacatggacacagggagggaaacaacacacactggggcttgtgaggagtggggttgggggagggagagcatcaggaagaatagctaatggatgttgggcttaatacctaggcgatgggttgataggtgcagcaaaccaccatggcacagrtttacctatgtaacaaacctgcacatcctgcacatgtaccctggaacttaaatttttttaaaaaatgtttttattgtgattttcacaggaaagaaggggccaggcagggtaagcaggcttaggattggctggcttgggtcatttccatgggctctgggacacaggggttgtctttaggtgtctgacccatggctatggggtgattagggtaggtgggtgtggcctggagttcgagcccaataaagccagtggtgagggtgtggctgtgaattggttggtttgcatttgaactgtggttaccagtgagctgtctactatctctaagaatccgctagagccctgtaaagaaagcctacaagggagcaggttttaggcaataataagtgagcagtatggcgccctaatagaaggagggatgcctgtggccaatatacacggctcaaagttgaccatgatagagaasytttccctagaaggtctgtgagggaggaggcctgggagagacagcagggtgaccagagtaagtgaagtcaccgaggtgccaatgagtgtggccctgcaggtcctgcagacccccctggtggcagtattggtggtcacagctggcaaagggaagtgtggctgcccggagagcttggctgaggttggaacgtgggagtttaagagagcaaactccmacagcttggtgcagagagaaaagtgtagaaaggtcgggtgtcatacagcagagggctgtgatgctctactgaggagtggaagtgtttttctgagggcatcaaacacgccgtcaagcagggaggcaacaaatctgagtygttccacagatactttgagtgcagtacaagttggtaatgggtaacaggctaaaccatgtggcaccccttccctcttatcagcttcttgctaccatgcagaaaagtgctgaaggtggcctgccytaaggcagtagcactagagcagggatggggaggacttgstggccagatgcatgtggacatgatggaaagggaagagaagaactgtcaagattttcactatcagtggtataagccccgtagtaatatgcctagtgttccattattggaacactaagtatgtgggaattatttatatcctaccgctcaaagccatcaccaaggtctgatcgtgaaaattcaaaaaattgcaacctgaggcataaatgggttttaagctccatacagtaaaacytagcatatgaaaacagttctggctgatgggttggtagaarkgatagatatagatacatayatacacatatatgcacagtaatagatataggtaaagaccttgatatatgtacatatattgtatgatacatatccatgcatatacgtgggtgtacacacacaggtacacacaaatatatatgtgcctttggacaaraaaaaatccccaggacagtctcatttggcttttaaaatgctgcagttgaataggaccgtagaggtggcctaaggcagccttccattcagggcacgcagatttggttcctcagctcccttcttctctatttctgagtcacgtgggctgcacctatctgtcagaagcccactgcccacccagagcccctgactctgaatggtggcccagtgctttctgaagacagaggtgggacctggtgctggagacaatccattcctttcacaaagactgtaagccttacccaagcattaattttgctgcatagrcggcctgttctcccacaaagcactgagtaagaagaaaaggggcccggataaaccagcagggcctggcagacaacttctggctcccttgccatttaaggtcccgaggaatgtggagacattggtgggggccagggtgggtttggaaggacggattttttcctctttgtctctatctctctttctctctgtctttttctctttctctcatagttaatgctatgattttgtaaaaaaaaaaaaaaaaaaaaaaattctagtttctcagaatcctcattggaggcatgtgtatatttctaaatttaaatgtattctcctatactgtccggggaaaggaagcatttttcaaccaaactgaaagggaaaggtactcttttttattctaatactcacatttcccaaaacatatccttaatattgtacatttggcacagttattgttgaatacttggaaggcgatgtgtatagcatacagagctgcagctttggactttgtggctttaggtaaattacttattctctttgcacctcagtgtattcttctgactaatggggacagtagcaacatcgatgtctcggggcttctgtgagtattcatcaaggtaatatatgcaggccagtaccacattccccactaaaggagtgccactttttttttttttttttactacttgcattattgttgttgttgttgctgtacgtctgaagggctttagtcctcttatgagcaaggcaaaagggacaatgttcaccctttggactggaagtaagaagcccctgcagttccaaatgactccacatttggaatgatttcacaaggagtgcaaaagaagcctcttgtttgactttgcccacaaatgccagaggaggactcttctgagccatgccaataagaaaaatgagaatgccagcttaaataaatgttatcacaatctctgcagaatcgtgatgtctccgattcttaaaagtgtctactgcagggtatttattattctgtgataataataaatcgctgcttatgaaatgcaaggaatcgagtgtcatggaggggaggaagggaagtaacagggagaagaactgtgagagatggaggtccagccaggcccgggctattaatcatcgccctccattatttcctgaagattcattcattgttccataggtacctagagggtcaattagagaccacagacaggctttttcaaagacgcaagagggtcaattaggccctccttataattttctgctttaacagcaaatgccagcctatcgtgcatcagatgcaagggagtttggaaataaacagggtactttccctcctcctctaaaaaaaaaaaaaaagaaaaaatccaacacagagacatggagacagtcggcgattgggaacgcttggcttgctggctgtcaggatctggttcaaggaaggcaaagggaattttatcaccaactgggacttgagaggagcagagttcttctggtctcagagcacggggaacggtcagggaatttgtatgatggagcaccctgttcccatatctgagatgattcatttatcttgagtgccatcttaactacaattagagtacaattataaagtatctacaatggaaatgggtcttgaaatcaatcgcagctggaccggcgtgcggtgagttgccgtgcccaccacgactgctgtctgtgtttaggacagagttcaaccaaacgtaccggtgtgtgattttgcacaacactgctttgtatttgttttccctgagaccggcaaacacattttttatttattttatttttatttttcgagatggactttcgcttttttgcccagcctggagtgaagtggcatgatctcggctcactgcaaactacccccgcccccgggttcaagcaattstcgcacctcagcctcccaagtaactgggattacaggtgcccaccaccaagcccggctaakttttstattttmaatagagatgaggttttgccatattggtcaggctggtcttgaactcttgacctcaggtgattcacccacctcagcctcccaaagtgcagggattaaggcgtgagccaccgagcccagccggcaaacttaytttaaaacacattgcaataaaataaaaagaaaagggattgtsctaagtgagaagcagagatgaaaatgtggaaggatgattgtgagaagtccacattgctccatttggacttcctttttgtagtgggctattagattttgcctctgcttgtttctgaatacccaagcttgctaacamagggaaagaccaattatcatgattattattatttaccttaagacctgattctacctatctatgatcacatagacatttggaagcaaagagaaatgcttttcatgtgggaaaaaccaataccaacttcagtgatattatttctccgccccccgcaccgggctcttgggaatatctcttagccctcaattgtcacattcattcagcagatgttagcacgtgcaggcaccattctaggtgttggggatacatccaaaaacaagcaggaaaaccccattctcttcatttctggaatgccggagcactgggcccatggagcccgtttcacttacacgtttttgtcgtctttgagtttccaagaagggagtggcactatagctgaagaggatgaccctctatcacagcctttgctaaaaccactgaaaactgtcttatttttcattttgcccggaaatgcgacacataagtgcattcctctagggaaggatttttttttttttttttttttttgagacaggagtctcactctgttgtccaagctggagtgcagtggcgcgatgtcagctcactgcaacctccgcctcctgggttcaaacaattctcctacstcagcctcctgagtagctgggattatagtcacctaccaccatacccagctaatttttgtattttttagtagaaacagtgtttcaccaggttggccaggctgctctcgaactcctgacctcaggtgatctgcccaccttggcctcccaaagtgcagagcaggaatttcattggatttstacactgctgctttttcagagcctggaacagtgccaagcacatagtcggccctcagtgagcatttgttgactaacttaggtcacagatgtggggctgtgattctgaaggccccggctcattcttggctttcagagaggtttgctttcactcctgggcagcagctgccctggctgctgccaccaccgccttcccggaggtcagctttattttcagtgtttttgcccttccgatccctgggtaagaagtaagaaaatttctagtgcctggagtctccatcctcgtttcccagtcatatcctagaagctgcaaattgctggcttgtggatgtctttggtttggcctgctgaagtttgttttggattttttaatgaaataaattagctgtgaacatttaaaacttgggagacatcccatcaaaattgggatttcctgcttatctcgacaaagcagatctggcatcctttgcctgcattttacatttggctacagttggctggacttgagcagcggctgcccctctttagctggggcatgtgccctgtggtttgccatagtacccatcaggcctgcttcactcattgtagaaatggcctggcctcctaggcattggagatttctgttatgctcattcatgagcttgcctgcttacacctagctgttgtgttggttctcataggtctccctgattccagcctccaattcactgagctggcctctgccagtgtcacttctccccagtcttggctttgatcaagcttggaaaggcctggcctttgtgttgtcacattcttctgcctagagtatgccttttccttcaccaaaccaagtggctctttcggaagacttgcctgaatcctagaccccttctctctacaacmttcagtctgagttgggtaccttgcatcctcctttgttcccatactaacccctacaaccatggtcattttgtggttatctgtttaattctctgctggctattccaggctgtcasctccctgactacaaggactttgttgctcacaatcatatccacggcatccacacaagatctggccgctacgtggaaggacacatagttccgtctggcttggagcctagcttgggagagggacagtagtggggaagggtgagcttggagatagagctgaccttcccaggtgcttcagcagttacagcaagattctagatcttaccctgacagtcacagaaagcactgggagcgtttatgaatgttgtggtatctcacataataaggggaccatgcatgtattttagaaagagccctytggcttcagggaagaacgatggatttgtgagggtcaggactggtagcaggtgggctcctagaatagtcccggcaagagatcatggaggccagagccagggatggatatagactaagacatgcctgtagactgagtgtcgaggagcaagtagatcaaattctagcatgagactgggagaaagagatgttctccagccaatggatttatgaaatgaatgaactttttccctttcctcccaagcattgcctggatcaccttgttaatatggtttcttattaaacgtgctggaaaaaagaggctctaagtgcgtatgcttttaaagcaacactattagcaaatggccactggcttcatttttcctgtgcatatatttttgtgtattccgggaggattttcttttctttttctttttaatcctcctcctcaagggaaacattcttctcacaatagcttcctggtagaaagttctaactaatgactttratcgtgtgmatgtattgcagaaatggacaggrcarttctcagcccattcatcttacagacctcaagtgaacaggcacaaaacaacaggctccaccctccttcycccctctatctcatactttacctcaatttatgacttggcttacaatccgttgcagaaagcctagctccccagcttctcctgaatctacgtttttctattttgtctgaactagccaaggtctctggwgtttgctgttatmttgcttcagagaaattagtgacattgaaaggctgttgtcttttttaktgtacttttggttgttaggagaaatttacaaggccatttttttctcccgtctctgcagttcaggagattatattagaaaatattctatacaaaaaatatgcatagtagggcttttctccagctagtagctcagaataagtcaktaytactgaaacaggtaccttttgtggaattgattctgaaatctgtttggatctgaaatctttctttcttgcctttgagtaagayacggcagagaaaaacaattacactagctgctggtctgtatttactggttagaatagaatattattaccatcaagaataacattagtggccaggtgcggtggctcaygcctgtaatcccagcactttgggaggccgaggtgggtggatcacctgaggtcaggagttcaaaaccagcctggccaacatggtgaaacccccgtctctactaaaaatacaaaaattagccgggtgtggcggtgcatgmctgtaatcccagctacttgggaggctgaggcaggagaatcccttgaacctgggaggtggaggttgcagtgagctgagatcacgccattrtactccagtctaggcaacaagagtgaaactctgtctcaaaaaaattaatrataataatgttacaataataataatgttagtgatacatatcattttgaaaccagttcttaagcaattaaaaaaaagcagctatggtgattgagtttttgtgttatgaattttatactctgaaggcatggtcattgtgaatgccaaagaaatgaacaggagaaaattttatttgaaagctgggattgttgcatgctgcagaatttttttttcttttgctattgctgtgtaacaaatgaccacacacttagcagttcacattcacatcttgtttattaactacaattctctagatcagaagcctagacacaatgtgactggcttctctgctcagggtctcttgggkacaaaataaaggtgtccgctggaggaacatcctttcctgcatgctctgtggaagaatccactgccaagctcattcaggatgctggcaggattcagatccttgaagttgtaagactagggcccctgtttcctactgacttctgctggtggctgccctcagytccsagaggcaacccacattccttgacttttggccccctgcatctcaaagccagcaacagaaactctcttgtgcatggagtcccctcctgctttgaatctctctgactttccttgactttgatgtytaggtytggatttcaagggytcagaaactctctcatgcatgtagttccctcctgctttgaatctctctgactttcmttgattttgatgtctaggtctggatttcaagggctcacgtgatgaggatagtttctttatcttaagggcaactgatgtggagtcttaattaacactggcaaaatcccttcatgacagtacctagagtatgaattgactcagtaactggaagaatgcatgcgtacaccatggaccgggaatccgggaggccaatttagaattttatgtatcaaagccccatttttttttgaataacagaaaaaaaaaagagacctgatatttggagagactttttcaaaagcagaaagtttaatataaaagaaagggggtaattgaagaagatataaactgcaaagaaaggatgttaggtagagcgccttatagggaatcagaggttttattacaggcagacacggcttcacctgtgagccgagcaagtgattttgcctgcagagaagaacgcagggttccttctatggctcaggatcttcagttaccagcagtggaagtgaattgaaaatagttggtctcttgagtgacctgatgcaactcattatcttctctgtgccttaacgtctctatctaatttcccattaaaagtaacaggaaaaagcgcaatgacttttgcaccaacctaacaatgggttgacattcaggattgctataatgatgaagcaatggcaaatggagtctttgtttttagccccgtggaggcatatgctgggcactcaacaaacatcacttcccctgcccttttctcagatagagttatccaaacaaattggatgctcaactctggatttgatccaagctctctggaaatctctagcttctcaaactgtttcgtggtggagtgccttttgggcacaggagaaggaaataagagcctcgcgaggtttgggaatgctgcctstagctytyacactgcatgcagaattcctactctgagagctcactttatctcaaaaacccatgcatattctgcatctactctgaattccgcagtgttgtgtgttactatacgatctagtgttttcgttgcttacaagttagattcacactccaggaatgtatctgttcccacatcccctgatgctgagcataccagagttaagggaggcaagcaaggcccytaacctccyaggttcatggaggtacccattctgcacttgttgaccttgagcttgaggactccataaatgtctgcccttggcattgcacgtgcctccctctgggctgaccctgctgggcctgtcacttactcccattggagaggcctgtttccatacatagctctttgtcagttgctcacactcggtcaatacttgccttcctttgaggccatctgcactcactgacaatctgatygctcccctgaatggaggtgaaagcatgcaagctmggagttaagatctttaactcagggaagaccctgtctatggaagtgctgagctcttcagtgtcatcacagaaaagcatgagcscctccctggtacggagtcatcacatcccatagctgagcgacgtcggagctccacgatggggaggtgacacatagtcagttaattacataaagagaacttgagcaaactcttactctgccatatgctgtgcagatccctctgaaaagctttacagatgttcttttttttttttaatccctccccctatctttctttctttgcacccacgatgctctgcacttcaagctaaatataatgtatctgattttacagcatacatactaatcaggtttgaaagttgtcttgtgaggctttaaaaagctagccaagagcagtgcgatttctccaaaaggatgtctgcaatcaagatgattacatgggaaaataaatcataatttatattgctgaaaatgtcatttgcaaaacactttgacaatactttcctttcagtctattttcctgtgtatggggtaagtgttgcccttctgcaactttmcttttattttatttatttmtttcttttcaatackctgaatatcactggagcagctgcagattcagggcagtatggggtggttcaggaacagaactgacaggtattgaagccaaaaaytgaacaataacaacgtaggagggagaatccaaagatagtatgtgttcaggatacgggcactcrtgtgggtgaacacacacacacacacacacacacgcttttttttttttttctttttttttttctcctattgcaatagaacgtaaaggtagatttttagaaccaaatgccttttaggaagctacctctcttccaccctgctgcctttgtgttgaataaactatattaaattatccaggaggaatgattagtgatctgattcattaatatcccttgttattaagaactgtctgtatttgtgtcctggttggcagatattaagtccacagatdccaataattaatatctwtggttgattgtaaaaatggccaccaattcttccctgtcccctgcayatgtacatccttgcactgtgaaattgtagatctcgccctccaaaggtgaagttcgtttgtccactccttgaaccaggatggcatgaaacttgatttgaccaatgaggcatttggaaacacggcacaagcaaaggcttgaaacgtgcttttatgttggtgcttgcccacttgctgtgctacgaacccttttacttytgggtgcgaacaarcccaggctagccttctgggcgatgagagacacaagaccatgtttccatattgccccagccaagagccaacctacagacgcaactgccttgctgacagcagacacctgcccagctgagcccagcccaaattgctgactcatgcaatcttgagctaaaaataagtagctgttgtttatagccactaatatttgtgatggttcattgcacagcaaaattgaatggagacaatacttttgaaattgactcttcgggagctgttgtaaagaagtaaaatgtgtagtgtttgcccttttcctcagctgtaggcctggtatgcagaagtattcagttatttggtgagtgaaccctcgctgatgccctggctagtgttttctgtctcaggaagcatgaacatttcatccagggttatatgctacagggatattcaagaaattgaagatccttgaaaatctagtctccctcacaaggatcaggtggcaggatctaatgggaggggtagagagtgagtgttaacacacagagaacccaggagacctttctcagaggtctcatatsaagaaaagatcatttctcctaagcaatcaatttctttttaaatctgaacctcatatctgagaatattcccttcttttatctggccactcgggagctcaaaaataaatttctggcacccttcttcctggctccagtaaagtcatacaaccatatggtacctctctggcaactaatttcacctatttccttatttgtttaaaaattttaacttaaattttttcccctcaagatctatttacggatcatcagttttattttttcttttctttcctctttttcttttgctcccttttctccccactcttgactcttctctagtttttatatgcagtttgtatttatccatgccatctgaaatcctccttcctttttaacaaggcaagtagaaaacgaaaacaacatcaaaggatacactacmcaattgttggagccctaggamccgagagaagagtacaagcaggttcttgaactgttctctccccagcaactataactggaaggaacctcagtttgtccattcattcattcatcagagcagcatagcagagtagaaggaactctgactttggcattggtgcctctaagtttgaagtctaactccatcactgtgtttctttcctcttgctgatagctgatttgttataaacaaattaccaaaaacgtactggctttaaasaacacatgcttatcatgttgcagttctggggagtcacaagttcaaaatcastctcacctggtcaagatgtcagtagggcttgttccttctggaggctctaggggagaatctgtttccttgcgtttttcatcttctasaggcctcctgcattccttggctcttggccccttcctctggcttcaaaccagcagtttaatatcatcacatctcctttactgattcctcttccgttgtcccatcacattctcctcatctggccctctggccactctcttataaggacccttttgatttcattgggaatacccagataatcttggataatcactccatctcagggtccttaatcacatcttcagagtcccctttgccatggctgatgacagagtcacaaatttggggaattagtgtgtagacttctcttgtagggagtcattattactctaccacaaccactaattctggacttcacgttccctcatccatagagcagggataacaatatcctccaggctatccgcggaagtagagaatataagctttatccagggggccactcagtgatgggagtcttccttatgaagctgtcccagctccatctctcaggactgaaatgtgggtaagaccatcacatttttcatcccccgccccccgsccccaacattgactgggcagatattcatacaatggcgattgttttgtctgcctggatggctttaacataataccatagactgggcaggttaaacagcagacctctattcctcacagtctagaggctgggaagtccaaggtgaagccatgggcacattctgtgsctgcctgaggstctctttctggttcccagatggatgcctttgtgtgtcctctcatggcagagagaggaaggggtctggaacctttctcttataaggatactaatcccatcgtaccccgtcccccatgatctcawttgaaattagtcacctcccaaagccccacctccaagtactgtcmcactggggcatagggcttcagcatatgaatttgggggagctggggagaggaacacatacatttagtccataacaactatctcacttacctctctactaagtgattcagaaaatagcaagtatagtagtgggagaacatggtatcagaaccaggagagggtcctctggctttctgagttctgccaaaaaccaagttttgytgccttgggcctgtggcttytcctccytgattgtcgctggccttgctgtaaattgtgaggcatccatgtgaggcacaggatggttccaaggaccaactgaggctgtctgtgctgaggctgggagggtgtaagtgctcagaggcagccggaagctgtggtttttacctcccaagactgtgcagagcttccttcttctgtagggagaagtctctcaggacagggctcacaacagtgcagtcaggagattggaaattttagtgacaccaaagtgggctttacttcctcctcctagaattcctgccagaaaggtggagatgtgcaataaactgagcaccgatagagtaccaagaacatgctttttgcacattgtttgattcatcaatcagagtggggcatggctgtcatcagttcagagttgaaagaattgaagatcaaaggggtcacgtctctgtgaatagtattagtaatagcagcagtatcgatagcaatcatagtaattaaaatggaagcaaccaccagtgtaatcatagcagaaactcacatgtgtgtgctttctatgtgccaggcatgaggctgaagtcatacattcattatttgttaatcccaccctaagtgatagktgtattcatcattctcagtatcagaagaagaaactgaggttcagaatgacccagtaaagatcacaagcccaaccctggtgaagggcgtgattggcagaagcccaatttaagcccccatcatgtcctgacgctttcccaaagctgagctgcctgccagggtctttgctcttccactgccaagaagtaaggttttggttgggcgcggtggctcacgcctgtaatcccagcactttgggaggccgaggtgggtggatcacgaggtcaggagatcgagaccatcctggttaacaccgtaaaaccccgtctctactaaaaatacaaaaaaaaaaaaaattagcccggcgtggtggcgggtgcctgtagtcccagctactccggaggctgagacaggagaatgtcatgaacccgggaggcggagcttgcagtgagcagagattgcagcactgcactccagcctgggcgacagaaggagactccgtctcaaaaaaaaaaaaaaaaaaaaaaaagaagtgagttttttttgtgtattctgaaaggttcccaagctcgccgcagcctgctattgtatttaaagggtgccctttgctgcgtaactagggcaaagaagaaccaactggctgttccccactggctgtggagagttccagctcatccaccctgcctctgtggctgagtcggggagaaaaggacaaagtttttctcccgcaactgggccaccaaaccagcagagcctccagccrgggtggtctcgaggaggcccattaccggctggagtgacagagtgtgtcaagcctgcagctcgtcccgtgtctaatggaacagaaacaagcaccytgctgcccttgttttccagtggctcaccggggctytgcgaggtttattaatcttagcgtataatggaaaatgtgttgccatgtgaaatctagagcctctgttcactactccgcgaattgaaggcggcaggagtctttgtctcatttacacacagtgcctgcgagagactcttagggcagaagaacgccgtcgtaaaaatccgtgcggaatttgaaagtgtgcattaatgcatgtgaccagatggttctaaaatatgccactttcaccaaaaatcatcctctgaaaaactcttctgaacaacatcggctgtgcatagtaactgccttgagtggggccattttagaaaatatatgaggtacgggatgaagatgagggaggaaaatggttcctacttatcattactttgtccctccaaaagcctgcatgcgggaagaaaaatccacccagtgcaagaaccgtggcagtactcagaccatttagaatcactttgagttattaccaagaaattgctaaccactgctttccaagttatatattaaatttttcttttttttaaaaaaaagcttccaactttttttttttttttttttgagttggagtcgcactctttcacccaggctggagtgcagtggcccgatcctgggtcactgcaacctccgcctcctggattcaagcgagtttcctgccttagcctcccgagtagctgggattacaggcacccgccgccacacccagctgatttttgtattttagtagaggtggggtttcgccatgttggccaggctggtgtcgatttcctgaccttgagtgatctacctgcctcggcctcccaaagtgctgggattgcaggcatgagccacagcgtccagccccaacttcttaaaagccagaaacaactggctgttagctgtcacaatattaatactagtgtgtgcaagtaagtttgttttctgcttctgtcttacacgttttacgggctatcagtagatgcatctaataatcctaacactgtcatccttatacttgaggtcttattgtccacttctaccttagctatgtwaacagatgagtaacctactctggatttacccagatagtgctgttaggcaccacacacgatgagattggaggcacctgggtgtcagcctcttgggctggctcattacaggccactctgtctgaggaacactcaggtttgcaaaccgkttcttaaaatwacaggatacctagggacctgttggggtgggwgggaagaaccctatgggcagaaatgtgactttctgtagcaaagatgtactgtttcccactgagaagawtcaaaaatagaaaagtgcttccttgtctytctatattgttattaaaacaagtagatgcattttcrttgaatcaaggcagttttcctttataaaatgtcctatttcatatcactgttcaaacttgacatccacatttgagttggtttaaaatatcactgttttgttgacattcacctgtattatacatttcagttggtcaagtcatttaatttatcataaaccatttaaggagcagttggagaaaagggggaaaaagttaaatgttaatgattcttttcgtaactgcaattttatcggctcctttttgtacatatatgattatgaagcaatttgyrtgaaatttacaccttttcaaattttgaaaattgccttgttgaaaaagaatcgctgtacttctcaatactacactgattaatcacagttatagagtagacataacatttttattaaactctcagtgagcaggaaaattagcacttcctgcaataacgatactaatttcattastgaacgttttcatttataaagtgcttcttccttatcttgaaccttttatcctcttcttattgaccaaagagagggcatatctttgggagctgctaataaaccatattcgtaatatgatgtgacctcatcgacaggctgctgcttctagctcatcatcttccttgatcataaatacccatcggtacctcttgtcacatggtgctcttagagcttcctctttgaatttcacatgtgataagagatggtttccatcctgaagagcttgcagtgggatggttatcggaaagattaaaactctaaaactaacaggtggatataaatataaagaaaatacagtattttgttgatttatgttcatataacttctttattggtaaaagggagacaggtgagaatacaggaaatccttgtggccttgtttgccttttttagaaatttaactttgcaaacaaactcaggggaaactagtgaggtggaaataaagaatgctagactacgggtctggggcccaagtgttttattaatataaaaacttgcgtataaatgtccagtttcaccaccaaatcctttctgaaacattggtagtagatgaactaatgcaacaatttatttttctttgagacaggatctggagtgtggtggtgcaatcataactcactgcagcctcggtctcctgggctgaagcgatcctcatgccttagtctcccgagtagctgggattacaggcatacaccaccatgcctgcctaattttttttaatttttcttttatagagatgcagtatcgcttgttgctcaggctggtctcatatgcctggactcaagtgatcctcccgcctctgcctctcaaagtacagggattataggtgtgagccacgaagcccagctgctgcagttactcaaccagcttcctactagaagccaggcgtttctcaagcttctgaagacacaaaggtgaaccccagacaagccaggtttacagagtgtgcatttcagtgggggagccagccaaaaaatcagtaaacaccaagataaaatatattccagtggcgatacattttcagaaacaaacaaacatggcactgggctggaaatgaatggcaggggagaaggcgggcggggcaagctttggaaagcacgggcaggtaaggacagggtttcaaaggtgagaaggagctggcagtgtgaatagccaggggaaaagtgttktgggtagaaggaacagaaagtgaaacggtgccctggcaaggcaaagattattcatkgctgaagagactatgttgcccagatgacttgttcatgtaatctgtgatttttaaatttagaattgaggtttgaagggaagtattgctcctttctttatctgcaatgggaaagcttactgtagttacttacagtagaagagaaatgtacatttctgaaaatccactgaggaagaaaggggcagtgatgattctaaatgttaataatgcagacagcctttgctttatgtatcaatttttgtaaatgtgttgcttaaatagatttttatgagccagtaatggtttagaaaggtaaatgacttgcccaaggtcatacacccagtacacttgggagccaaaattcatcatagatgactttgtgaaatgtcccattaaatgtgtatatatatatatagtgtgcattacagcttaacagacacacattcatttgacacattatgttttaactttattaataagtttttgtgggcataggtcttgttttgccaacttgacatgtggattttaaagggcaagtgccttagaatacaaactgtcctataaagaataccatattatcgaaaggatgttcaaactcatcagttagaggcgttgcagttggctgggtgcagtggctcacacctgttatctccgcacttaaggagtccaaggcaggtggattacttgaggtcagaagctccagaccagcctggccaacatggtgaaaccccttctctactaaaaatagaaaattagccaggcgtggtggtatgtgactgcaatcccagctactcgggagggtgaagcaggagaatcgctggaacccgggagacaggttgtagtgagctgagatgtcgccactatactctagcctgggcaacagagctagattccatctcaaaaaaaggcattgctgttaatacaacaatgataagttatttcacactcaccagattggcaaaacgttaagtactaaggtcataacaagcactggaaggatgtggagaaatagggaattttatgcattactgaactgaaacagccattttggaaaatattttggtattacgtaataaagtagtacttagcaacttatgcaatttggttcctataaagatgccttagagaaactgttgagaactaggaaaagctcaggaatgtttctggtgcataatttgtgatagcaagaacctgaaagtcctccaaaagccgtctacaatgaaatggggaaattaatggtggcacattcctgcataggagatagcagtgataatgggtggataccagaacgtgcatcaacacagaagaatctcagcaacataattcaggattaaaacagcgtttacagctgggcacagtggcccacacctgtaatgccagcactttggaaggccacagtcggcagatggcttgagcccaggagtttgattccaacccgggcaacatactgagaccccatctctactaaaaatacaaaaattagccagtgtggtatcatgtgtctgtggtctcaggggtctcaggtacttgggagactgaggagggaggacctcttgagccgggaaggtcgaggctgcagtgagccatgattgtaccactgcactccagcctgggctacagagtaagactctgtctcaaaaaaaaaaaaaaaaaaaaaaaagcatttacataggagaatatatacagtatgattcaatttatagaaagcttaaagtataggcaaagctaaacattcaggatatttgataaaactataaagaaaaccaagggaatgaagaatgcaaaatatgagctagtgttttcccaggtgtgagggacggggcatggttgggaggaaaacagaatggtgccatggcgagagatacacaggggaggtattggaaagttctgtttcttaaaatgagtgacaggtacctaggtagtcattctatatgttattaaagtgtacacacattgcttatgtgaagtcttgttatatgtggcacatatcacataatctgaaagaatctgcttcctgtagtaaaaattaaaaaaattatagccgggcacggtggctcacgcctgtaatcccagcactttgggaggccaaggcaggcggatcacgaggtcaggagagagaccaccctggctaacatgatgaaaccccgtctgtaccaaaaatacaaaaaattagccaggcatggtggcggggtgcctgtagtcccagctgctcaggaggctgaggcaggagaatggcgtgaacccaggaggcagagcttgcagtgagccgagatcgtgccactgcactccagcctgggcaacacagcgtgactccatctcaaaacaaacaaacaaaacaaaacaaaaaaggtttaagaaatgttctagtaccttgaaaccaaaataggtrtcagatacttggctgttttgttttttcttctwagccattttgacctgtgagattttatgtgatgaaaacataagaatgtggtattacaccctgtgakttgaattttccatactccattccattctatatgtcagatgcatcttcctaaaacacacctttgtcacatcactcctctgctcaaaaacattcagtggctccctgggccctctgggactaagtttataatgctcagcttgtcattcctttgcccagtgtactctctgtctcactaatttgttcattattttaatgcattttcttgaatacacttctgtagacagccataagatgggtagcaggaatgctgcactgaaccataatccaaagctttcatcaggttcacttgcttcctgtccttgccacaccatctgctcattctcgatctccacttgaacacacttcacattctccacttgtgtatcattcactattcttgctacataaattaacacaaattttgcagcttaaaacagcacacatttattatttcatggtttctgtggatcaggaatctgagtatcagacttagctgggtcctctgcctagggtttcacaaagttgcaatcatatattggccagggtgtgttctaatttggtagcttgactggggaagaattggcttcccaaatcacccagattactagcagactttatttccttgtagctttttgactcggcctggcttcttgctgactgttggctgttggctggaggtacccctcagctcctagaggcatcaacagttcctgaatatctgggcttttcccacaaagcagcttccttcatcaagccagcaacaagagtytctggggcaagttggtcaacaagatggtgtcttacatgcccaatgtaatcatggaagccatgtatacctcatcacatttgccagatttctgctgattaataccaagtcagaagtcctgcacacattcaaagggaggacactgcacaatggtgtgaataccaggtggtagggattatgtggggccaccttacagtctatcagccacaacttgaagtatcttctctcctctttgctgccaaataatgtctctgaagactgtaagacctgaatcctatctaaagttgtcggtggttgcttccttcctgaaagcaacaagaagcccatgaatgtcttatggcctgaagatctgccttcaaagactactacctgtgttgtcacaaatggcaagatttcatcctttttatggctgaataatatttcactgtatatgtgaaccacatttttaaaaatgcatttctgaacctgaaggacattatgttaagtcaaataagccagacacagacagacaaagacatatgatctgactaacaatgtggaatctgaaaaaaccaagctcatagaatagaaacagagagtgagaatggtggttgctggggctagggggtcagtgaagtggggaggtgttgatctaagggttcaaacttctcgttaataataaaccagttctggagatctaatgtacagcatgagtggtgatggatgtgttaattaattcgattgtgataatcattacacaatgtatatagtaatcaaatcattactttatagaccctgaatatattcaatatttatttttcaattatatatatatatatatatatatatatatatatatatatatatatatatatatatatatatatatatatatatatatatatatatatatatatatatttaaagctgtcatggaaagccttaaagttaaaatacgaagatttttgagaaaaactttgcatattttaattgctgtctggaatcctccttcagmtggratgagaaatcatctctgggttagttctgtccctgraggtgagggccagacaacacatcaaaactgactttttattttttttcaaagttgttaagactatctaagattcagatctccctaawactgttcctagttagtatttagaacgtatttgtttagaggatactagcctgaaatagccctatctccaggttgtctgatgcgatgaggatgtggtgttaatcttacacctacccattagtctataaaactcctgagggatgctcaggaaaccaaaaaggatgtctgcatggaggacaagaaggcacaaatcgtytgatttcaccccatcctaagatcttgtgactymagctttgttttggactggggcattggatctcccacatgccctctcttaagtcgtgcatttgacgcatatttaataagcacctactgtgtgccattagagaccatgatacagttttgaaagcctagcctgaataatggatgacaccctcctaaagccacgatttggtcttgattatttttagcactatgaagaaaaatttcattaaatcacaactctatttacttttaacccaacatggtgaagttatcaacatataatgcctgtctatactttcagatggaaaatgcctagataaatactgcatgggacatttttaaacatgtaaaaaaatcaattttcgtaaggttacatctttttacctctttatataaaacatgctatattaaaagagagattaaattttaccctgtggagtaaaatgcaaacacaaaattatttttttcatttttcagagcatgtactggattatcatttatttatgaggctttttttaatctagaatatatggaaatcttttcttgaagcacaatataatattgaattgggaatgttgtctgacagtttccctcttaccgttgcatagaatgactctcctgtatgaatttttaaaagaaacttcaatatgctatgcatttgaaagggaagaagtaatcaccataatcttgaggtatcttttaaataggcttcctgcgcagttcttctatgtttcaccaacttttctacaacaaataatgcatctgtgatttttcagaactcacaaaatgtccagctttctttcttttattcaaaatttatacttcataattgaagttcacctcccaaaagacatagcttggtttagcatagagctatgatgtgkkttctctttgttccttttgcacactttccttgtctggaggcgttgggcttggatccttcattcttcatgaggctgatgtttttccatttcggtttccttaagtggtgaagctgcacaaccatgaaagcagtgaccacataaaaatgctgctttgaggcctggtacctcatgcctataatcctagcacattggatggcccaggcaggagcatcacttgaggccagaagtttgtgaccagcctgggcactatagtgagaccctgtctctactcacataaaaatattagctgggcatgatggctcataggtgtagtcccagctactcaagaggctaaagggggatatttcttaagcccagaagattcagactgcaatgagctatgattgtgccactgcacttcagcctaggcaacacaacaagaccctgtcccttaaaataaatgctgccttgggtatcttaatcctttctcaagattccttctaaggctaacatttctttgccatccccacactaccatctgctcacttttatatatcttgaccattttatttttcatcccatcttcactccatgtaattagttagctattgctgcagaacaaatcaccccaaaattcagtgattagtttataggtagccccatttcacccatctcattctatagctcaggttgaaagttgagtcatgaattggggaacattcttctcttggtgtaaattagtcaccagtgtctcatagggttgggctgaaacttaacacatcccatcactttgattggctaaagtcagttacataaccaagcccagcttcagaagggaaattgtatgccttacaaggaggtgagaggatggaaaatgaatatttgctgaacagactttytgtccagtttgttgtatttggtggtggtgcagggcaaatatatgtttaaaaccttgttcagatttttagctttcttcagaacagagcttttaaaactgagcatttgtcccctaaattccagcactgcggccatgagtaaagggtgccctgaccacgagcaaatcatttagctggctcacctttcatgcaaccttgaattcaccaggaaggaagttcatgcagccctgggtatgatgccctaattttgagccaagccagctagagttcaagtccaaaccattccacttcctagctttgggacgatgaacaatttacttatgctttctgggctttggttcctaaattatttaaatggggatgattacatacattcatcattttcaccttctcaaagaccttctggacaattccccaattcatagctctgggagacagtgtgttgacactctatttgaccacatcttcctagcagtcttgcggaaggtgccactttgcgaacgatctgttgctaggtaatgtcaatgacatgactttcagtttagcacatgtacagatgaccttgtttgggcttgtgccgttggtaattcagtttcaggatttccgtttgacagaatatattcaagggtggtttcttgctatcagttgtacccttgtggccacagtttttccagataaccaagactcactaatattttcacaagaacatttgtcacctaggtccagatttcagaggaaaaaagtataccgccattgttcttgtataaactttataaaatatttggggaacatcactagccacctgcttccgaaagtacttagatactgtgtcatcttaatacaagacactatgcactaattaagctgttgttgatgcttttttgcctttttgacaattaaaaataatctcataccactggattagtctcttgcctttcaattttatgtttatatacaaatatatgtgcataccaaattttatatatatatatatatatatatatatatattttttttttttttttttttttttggtcggagtctcaccctttcacccaggctggagtgcagtggcgcaatctcggctcactgcaagctccgcctcccgggttcacgccattctcctgcctcagcctcctgagtagctggcactataggcgcccaccaccatgcctggctaattttatgtatttttaatagagacagggtttcaccatgttatcaggatggtctcaatctcctggcctcgtgattcacctgccttggcctcccaaagtgctgggattacaggcgtgagccaccgcggctggcgaaaattatatattatacacacaaacatacacacacgcacacaccaaatttaaaaagacagatacataggcagttgttatgcagtgtttgaaataaatttattkccagctatgggtcatttggaaaaagatcaatatgatgcatcaacataacaagtaaatggaaatgaatacaaccgcatggttttctgaaagcacggtttcctgcgcggcttccagaattgcatccctgacatttggaacatgtgttacatgctacagaacatctgtctgtgaacaggttaatgggaaaggtgcatctctacaaacaaatattacctgtaatgctgttgtagctttgttgattgttgatattacttatgaactttcttgcttttcagaaaccaccaccacaaaagaggcagtaacattagtattacattatacatcttmggcatttttttcctttgcccttttcgtaggtttttgtttgtttgttttttcttgtcagccacttcatcatgtttggtctctcgtctttggctgtgtttttctgtttctagttattgtgggtgttaaaaatcactttaatgattcagcaataattaggaagtccctatttgtgggtgttactttactaactaccagggatgaaaaggcaggttttgctttgttattacgtcacagtttcgtcaaggagataagtacttaaattgcagtagagtgtgacagcatatgtcgacggtgtgagtgatatggaataagagtgagacagggaggcagggcaggctccaaaggcgaagagatgtctgagccaaattgaagggtaaactgagttcaccaggcaaactgaggaagggtactcaggctgaaggatcatgggaggggaggagcgtgagttcctcttaagtgartataaaccagggggtaggaaacaacatgagatgaggctggcgagagagaaggatgcyaggtgaggtgctgtggtgcgccagagactgcggaagtggctttctaattaagaaacagaagccaggaaactcctgtacttcaaggttttggagtgggaaagttgaggaaatgtaagagatcatctctgtctctatcacattaccgacggagaagtgggataagaactaygtgtgttttcacttcttctttctttagagaaaacaaatatcatctgccttgctaggtagttgtgagaaatgaggagataatatctttaaatctcctacggtgatacctggaacatgatggtgcttgggaaatgtctcttcttctgaaatgaggctgcctsgaagactcactggaacccaagcaaagtgtctctgcatttcactccgagccatcgacttctgttctgaatgttaaaatgcaggtggctgtgagggagtcttctgagtcatgccagcgtttaaggcgcttgctcttctttgtgcacattcctgcttttctcaaagcctattgaaagcaagggccatgtttgctgttttctttgacagaggaaattttttttttttttttgagaccgagtcttgctctgtcacccaggctggagtgcagtggtgcaatctcggctcactgcaacctccacctcccaagttcaagtgattctcctgcctcagcctcttgagtaggtgggactataggtgtgtgccagcatgcccggctagcttttgtatttttagtagagatggggtctcactatgttgcccaggctgacctcaaactcctgcagtacagtattgcaccttcctcggcctcccaaagtattggaatatccggtgtgagccactgcacctggcctccaacagaggatttcagtcaatgctgagcaccaattacagattgattgcctctgtgattccaggtaaataaccttgttgtggagctgagtctttcatcaaaaacaaggactcctggcagatgcccagaggcatttataagcagtcccatcacgaacaaattgccaaatgcaaggcctgagcaaaagacacagaaaggatttctttatcgtaagcacacttctctacattacctttataatccamcaactytgstattagtaaattatagaamcaacttttgtaacactatcttgtttscagagtatatgaaaaatttgaagttaaaattcagctccacgaatactgcagtggtgagaaaatggcgacaaagattagtcttctgtgagaagtctgctaattattcttcatttaataatgccatgtatgatggccttcattagaatgaattcttctcaacacctatgcctctttcacctcagacatgccttctaattttctttggtagtgtctgcccacccaggtggtaatttctggtcataagtctaatttagtagccagctaaaggatatctgtgaacccttcgcaaagagtaatctattgaaaaggaacaacaaaaaagtatatctgtgaacttatkaaatgactttaatcatatgaaaatcagccatcagccttattagagtggttgattttttttttratctaagagctttcttggttattttctgttcttaatcattgttgtatatccttaatgygcaggacatgacaccgtataacaagtgttttaaaaatatttacaattctgatcttataaaggaaaaagttacatatggtcctttgaactaattgctaaaatgacactacattaattagataattaagggtcttgagcatgtggctattgtattcattgggctggaagccaaccttttctatagctgagaaaatgggttagcataattcaaaattcaattgctgtaccctttttcatatgaatagataatacagaatgagccttaaatctgggttggaaaaactaacaggaactggttttattttaattgagttttaaagcacttctaggccatctcattgtctttatagtttaaccctttgaagttgtgactgccaacgtgctagtcttgtcgtcttacacgttaatggtaatgatctttttagatttaytgtgaacctctaggaatgttttttttaaccagtaaatgcactgaaacatggaatcaaagtctctttcccgtgggccccttttcattgggaataaatgctacccatagattgaagtagtttataccagtacattttttaggtgccttaacttaccaaggttatttgtcaggaaaattatctcttgtaacaccaggttccctacctttagatgacaggacttaatacaaaagttttccccataccaactagtagtgtaagttgatttcatatccttttatttcataaagttttgcttatcgggtttgtcatcctctatttgmaattaaaatgtgtggtctcgagatgaccttaaagtatctgacccccaaatctaatcactcctagcatctgtgaaaattgacaaatatgtcaggtataacttggggcatcaaaacattgttttaaatatttcgtttgtagacaaggcaaagatcattttcaggttagtcctctgagaaggaacgctgggtgcagaagcatctttggtttctctgctctataatcggcactcattatctatgggtttatacgagcagaaaatgtacagttatatgttcagcacaagtgaattattgattggatttacggccagaagaatgttcctaagtggtcaatacatggccaaagtgtgtcaggtgaaggtaaaaatcaagtaagatctatacttttgatagcaattgctgttggattatgttacgcttgtcatctgaggttactgttgaatatagataaaaatgttaattgtattaatttagacaagaatgtggcttcaatgagtatttcttacaaagtgggagtatcaatttttcttaaatgtagagatttagtttttcaaaaattatattttttatatgacctgacgttgattggcttgcctacattctcttttggtgtatgatgacagtttaaaaattcggatgcattttgcacagaattaagacgttatgtgcaatccttgtgtttctaattatatgttgatcaatgacacctttacaaaactgtcatcagtctattggtggttgattggtccaaccttagcccgatacctctatctccgcttagtcattcctggtgggtgactgatgacccctgcttaacagtaaacttgttatgcatagggttgttagaaaagtcttcatcaatttgagccaaactgtggctcccagctacttccatcaggggtccttattccaccctttgattgcaaaatgccctgaagacctggtatgtcttatgtcagttacaagaggcccttctagtgatgtaccgggaacctcctatgggaaccagagctctgctaattttggggacaagaaatgatgaaaagaagtgccttgttcttggggcatcacagtctcatgacagagtgcatgttgtcaaatgcgcgtttaatcttcttaagctcaacttcatgcaagagacctaggaattcacagagtgaagatgatttctccattcccttctccgagcagagctsttgaagaagatgggagttaggagaagtgaatcttttgttttcgaagcctttgtccttgtgagtctcttaattggggtgtcttgtaatgcaaagtctttaaagatgtgtgytcctgaaactcaggaggctgctctatcccatggttcaaccaaagaaccagggccaaagcagtgctgaaggaacaactgattctcttggccctccttagagtgagggtacaactggctccaaaggaaatgttggcacttccagagtaattctgacagtactcagatttgcttcatgtacccattctagaaccttacctactcaagtgtaagatgagatgccactgtggtatcttcaaaggaatttagaatcatgtcttaatggctccattaagaagaattctttttctsttttctctgaaaagcatcccaggtcataaaatgtaatgtgggattgtaggttttgtgggaagatgcacttggcagcaattccttgagaggaggccttgaaatgtcagggtcccccattcatcttcccaagctgggattgacccagtgataacataatgataatgcagctgctttcaatgtcaagccatcaggcagcgggttgggggggttgcttggcccaggaacccgtgccctgatgtggagttggtaatctagagggttttgagttaagtgcttttgacatggaaaatcaggagccaagggcgaagctgccttttaaatgctctttctgaaagagtccactgcagatgtaattgagcctctcaggtgaagagctttattcgagcaaagctggttagtgttgcatacctgtttgggggaatattttaggcatcctcacaaaactgctatgtgacattgctgaaggtccccagcctccttgctcccaaacacttcaagaaggaaaatgctgttgcagaaatgttgtctaagctttaccattcagtgtggcccagatcaacctgtcccttctttttgtgatcacagtgtgtaattataaagttatttgtgtgtttggtttatgtcttccacactggactgtaagatccatgagatctaggaccacgtctgtcttgatcatttctccttctctaagactaacacaaggcctggcataatcattgtcatcaccatcaccatagctagtatttattgccatatacagttatgtaaaacattgtaagaagtgctttacatcagttattcccaaccatggagtcatgagtcaaagatggtcaaattggccaagatgaaggtgtttgcattttggagaccaagcacttgaatccataaccccaagatgtgactttccaggcttgggatttcgcaacacgtcgcttaatctcttagcttacattttgtcatgagtaaaactgaaacagtaattcccatgtgctgagtttgctgtgaggattaaagacaaggactgttctaagcccggcatataacgggagcccattataagtgaactgaggtgttattttaatatataccttttaaagtttgagtgttaggcatgctgttgagtgaaagaagacagactgttaccagaggacatattctgttctatgataccacttgtgtaaacgtgaaaagcaggcaggaattttccatgtgagagaagtcagaatagcagttagcttaccagggggtggtgatcttaaaggggcaggaaggagccttgtggtatgctggaaattttccattcatctggtgatgtgatcacttggccgtgtgcacgtgtaaaagttcaagctatatgcttaatatttgtgcacgtcggtgcgtgtaagcaatatctcaaaacatttgagagaatttcccattcattgacagaatttttctcccgcctcggtcaaagcacacagtgggttttcccaacaactgaggtgcctgagggttgggtgccaaagaggcagaaaggccgagatgaccgcttgacctaattccctattcagctgaggcctccacccctggcctgttcaaaggcagttacggatcttttactcaaaacctgaacctaaaaagaaattctttagccatgtccgtgtgaactaaattcagcgtcagatgtacaaggctgtggttctgaccacccccgggctatttctgaccacaggacagcttaaatggtgtggcccataaaatgtaatctgcaaactcaggctgaatgttgatctatttagggccaagagaagaccaggccttggcagcagttctccctgaggtaggatcttaggtcgaatggagaccatcaccctggctgccagccccaggaggctggaaattcgttagcattctttatctttggggatcggccacttacttgtggggttgactcttacagcctttgaccacctcccaaaagctggattcactgatgggcccccaactcaactttcactggccaaagtacttggggttaatttagcaaaccccaggatccccagagggtccctcggtattgtggttttctcctcgcttccaccttatagtggctccaccaggacctcttgactcagccagcactccttctcaagtcacttcgcagcacaatccgtttgttgttgctgttgttttttcttttgttttgttttgggtttttttttttgtttttttttgttttttttgtttttttgcctaatttgtgcttggcttctccacagaggcctggttctggtcccttcccctgcaaccccaaggcagggggcagattcccgtatcatggtgctccttggcctgattctgtggsctttatattagaactcaccttctggaatcttttattgtcttgttctctcttccaagctgcgcatcttccttcccttcagaggtttggtgatcagcgtggtggctcgtttctataatcccagcagttttggaggccgagactcggggatcccttgagcccaggaggttagagaccagcctgggcaatatagcaagatgtcatctctaccaaaaaacaacaacaacaaacaaacagacaaacaaaattaggccaggtgtgatggcttatacctgtaatcccaacactttgggaggctgaggtgggaggattgtttgagccccggagttcaagactagcctgggcaacatagcgagaccctgtttcttaagaaaaaagaaacatttaattaaaaattcagaattggaagttgcattgagccaagatcatgccactgcatttcagcctgggtgacagagcaagattctgcctttaaaaagaaagaggtttggtgccaggacgccatgaaataattactctaggtaacctgaggctagacaaacctctccatgtctcagtttccttcctggcaaaatggggaggtaaggccagatttcttctcctttagttttgtttttctacttgaattctatttgtcatcctctgtacctaccacctgccagttgctgtattagatgctgttttactcattgtctaattgaattctccaacaaccttgcaatacgcttgttatctccattttagaaacgagaaaatggtgactcagattaagaaacttgctcaatgtaaccaagtcacaattttaatattaaaaataatgagcatttattaagtgcctgttgaatgtgtaggattttgctaaatctttcacataatctcatttcatctttatcatagcccttatggtgaaaatgccattattctttgacatagaggaattttgattcaggaaggttaagtaatgtgcccagtatcatctatgtataattgatgggtctataatttcagactcaggtttgtttaagtccaaaaatcatgccattatgactgtgtaccatgttgcatgccttcatatccccaatggaaaaatcccttctcccacttttcttaaccctacaagatatgccaagattctatagcatctgaatttgaaaacctctactaattcatgaggcaatctatttgataatggcatgatttagttagtgttccttttttagagataaagcctcacyctgttgcccaggctggagtgcagtggcgtgatcacagcccactgtagccttgacctcccaggctcaacctatcctyttacctcagcctcttgagtggctggaaccacaagcagatgccaccatgcctggctaactttttttttttttttttttttttgtagaaacagagtctctctatgttgcccaggcttgtcttgtactgggctcaagcaatcctcccatcttggcctcccacagtattgggattacaggtgtgagccactgcgtgaggcccagttagtattctttacatttttaaaataaaatttcagagaaagcaaccaaagggagcataactctgataagaataataaaaagaaacaattcagcaactctcttacagatttttatcatcatcccattcataattgattccaracgtgcatgaatctttcaagataagtgtcttattgattaycctgaaaacaagcgatcacttggtgtcctgagattcgctcactgccctcccctgattaccgtaaacagagatgttgatgagaagaaatgtcactttctttggtgttggatccataggacattttgaggaattgggtgtggggagtggagggagtgaagtgacccagatagggaggtgcttgatggcttgactgtggccttcaccttgctttttgtggagctggatatagacatttgttggccagctaatactgtcttgatctgttatatgatccttaggccaggactttttcctggtaattgtgcaaaatgtcccagtgaatgccaattccttgctgtcaggaaacattaagtttcctaagtgacatcctttttctgcatgtttacttatggttatgtaaatcaagcgggcctccccattggaaatgatggcagtggttacaagggacttcacctggtcttttgtagttgtggcaaatagataagatacaaatgtgacctgcaattcagttcagcattatgaagctgtatctgctccctgggtggtggtcacagccctgctttgtggccctaacccttgccttcctgctggcgggccttgcacaggtgcagagagggggttagtattggcaagctaattggataaatggtgaagtttcccctgggtggctccattgctccaggtgaagctcttgaaatactctgtagatgacaatagcctcaaacttgaacaggttcttgcagttggcaaacagaaggagaccagactcataggttttgggtgcggataatggataatctggctattgcatttaattcccagcctgatttattgaggctgcctttggtgaaatattgatttatatcttggggggccaggatggggctactctgtactcagatgaggcttgctctcaggaagttcttgttcagcagcaaaaatctgccctgtttgggctctgaaagttatttttgtagtggcctcacaagtttcttgtagcaggtcatgaagaggaatgaaatactataatcacagagcttgcagaagctgcctggaggaccagttagtctattttttgtacatgaggayactgaggctcagagaaagtgaggtcattgagtcacttgagttcttgttgagtgttctttcctgctgaggtgtcctaggtgcctcttaatgcctttaacatctgctaagagtatgtcacttattgacgtagcatcactttattgagcagctactatgtaccaaacacttagcatatgctttttggcattaggagctgaacccagagtggtctctgtggagaggtgcaggtttacccagggtggtggtagtggtgatggggtggtagtgatagtgttgatagaagaagaggaggaggaggaacttctcaggaagaagtggcagttccctcctttgtttcttatctctactgtttagcagccactctccaaagcctcttgctgggaaygtggccatcatagaagtaaatgagacatctctttcatctgcaccaacctccttattaagaccttatcagttacctgtagattctcccactgttgtacttgtttctccctcaaccaattgtattttagctctcaagttttggcagggttgagtctagtatttctgttgggatccggggagcatatggagtgttgtttgttattttttagagtttcttattgcggtaagtgctcaggagggaacagagggagaaggatagaggaaaagcaaagcaaaacaaaatagaaaagcacaaatgaagaatatttagtccattctgtattagtcctccttgatggggggacacatgccagccaggttacctgattcatctagttgtgattttattgacagtcatttctaccttgttggtatccgcagaggttgtcttgaagggggctgatgccttctttcactagctttatgtggctggcagttctgtcctgccactcttttcctcatcatctcagcctccctgcccatggcactcaagagtcsaccttggcagaacctgcaactcttcagcgcctccctaatgaactccttgcaagggcccttggttaagttacagtagagaagtggttgcttaagcaagtagtttccggtaaaggcataaagatagcccataattgggtgataaaatacctggattgcatctaaaaataaagacttgtgaaggtaaaactgtagcttacagtgtgcgactgtttaccttcttttggtttcttctcatttaataggttggtcatctctctgctggstttttcccccttttttctcccttctgtagaataacatgtggaccattaactatgatgctacttcttagctgcaaggggggaaaaatggaaaactccaggggaagagggtctttacttagggagttggcatttgttggaatttcccaagaacatttcatgattagtgacaggttatcttctastttacctgaaggctatggtcactcaacaaattttgtgttgcttcttacgtgtcacgcactgtgataagtcctaggattatagaagtcaataagctatgatgcctatccttaaggagagaaacacatataggataggaamatagcttgccatgtctgatagatattaggcattcagtctctctctctctctctctctctctgtttattatagatagaaataaaaaaattataaatagaaatttatttctcrtggttctagaggctggaaaattcaagatcaagatgcagacaggcttggtgtctggtgagggctgctttctatccttcaaaaaggcaccacgttgctgtgtccttatttggtggaagcaagtgtgttgaatattctaagaggaatctgaaagtgttatagtattaaggaagacagatccaagatggtggcaatggtcaagaagggtgcgggaagaacccttcaactctaatattatttgagctgctcactgataaataaataggattttcccagttggggaagagggaaaggtttttagggagcagattagacaagaaacattgaaaacacaaagtgtatttcttgatacttgttaacactaggtgttgaggagacataaccaagttctcctgcagtttgtgtgttaaggcagatggaaatgtcttgtaactcagtaaaacagtttagaaatttaaagcctttggagagagtaagtattgagaaggcacatctctacgttgttgaygtgaaggagttgcaaggtcgggtagatgggatcagtgccaggtctaatgggcttcatttgcaagacctaatttctagcagatcatggtgtaagcctcaaatgggaggtgtgcctgggatggttgcagaggagttgttaagagctcagactccagcgtttagacaacaccagctgctacaaaggacactgtgcatttctaaatctgagtttctgcacacgtatggaggagtaatatggcacctcctcatttggttgagatgctctggggtacacgtacaaggcgctcaactcacggtggctccaccagtatgaaaatgtgttatctgccctagtctgaagtacagaagtcaggtggtgagaggtgacatgccatgatgtggttctgcttctctgagattgtctgtcagcttttccctcagtttcacccccctttctccctttttcaagatggttttagcacttccagacattataaccagatagcctattgctagagaacaaagcaccttctcttcctatatgtacctcttgggaacaagggaacctttccccaaagcccctcaacacacttaggctgacatctccttgaccagaactgtatcaaatttacatagcctcaaatgaagcatctgggamcaccaggattgggtgtttaggccatggaagagtaacagcccagtacacaactgtctccagtggccagcacgtagaccttccctcacactttccactctctgcatcccctcttccctctcatgtatctctattacatggagcctcactttatagtcctcattaagagactgtggggtggtagacagataacaatgttaacatcaggcaaatgggttttggatttaggttaccatcatttatcttctctgtaaccttagacgagttgcttgagttctctgagtctcagctgaccaagctctaaaatgagcataaccatatcagtttgtgtttcctgttacagggagaaaagactgagataactaaagtacctgattgastaactgctctctgaaggtggaggctggactgcttcactggacagggtggcctggggttattctagtgcagtggtagctggtgacaaaactsaaagaagatgtaactagagaaaaggtactcagtgcagcctctgtgagctaccaccactgcctctagttttccagaaaaccaccmctgaccactctctgtacagatgcgctcaagcgaccataaccaccagtgttcctaacaatgcgcctattgacttcttatttcaatagatatccagattkattatccctcaaggtaagcatcgattttacctttgtctcagtcaatatttacctctgaggtcaatacgtgtggatattcacctcagctgcagtcaatatccatttcgtattacaatatatgatgtgcrtatgtgaaaataaagaacagcatggtacaaaaaaggtctgctaggcaaagaagctttttgcaaagcggatgtgtttttgttttattttttgtttgtttgtttttactgtgtcactttttagaggtcagattctatttcactaaataggacatatgtgtcttctgccaagatgtggaattttggcaaggctagcatgataacaaataaacattcaagcagtcacttaatgatattgaattgaacacmatttctcagaagttcctgtattaaattacaaccataagaacatacacaagcatgcagattgtaagtgtgatgagaatggaaacattccataggacgcagagttattcctcaagcccctggactcgcagagaatcaggtgtatgaagcaagaggaagaagacaagaatcaggaggcaaagagaaggaggaagaagcctcagtggggttgcttctttttatttcttagagccagagctggaagacaaggcctggcatattttggcaggcctggatcagagcctaggtgtgtaaattaggaattgcatttsgctgctgctaacaaggacccaaacatggtggtaaattcttccacataaaacaacagaaaataagttgttttctggccctgggctggggtggccactccaccgtcatcgatgatccgggctccttttctctttctgctttgtgacattgcttctatcttcatgataactcgctgcccagaatgaccaggcagcatgaaaacgaaaaggtggagagggaactaacttcttcccttttgaagagctttctaagaagccccacccaacactactgcttctctcccagtggtggtgatttagttgcttgagcacagatagctgccagggaggctggaaagtacagccttcagtcctagcaccaatgtgtctaggcaaatacaaaagctctttagccaaggaagaaatgacaacgaatatttgggacccactgggagtttgtgccaaaccaggtgtcattgccctccccaccctaccttgctcccctggrgtgtatcctgattcttttgaggawcacttgatcctgattttttttttatgtgtawagatgggatttcattatattgcccagactggtcttaaactcctggcctcaagcaatccagccacctcggcctcccaaagtgctgggattataggcttgaaccaccatccctggccttgatactgatattttattgtcctaactgacagttttgtctgcccagcattttcccccrtcacccttgtactatcccattttcctttgccatgcacctgtcttcctcttcaggattgatcacaaaatcaaaaccattcctaccagccagaggtgggcacatgacccaggtcagaccagtcacagttcctgattcccggccacagtgcttgatgggggaatgagcatatatcaaaccaggacagtccaagtccttccggggactttgctgccacagttgacagggggaggtatttgcataacttcaccacacacagctaagctggtgatcctgctgcttggcagcatcttcccagcgtacaacagaggaaaactgcctgttgtagttaaaaaaaaaaagagagagagagagagagactgatacmcaaagagaatcagaaaggagtagagatgaaacaaagatagagctagcatgattgcaagctgaggacatacgaggagtccctgggtcagctgggccatacatttgtaagctgtagacaaacaaaaatgatctttgggttccttctttagcaattggagttggaggaggatgaccttagtttgcgtctttgtcccactatcattatatccaacttgtgtaattagaaacactatttaagtctcagtttcgtctcctgtcaattgggaaaatatcgtgaggcggagatgtgagatgtgatcacgtttataaagtctgcggcaagaggatgataaagtcacttctcaactccttctcaactcctcctcctggcttattaatgcccatcctttaacctgtcctctgctttatctcttggaatccttagggcctttttaaccccatatacgaagcaaacctatgtgtatgtgtttgtgtgtgcatcaattcatatggtcctctgcagccttgcaaagtcgattcctgacatttccgtagactgttttttttgttttcagcaatactctccagcagcaaaacccaatccgytcatattcttgcatttgctgcagcaaaacctgacctctctttgtgttacctgagtcttgacgaagaagactgaggaaaggcccccccccccccccrccaaattgtcccgttgtctcttggctggtcttgccagctggcacacagcttcctctgaccaccctgctaggtacaaatcccacatgaaaagtctcaatcacctggctcaaactcatagttttcaggtggcataagccatggcattttcacctcctttcctggttgtttccagaaagggatgatagccccagtgcagtggctctgtatttctcagggcagcgtgggacctcagggtttgtcatggaccacacctttctcctttgtccctttttataactcataggctacctccaacttgacrcttatttaagtttttatttattttatttagcattcagaaaactctatagcctcagtctctcgggatgtaaattaaagcaatttcattttcatagtttctctgtttcaaatccctcattgtttatttaaatagcagcctatgcatattgcaagtaaagaattataattaagagaaccagaagggcctgtctctcaggaaagcagtgatttcctttcacaataaccctatccttactgttgaagacttgyggaaaagggacatggcccagggaaccagagtggtttgggaaagcactttgtcaagaggctkggggaccccagggtggaagytgccatgcgcatgaggytgtgttagcagaggcagtggcagaagaagacattgcaaacctgcaaaagcaacctctgaggatgggtagacatatacttcattgcaggcagctgctgctgaaatagatttggagtcagatgtcatattcctgccagcaggtttagcagtcgtgggactagggaagtggcaatggcaggagcaactggaaatgtcttttttttttyctcctttttcctgaatatggaaccaaagcctgtgtttttcttgctcacatgtgagtcttctccttgcttcaaccctccccgctgacagccacaagactctgcctccctgcagcctgtggaacrtaatattcgttgggatcatacattgaccaaagatccgccatgtctttgcaactaacatactcactcatgacttcacgtggctatgtacaagaccacatctctcaatggtgaggtcctcaatctctccctccccaccacagttagctatcagagatatacggtgtccttaagatagggcaggcagggccacctgccccccagctgaccagtgtggatgtcttgatgatgagccatactcagagtggccctaggatggctcctcagatagctgctggcagaaacctgcactcagtacatctatacatggtgtaatgattgactcaagatamttagcatagccrtcatctcaaacctttattatttgtgatgagaagattcaaaacccgctttttgaactgttctgaaatatgcaataccttgttgttaactgtattcacctttctgtgcaacagggcaccagaatttatttttgctatctaaaatatcaattaaaaatacaataaaactaaaaagaaacctgaactcaggagagtggaaaagaacttcaacattcaaaggggataagacatatactcagagtgggaaaaatactaaatggtaggaagatgagaagttttttactctttgttgtttctgctcattttttatattcaaaatttctaatcatgtgtgactatatatgtattatacatggtaggacttatttttttaatgtgaaagaatataaaacaaaatacgatattatcttttgagtgatatcaacaaaacaaaacatgatatccaaagtcaccctgtatggttggatactttgggtttgccatcttttcttttgttcatttgtttcatgcaatagaaacgttttgagatcctgtctggctgggttctgctaggcctgggtctacagcagtttgctgtcaaggtcttggcccttcaagagcatgtagtgtggtggggaaggtgtacatcagtgaagaggtaatccaggtcacggtgggatgacacaggctgctgtggcaacccacagcaggaatagccagtcctgccccagcagggcgtatcaggggtgctaaggtgacttccaagattgaggttggcgagwtcgtgacaggtgtgcaagatggggtgttccaagactggggacaggacaggtgtgcaaggaccagccagctgaggtagaggaaacctagacctatggaacatgctgatttcaaggtccatttgtggggagaacacggactgtgtcattggaagccagcagggagaatcagttgagaggtaagccgggcctagtagaaagtaagcgaagccctttcattaagtgaacgaagggtgcatggtgagtacacagccatgaaaataaaatgatataaatcagcacggtttcagctgccctcccatctttctactgtgatctcagcagtgatggggctggctttgagggttggagatcacacacacacaatcagccagctctccaaagcaagccccacactctcttgatgctatcctcaataaacatgcggtctaaacagtaaccatgttctagctatgcagatgcagtttaaagacaaatcctttgagcctccagcatgcgatcccctcccaatctcattgctgctcccctaccctcttctgcgtagaagcgctggagccaggtgcttacgacctgggtgctagtatctttgtgaaaactgctcctgacctattgctttgtttattttagccggtgcctttgtagagggaaaacagcttagcaagcatttagtaggtagatccaaagtccccaggagctgttgggaagtccataggtgctgtttccattgctttttcattccttcatatattaatcaaggagtcagtcaatcaattaaacggatactattagcacctactgtgtgccgggcactgtacttggggccatatgcactgctgattcattcatttggattctacggtggctctttacccattgccatcattttgtaggcagtgagtgcccgcatcagtgggcgttttatgttgcaccattttctgagcaatgtctttsgtccaccattaagcatttgtggccgcccaccccacaatatgctttgctttctgctttcagaaacaatactggtgacctgttttaagaaaagctgaaaagccaggacttagatttttctggaaaccttcaaattaacctcattaagtttaaaattgtttttttctcgttcatctctcttgcttttatgctttccaaacccctaaattgtggtgcctcagtgatcttctataacataagttgatagtcaataattgcttaatgggaatcataaatatgagtttatttatatgtgtrtatatatatatatataaaatatatttccatgaatatactgaatgctaagccctccccactttttttttcttttttaaattcagaaatttctagttgtgtttattcccctcgtcagcatactttatcatatcaragccttttcagacactgtaaaactactgagttatgtttgggtcatgttttgcggtatgccctttaatagtgtagctttagaaatgcaattttcagcctctgcttattagaatatgataaagtattcctggtctatgtccagctccactaatctccagactgcgcttcatgaattaagcatgaagattttagtcaatgtgctttcaaagaccaatgtttagggaatcatggattttctacaagctgagggagaaatctataataggaggaactgattttcaaacatcatattctcaagaagaaatgaccacttctggcccagaaacagaaaatatttcactatcagaattttctagaaccagttaaaaccacattgtgctgttaggtttaataaacggattgtgttttaagatgtgtaagactgtctgtcacgtgggaggatttcaaatgactgcttattttggaaagctcatgtagactgggttaaaatcgagaggggaatgcaaattgaatttataaggtattattaacttcttcctctttccccccgccctggcccctgtgcattttggttcattttgctctgatacaattcagcaaatagccagatatttcttgccatggcgagagcttagttgggggagagattttgaccaggcaggctctcaggtcggtgccatcggtgacgccaacacacctcctggcttggtgtgttttgtggcatttggcaggcaaacgttttgaaaagaaatctcctttcaaaaatcacagcactggttgaagcaggagcatctctcccyttaaatgcaaaaggagttaatatgccagtgactacagtgtgcctggaaaggtcactggaggcatttttgtctggggcagcccctggagtcttggcttttgtgcttggtgagaccttatctggcctcttcattgtccccttcatacaaatagatagcttttagtgagcagctactctgcctggcactgttctaaacacatgacaccaatagctcactcagattsccgcctctcaacagggaaactgaagcacaggaagtttcagtgatgcacttaggcaaccagtaagtggcagggtcggcattgaggtcaagactggttggacccctaagtttgaacaatcaaactggactttggggctcacagtttgtttcatgtcaggaaggtgtccgatcagaacctgaatgccagctcaagctgctctcagctaaactccaggggttgctgatggagacttcatcccctcctccagtcccgggatcaagacagaaatgtaaatcacctccaagaatgggtctgcgtcttgcacattttccttttgagaaagaggaaaattctcagctggtctagctttgtctgtgaacctccgggatctctcaggggctttaaattaattaatcaatccacagacattgaactgaatctccaccttgggcttgagactctgcaaagtgcattaaatgggaaggaaaccaaagggcctgctgccctgcccccgccatagcccaagkctgtggccatggctggggaattggcctgtcagttcaatcaggcagcccctctgactggtgtttttcactaagctggccccatggatggccctggtcatgtgtagacatggcctcaggagggccacattcctctcatttccaggcctccccacttaattgttcctgacacagtttggggagaaatgcagcaaaacccaggcctgccaatcaacatttgctcccgagtctcagagcggcccctgaagagacaggttggaccaagggacatccacagatgccttgtgtttaggaagtggggtgtgggcaacagagggagaattgttacccccgggagactgggggtgctgaagaagagtctcagtctctgcactctgggtcttgccaaaacctctgggattgggtgtggtgtccatgttgaggaagggacagtgagctctctaaatgacagtgggtcaaccaccgcatttctaggactcaaagatgccgtgggggtgtattagtctgtttccttgctgttgataaacacatacctgaggctgcataatttatgcaggaaagaggcttagtggactcacagctccacatggctggggaggcctcacaaccatggtggaaggcaaggaggagcaaagtcatatcttacatggttggcagcaggcaaagagtgagcttgtgcagggaaactcccccttataaaaccatccgatctcgtgagacttgttcactatsacgagtaaagcacaggaaagacttgccctcatgattcagttacgttccaccggggccctcccacaacacatgggaattgtgggagcgacagttcaagatgagatttggrtagggacacagccaaaccatatcacagggtcacctgtaggttaccgtaaataagagaaacagaccaagtagagactcagcatagctggagggggggccccagatgacggaaacagccccccagctccagccatttgttactgggttgtttccaacagaatcaaggactcggatttttatgtgaagtcatctccattttaagtattcttttctttccccccaaccctccgtgggttaaagcatccatgtttacagaatgaaagatgagggcaggataccacttctcctagggatcatcatcattttgtggggctatagtccagagaggtgaaggacccatcttgtgactgcacagctaccctgtggcatgactgagactataatcttctggattcttcaggaaaccctggtagctgatgaaactgccctagaacgacagcaagacaatagggccatgaaagcataagccctgaagtctggacactgagagaattctaggcttgacttctctgtacagccatcttgggagtgctcaaccctttgaatcggatgtctagaatggaytcagatgtcactgtgcaggtgactcacgcctagaatcctctgcctatcgtgacagggagaagcctgtgtgaccctgtggccatctcagtctctgcagggcatctgtagctttggaggtacctgggcaagagactgcctttcctactagagcttctgccatccctctgtcactatttaaagcattgcctgcaccctcaacctcgttcagtttccacataatacctggggcagggatgtaaataccctgattttatgtgtcaggccttcaggactcagggtgtataagtgacatggctcctcgcacagcagggatggagaggcaaacccaggttggcctctctgccactcatatagaactcctttatcaccaagattcctttcttcttcagtgccacctgccttattttactcacccagaaggaagccgggtccctctttgcccctttgggtgtttgtgaaaagcaagttgyaaacwctgaattctataaactgttggagacagrttctggagagacactcaggcttagctctagaaagaaacgggtaagacagaggaggttcagggcaactgtgttgccttccttgactggtgcatgggaattccccagcagagagaaaaaaaaaaaaagaaaggaaaaaaaccagaaaggagaatagaatctattatctccaagccattattcacacacacataccccaccgccattttccaaattgtaaggtctttttatataagcactttccgttaaaggggaagaaatagctttacccgtggtgtaaaatatatactttctaatgtaaatcaagaagctatgaataccataataagaatgtggtagtatattaattgatggaaattgtagagtggaatattcataatcagcagaagtcttttctctggaaggaacaaaggattaagttagggagacagtaatggtattgttagcaggctatttcaatgattttctctgcrgaagagtagggaaaggtgacattccaactgggaatattmgactctgcagatccctactcggagtttttcagccctgttttaagtgccgagctgggttttgcctcatgatccaattgttttattagcgaaatcatcatctrtttcattttgctttggtaatagtgcagtgtctgtctaacaataaattatagagtcaggcaaacaatggtttcgtattagggatataatgaaatatcttattaaaatgcagacttccttaggttcctgaaattagagtcttattttaaaatgattctgttgggcttattacacgcttttgaactaatcacactagtagaatctctctttagtcagagcatagaggactgtgagagttacctcttacttcagtattttcccattcgtattttattctcctgttctcttctggatagatctggatagattttttttagacagagtctcgatctgacagccagactggagtgcagtggtgtaatctcggcttactgcaaccttcacctcctaggttccagcgattctcctgcctcagcctcctgagtagctgggactaaaggcacgtgccaccactcctggctaattttttatatttttagtggagacggggtttcactatattggccaggctgatctcgaactcctgcccttgtgatccacccacctcggcctctcaaagtgctgggattacaggtgctagccaccacacccggcctcttctcgatagatcttatttggctgacaacgaaagctgttgtgctggtagcatcatccctttgcatgcaaaagataaactgaaatctraagtagccatatccttccggccaggtttttcaagtggttactctgttctgatcattgtcatgacaggaatagtgaaaataacaataaatcatttttctttaacgatccatttactgtatgctgggcactgcacaaaatggtttacatggtttatcttgtagcgttccatttaagtctgctaagagtagatgctatcattctctccattttacagataagaaaattgaggcttagagaaattgagtaatttttgccaatcctgagacttgaatctccgctctgtcttctgcatacactttttacttgtcattgctgattagctttctctttccatctccctgatcagaaccattctgcgttcttagattcaacaaaatgtaatactccaccttgccagtatctagcgtgttttcagaaattgtgaacggggtggaggtggagtactaactgcaatcagatgttttatttgtttatttatttttccttcttgcgttgctcttaagcccccactcttgggcaaggctctgtgctatgctgttttatgcacatcatcttctaacagcttctctgccacacctggagaagtgccaatatcattttcatggcacagataaggcattggatgctcatagtttaagtcatcaggtggtgactggaggagccagaaggtccctttgggcctgtcctctcaccagcatcaactgcaccaaaaagatctcattctgattatcagggatgaacccccccactgggtgatcaggcaaactacatgcattttaaaaaactatatcctgctgggtgcagtgcctcatgcctgcaatcccagcattttgggaggttgaggaggacggattacttgaggccaggagttcgagaccagcctggccaacatggtgaaaccccatctcacctaaaaataaaaaattagctgggcgtggtggcagccacctgtagtcccagctactcaggagactgaggcaggagaatcgcttgaacccaggaggaggaggttgcagtgaactaagattgtgccactgcactccaacctgggcaacagagtgagacactctcaaaataagtaaataaatataaaataaaataaaaaatatgtcctgtaatgaaattgaaagagaacactttgtttcttatctagttggaacaagtggggtggggacagacaagtgactgaccactctccatctgactcagtgtcagtagactctctcaaaaattagaagctggctgacatagtggctcacacctgtaatcccagcacttcaggaggctgacgtgggaggattgcttgagcctaggagttcaagatcagcctgggtaacatagggaaacccttctactacaagacatagaagaaaattagttggccatggtggcacacacctatagtcccagctactaaggaggctgaggcggtaggatcgcttgatcccgggaggtggaggctgcagtgagctgtgatcacgccactgaattctagcctgggtgaccgagaccttgtctaaaaaataaataaataaataaaattagaatctgaattttgaagacacaaattcagatgcatgtggatgggcccaaaatactttgtttacatgtactccaaatgtaactcctggggcacccttccttattttctctaccacaccaatgccttcatggtcttacatcttgtcctcttaaccctgacttctctagccctcatgaatgctttagtgtggcagatgttactgtacatgggccctcgtttattcagcaaatattcatggagcccttgtaccaagcacggtgctgagtgatgctgtgagggtgagcaaaagagaattgtcatctgttaaatcccagaggtccgtctgtgacaaaactttcaccattcttttgtaaaaattagaaaaatacaaaatagtgagtttttcatgagctacgttgtatcaattttaaagtatttcttttaggattctattatttaccctttttcttcaatgttaaataccatttcctttaataaagatttaaaaaagattccttccttccttcccccctccctccttcccttcccccctccctccttcccttcctccctccctccttcccttcctccctccctccctccctgtcttcttccctccctccctcccttctttccttcctttctttccttcctccctccctcactccctccttccctttttccctccctctctcccttcctcccttcttttctttcctttttaaatgctgattttgttttctttttaaagccctcagttggcaaacttaaaagttgttaagtctgtgttagcctggctagctttttttttctctactagaccttcaaagtctaggaatgcctgatgtatctgtatcctgtgagtttgccacttcatgatatttgatatgtcattgtttccccataattttttcattgttagcgttgtctctccagcctcctgcttcctcttcctctgtctccctcatggtgtgtcttgctcaggcatgtcttatataatcaatatttagtgatttgacttcttaagtccttaaaaaaaaaaaaatccaggtgcaaaacacaaagacagggctcatgtcaagggagggaacctcgctcttctactctcagtgaaagaaaggcaagaccactccagcctattttttttttctttcccttggcccttgtcaaaagggtagccagttttctgttaccattgtgctaactgaagaatggaaaatatgcccagagtttaaaaaaaatcaaccaatgcctgccctttctagagcaacctaattaacaacccaaatgttaaaatttctttatttagaaactcagctatccagaattacaactccgcctctcgtgcttggaggcatagttctttgtcatattcctgagtgtctacagatgatgaaaatagccagttatctttgcccttcatggaaaggataggaagaagctctgatgaagcaatgttggggcactcatggttaaattgaacctttcccctggttaagtggagtgtgtgtgtgtgttgttctttttttccagcaccatatttggccctataattaatatgcaagttcaaatacctcttgcatggagcaagaagctgaaacatgcgcatttgtaatagactcagcatctgaattgaatgggcagctttggctggagtagtactgcagcttctcgaatgcctattgtcaaaatatatactagttaggagacacattctgctacgagggatgccctcccaaattaaagacactgttcagtttacgcttaacatttatggctatcaaactactagtccacaaccaatcatcatggtttcgttaacacagtcaaaatttaccactgggctattattaaaacttaatataattaatgtaaaaacacatacttcttttcaacaaaaactggctctctttgtagtctcttttttaatttggtgcaatcacttaaaaagtttagcasatttaaaattttacatcattttaaaattgtttctcttttataagaaggatgctatttactattaatgtagaagtacaaaggaaacggttactttggatttattcttttggaaaattagaatgtgggctacatgcttttcagaagttgatgaccaagagaagaaagaaagaaaaaaaaaagggtgcttgatgccctgctcctgctatgtccgggaatttcttgtacccttcatatgagcccctctgaacaaaagcaaatcctgttgacctgtcagcttaaaaagacaagaaatatgccacattccgcaggaataaggagaaaagaatggtgcgaaaatcagtgacacgaagttgaatatgtgaacacatccagacaaatgtgaagccagcccgattaggacgactgaaagggcatttccccagaattgcagttttttttttttttttttttttttaaataggggacgctattgtcattcagaaagccacaggctgttctgaaaacaggcaaaaatcaatagcccacttgttgaggataagtgaattagcctgtgttgaatgtaactgagtacctgaacacttgagtgggcagggattgttggggagaaaagacaattgtcttttatgtccacagcggttcacatcgctgattaattatgtccaatgatcatttttgtgcaggactaatgggcagactctgtttttgtttttgtctgtctgcccacaacctggtgaactgaatagagttccccacttctcagaacaatgcaaatggtggccaaggggctgtggaagagttgccagaaatggaatgattcagattggatgaaaagttgattttattaattagttaaaatacaaaatgagaaaacagaaaacacaataaatacacagttaataaaatacttcatattttattataaaaacattaattactttaataaagcggtttatattttcaaatacaatatttaataaactatattaaaaatatatacaaaatagttgtaagaatcggggctcctgtgagtacgtaaatgaaatacgcttacatcatttacttctcttcccttttgtttgtgagtccagagacgatggaagagtttggaaagttgtcagcttatctttgcatatatttgtccaatgataattaagcacaaattgtttcaaaaatctttcaaaaattgttataaagatttttattggtgctaagggctgtaatttagcaaagtcttacacctgaaaccaaccaaagggtcttagagtgtgaactgttgtcttagacccggagaagtctccaaagaatgaccatccgaggcattcagctggcgtaagaggagtgactcatttgttcttctttttttttttttttttggctgtctacagagaaggaggatataggggcccttaagagaaaaactggagtagggtgtgtgtgtgtttgttttggtcaagggcagagtgtgctgtgtcagggtgtttcattgcattttcatatttgtcatttctctttggagcgtgtcttttggtgccacggaaaagggctggattttctatcrggtacaataggtacctgcagggcttagggtacaagagcttgtcggggacctgcacacatgtttgagacctgtaaaaatattgctggctctgaattatggaaagaaaatcgcaaagttaaaatctatcaaagtataattaaatacctacaaaacataatattatgtcactagtcaaccgcaacacaaatcttatatcattagatttcagtgatattgaatgtgggagatggaaccattttagtgcatttgatatgatgtgatgtggctttctccaagcctgagagtgcctgaaacccagagaggtcgtacgttgaccatgccacggggcccttcctggtaaatctaagcagaaatacaccatgcatgagacagaacaaagaaaagaactgtgaaaatacactcaggaccaggatgctgatacagtcatgaggttcagcttaaaaggccagtttctctactgcagaataatgaggtctatcctgttttgctttctttcaaagcccttaccatttatgaaaccagattgcaagtctgtttgaatcccccaaatgcctgtgctacataactgtctccttactctgtgctcttgccccaggcagagtggaagttgccttataaagctgcgacttggccacagtgttttccctttcagcagggaaaccggagttctccstgctgttgggaggttcaagagccactctgtgcagaaatgcccagaaagagttaagtgaggtaagttcgtcagacttctgcagacccatactgtggaagggtcaagtgcagggtcaccaacccgttccatcttcctgtcagttggcgtccacccttggtttcaaagggaacaggcattactgacatgacsggacctttacagttcccagctgctcatttggagtactgcggacccaggacaactaaagccggggtcgcctgccctccaggggttcctgggttgaagtatctgttccctccctttattttttctagcctttatagaaatgacaaagggtcaggtggtcttaaattccaaatctgggcacatgaatggtctgacctcggaaacttmctatatgctcgaaacgatttaactagcagcaataaaatctctactctttttatgacaaataatctagcatgtctggggagcatatttgattcttcatatttgggacccttttttaaaggctgagttttattaaaatgatagaaaaattagttattaaacagtatgtcaaatacctttctgtcccaccagatttatttttaaagacaaacattacagaggggcaggggaaggttatatttgaaatctttctatcctttctctaaaatatatttggtgaaaactaggaagtgttgatagatatcattgtttcctgacaggtttttggtgtttgcatcttgaaagtaaaactgccaagttatttttttgttctggtttttgttttttaagcttttctttgataacctcattttcaaggggaggcttagcactgatgtattttattttcttgctcagagaggaaacactgaaatagctatatgcttccccaccaggagagtggaagaatcttgcttttaaagcgatagtcctattttctaagtaaaagtccaggcatgtgacttaaaaaagaaaaaaaaaaatgttttctggtcaagtcacatgcctctgaggtttktttttttctttctttcttttctttttttttctttttcccagactcctcatacccctcytaggagacagtgattccctggcttcaccaggcaggctcttgggggcttcctggtccctgtcactcttaaaatgcagcctgtctttggacatctactccaagtttgcattctgccttgccttgtcagtctgggctatcaaaaatatagtttcgtttggaaaacaaaggggtgaggtgggtccaaagtacaggaagctataccatgcaaatgaaaatattttttccaaagccatctgctaatccctgtgatttaaaaatgtgcgtgtttttagtttctgtctaatttcaaccttttcttgctttagtgattaattaccaggtttctctattaagagcttgtgcgtgtgtagggggtagcatagaataaacaggctcagagcccccacccccacccccctttaagtaacagtgacgcaaacgacctttatttagcagaaggtagctctgcgaatccgctgaatgtccgattgcgatctcgctggaaagactgctgcttcagcaaggtttctttgctggtctgtggcaaggtccctgcttcattttcaaggtgtcctcacttggtgcctttgaagggtttttaatggattcgcttgatataccttccaaatggagtactttgtgcgttaattcagtttgtgataaagatcccttttaccctccttttcataattcttcccagagatatgaagtacactagaaggttagatgtggcatttaatttttccacaaaacctatccatagagggggaaaaaaagattcaatttcattactattcatgtgtaagaatattgaaggtggtatactaaaggagataactatttcttcttctatcaaaggaagaacaaatctgtctttgaacgaggagctcaattcttatttaaaagataaaaggtcacctacaatactcattcctttaaagctatagtgttggggtgggaaggaagctgtcttacctggacatattaattttaaattttgcttgaaaaaattgctcagtgcatttattgactagtctctctgtgtgagttctgaaagtctgtttatatctgttgccccttctcctaaagtgaacccagatatgtgggtatggggtgctagtttttatattaggtctgagatgtggaaaacagaaatctaacttagggatgtatcataatcaaaccgtcggggctaatggcatggctctgatattataaaatctggaggtttggaatgcagcaaactctgggggcattatcattattattattaatagtttgtatttacaaatgtggcattaagtagaacaacgtattcttgcaattaatgacaggaagcctacaatttctcattaagcacaggacagtgagaacgaacagaatttcagagacatgtttcttaacattaaaaacaacaaaaacaacaacaacaacaaaaaaccaagtaggaagcaggcagagttgcaatatgaagaacaatttcaatcatatgttgtttaattgagtttaacaagtaaatgtatatcccagtgtgtgtggtcaccaaagcataatgacaagttgttcatcatttaattagagatttgcttattgaaacgactgaaataggtagttgaaattttgcccttggacaagggagtaatttgtgatttgctacgttcatttcgtgagacttttggtgaaagacatctccttctcatatgtttaggcaagcgttgatgacatcaacctagccttttattttaaatcccctgtcaacgcaattagataatacaaaaataacaaaactataggaggttgaggatggggctgggggccaaggagattacttggtttgaaatgaataaattgtctatcgtaagggaattctttggtgcattttattgtgtgaaatgagcctggtcatatgactgccctgcctccctggaggcctccctgccctcctccttcccacagacacttatgggaggtactggccarctctgtatggccagtactgccctaagcaagaccaagaagcttagtctcaatttcagagagttattttggcaacatatttgggaaaatgatagttagatgctgcgttagccagcctctgcatgattttttacgcaraacaaacagttccaaatatcagtgctttcagcaactcatatatttctcacttatggtgcatgtcgctgatggttggctgctgctctgatctcactccagtatcagcttcagtcaaggaacgtattgttgtcaaggaaaggaaaaagaacagtggtgagaccaaaggatcttaaagtttctactttggaaggggcgtggcattgcttctctcattccattggctgaagcaaatcatgtatacaagccagaagccaatgagctataggaagggtagcaaagaacagaacagccatacagcctagcccacagatggggtcaagaagattcaataggcattggctgaagacttaagacttctcaagcaagttggatcctggtgtgcacctggcatatcctttaggattctttagtgttggtagattgagatggaaatgaggaaacttgtattacctactcctttgggccagaatttgcttacagcacagtgaggaggtattctttggagagcactgtttcccaagagtgattctaacaaagaggtgtaaatggacaagaatgaaaagcaattgcaagggccyttgaaggtttgtgaaggatggcaaagtgacttggatgttgatttctaaaggaggtraaacttgaaggtagacaagctctttgtgtccatacatttgatgggtcatcctatgaaggagggcccatctcttacggcaggcagcgtggcgtaggcctcagagtcaggcatctggggcccagccttttctctgcaggtgcgggtggctcttggcacatgatgtaggtttttgtttttgttttgttttgtagacagagctcaatcttttgcctaggccatagtgcagtgtacaatcagatttcattgcagcctggaactcatgggctcaagcattcctcccacatcagcctgccaagtaggactacagttgtgcactaccacacctggctatttttaattttagtttctgtagagacagagacttgctgtgttgcccaggctggtctcaaactcctggcctctcaagccatcctccagcctcagcctcccaaagtgctgggattacaggcatgagccaccccacccagcccatgttaattttttcacctacaaaatgaaggctacaatatttactttgcaggattgctgtaaggattagaaccaccgtctctaaggcattcagcatagtcccttagggtaamatgagtgctcaagaaatagtaaattttartatgtgtctcatttttttccagatgctctggggtcactaccaaccttgcctttcaccctacctgtggatctatgaccctgtccttctcagaacaccactcagtacttctgggttccccaagaggtgcctcttgagagtttgtaggaaactgtgctttagtaactcatggtttctgccctcagcttctcttgcatggggccttcctgcttgctcctctgctcacaatgacaagtgaggactcccctccatgccttttgatgctggtgcccatcaccccgatcacatgaacgtctatgcccaggtcccatttcctgacattcccaacatctctaccttctccgggcctagggcagggatcactstttcagaaacatgagcgtatggaagccccagtgtgttccttgaagtcccgatgcgtgatttgtccccatgctgtgtcgcacttggtcatctggaccctggggttgcctgagtgtccctgttacaaggcccctcctgaaaccagattggtgtctatgagggtcatctgggaaacctacctctggcagaatcgctgtcctgccagtttcctctcccccttacaagggacatttatgctttctccctctacaaaacctgcatgcaaattatctgatggaattgacccatagtgggtgttctccactggttcaacacacctgaattccggattcaagatgcaatcaccactactgttgttgtgtaagtattgctagagatggctgcagaatacctgggaaagctagctaagcagtgactggaggaaggccccagctctttggaacgaactttccagccgagaatgctttccaaaatgggaacaagatcccaaccccttatcagaaactttgggggccggatgtgtttcagaattcagaagttttcaaattttaagaagagaatacactgcgtattctgtgtattacaggggtcagcaaattcacagcccataggccaaatctggcctgtttttgtaaataaagttttattgctatacagctgtacctgttggtttacgtactgcgatggctgctttcagctacgttggcagagctcagtagtcatgacagtaaccatatgcccacaaagcctaaaatatttactatctggctctttgcagaaaatgcgctgaaccttgcrtgttgtgtcacccctggaggtagcaccttgtaattaagcacatgaatatctcacatcagaatgaatgaatattcacactcagtgggacaaacaacttctgtcagctgtagactgcttttgccatcaaatggttattgaaagaactatctgtgttgacagccttttgggtttcatacagtcctttccagcttgggcagtatagataaatagaygcacaaagcagagggaatcaagtagaataacatggtttatttgtgtgtgtattgttctgtttttggtaaaatcatgcttatcatatcttcartgcatcatttattctgagtccacattgctgcctttgagccggggccctgaggtatctcctatactctggctggggtgagggcggcaggtcctctgggccagcccagatccaccctgttcacggtgtgtgtcctgctgggctcacttctgaagctgaccttggggagcagattgaacacctgttgatgccattctcttaatttcaggggaatgtgtgggtctttgagctagagagacataggtgtatggcagatgagggaccaccccctccaccttagtccagttacagggcctcgcctttttgatactaacgctacatgaagagggacggggccaacagcaggctcttccttgacgtgttttatgtacactccagaaatattgacagagttgtctttttgttttggtttttaaatgtttttttaagttaacttctggaatgcatgtgcagaacgtgcaggcttgttacataggtatacatgtgccatggtggtttgctgcagccatcaagccatcttttaaatccattcttagattttccttttccatagctctttgtgatgcttgctttaatcagttgatacatgtttaatcacgttttgctctgggctgtgttatatacagctccctccctaatcttgctagaaggtagggctaatgcattgtcaattcagaaatagggggtgttcctgagtctggggacactctagtgaaattctatgkgtaaaataatttgtacaagtttatatttttagctaaattaaaatactcacattcccattattttttagaggttgtaagctaagtaataacattctagaaactctctgttttttgaaaggkcatcaccactgttgaaggcgctaatgggagatcctaagtttcaggctctgctacagacgtcaggtcccctaggagttgggctgcctttgctctcctctccgcgactcggtacctggtgtatagttggctaaaaagaagttgttggggctgggtgcagcacctcacacctgtaatttcaacacgtagggaggctgaggcaggaggatctcctgaagcccagaattcaagaccaggctgggcagcatagcackacccatctctactataaatttaaaaattaactgggtgtggtggtgcacatctctagtctcagctgcttgggactactagaaaggtaaggcaagagaatcccctgagcccaggagttggaggttgctgcagctatgttcgcaccactgtattccagtctgggcaacagagcaagaccccatttccaaaaaataaatgaaataaataaatacataataaataaacagtagtggttgaaagaaagggaaggaagaaatgctgttttaggaaatcaataggataatttttttttttttttgargcggagtctcactctgttgcccaggctggagtgcagtggcacagtctcsgctcactgtaagctccgcctcccgagttcacgccattctcctgcctcagcctcccgagtagttgggactacaggcgcccgccaccacactcagctaattttttgtatttttagtagagacagggtttcactgtgttagccaggatggtctcgatctcctgacctcgtgatctgcctgccttggcctcccaaagtgctgggattacaggcgtgaactactgtgcctggccaggataatctttaagaagaagataacattagctattcttctcacttcctacgtagaattccmtaccctgtgtctttggcctggaaagggtattggtagcaattgtcttcggctttccctgccatgtgtatgcattcccacggccacacaagcacacacacacttttgtggttttttttttaattatataagcaagtaggatgtttgtcttagtttttttgggctgctataacaaaatgccatggactgaataatatataaacaacggaaatgtatttctcacaattccggaggctgagaagtccaagaggaaggcactggcagattcagtgtccggtgaggatttgtttttgatctcataggtgtccatcttgctattttctcaactagcagaggcaactctctggggtatcttttaaaagggcactaatggccaggmgtggtggctcacacctgtaatcccagcactttgggaggccgaggcaggtgtctcggtggatcacttgaggtcaggaggtcgagaccagcctggctgacatggtgaaaccctgtctctactaaaactaaaaacttagccaggctcggtggcttgtgcttgtaatcccagccacttggaagggtgaggcagaattgcttgaacctgggaggcagtggttgcagtgagctgagatggtgccactgcactcctgtctgggagacagagggaggagactccatcaacactaataataataaagtaaataaaagggcactaaccctactcaggaagccttcactctmatgacataattacctcccaaagtccgcacttcctaatgttaccactctggaggttagaatttcaacatataaattttggggggasacattcagaycacaataatgttttataatgttcmttttgctttaacaagagacacatgtcagatagtagacatgatctgagaagacacaaaacccagcgtggtgattttggcagccttgccatgcatctctaacatgcacrtggccagaaaaatagcttggacattctgttcaaccctccacatsaactggtcagtttagtctttaaaaggtgataggcctgttgtsgtggctcacgcctgtaatcccagcactttgggaggctgaggcaggtggatcacttgagccccggagttgaagaccagcctgggcaacacggtgaaactaagaatagaaaatattaggtgggcgtggtggcgtgcacctgtggcctcagctacttaggaggctgaggtggaaggatcacttgagcccaggaggcagaggttgcagtgagccgacattgcaccactgcaccccagcctgggccacacagagaaaccttgtatccaaaaaaaaaaaaaaaaagtgaccacactgtggctttgctgctttgcctaagtatttcgtgaaattgatcgttcattcacaatgctcagtgcagtgactttgccgagcacaagtggtggacttaagaagccacataaagaagcacccacgtctttctctgaggacgtgcttgtgtgtgttctgaggaaagcaggtgatgatccctgaggtgtatcccccaatcccaaactagaagtgagtccccctgctcctcaagcttgcatggcgctcaggtattccagtgggccccgctgcattcttcccagtcccaggaaatctttgtgcatggctgtcttttctgtgccatcttgggcatctcacgcattggccctatmcacatgttgcctccagcatcccaggaactccgttaatgtttatttgaatgatggaatgaaggtgtcttgctatattttgacatttctgtcaaaatatgaatctrtctttgcctagcatcttttcatgtgcacattgcccatctttataacaaagtgtgagtgggaaaggacttttaatcttcattatattatcattcatatgaataatgttaacaattagtgtttattgagcacctgctatgagccagatgtagtgttcagtgctattcatgtgttcttgaattaaattttcatggcaagcctaagaggccatgactgtccacattttgcctctgagagacgcaaggcttggaggcaggaaatsactcactgaaggccacagcacaaagtggggacttgagtcccgatctcactgattctaaagtccttgctctccaacctctgtccatctgaaatggaaaagcactgacgcagttctcactctggagcttgttttattttgcttgggctgctgtagaaataccacaggtcaggtggcttaaacaacaggaatgtagttcctcacagttctggaggttgggagtcctagatcaaggtgtcagcagggttggtttctctctgtaccattgtccctggcttggagatgaycatcttctctgtcttcacatggtcttccctctgtgtgcgtttgcatccttatggcctcttcttgtgagggcactggtcatattggattagggtccaccatataatgactttattttacctgaactgtctcttaaaaggctctgtctccaaacacagtcacattgtgaggtactgggggtttgggcttccacatacaaagtctgggacacagtacgytctcataagagacctcttctcaacaggatccatgtttgatccgggggaataaagctagagttgctttcttccttgtaatatgtataatgactcatgagagaattcyccactgtcttccccacctgagacctgagaggaggagaaggaagcttggagtcgctgccctgtggcctgaattggtcagtgaccaatcactcagacccagctgacaggctatacgcggacaccttggatgtgcccagcatggatcttctccaagtaggaggccttggagtcagagaaaggtgcaactcccactgctgctgcaagaacaaagactttaagatactgaaatttctgggcaaagtttcctcaactcttcatttaagtgttaggccaggtggggtggctcatgtctgtaattccagcactttgggaggctgaggtgggaggatcactggaggtcgggaatttgaaaccagcctggccaacgtggcaaaaccccatttctactaaaaaaaaaatatatatatatatatatatatatatatatatatatatatatatatatatatatatatatatatatatatatgtagccatgcatgggggcctgcccttgtagtcccagctacttgggaggctgagacatgagaatcgcttgaacctgggagtcggaggttgcagtaagctgagatcgccactgcactccagcctgggcaacagtagcaagacgccatctcaaaaaaaaaaaaaaaaaagtgtaatgcaagtagaaaagggcacacactccaggtgtatatctcaacaaatttgtacacactgcatgcacatgggtgacccgcacccacatgttatacacagaataattacaggaccctgccaacctcctcctatcccctttcagctcctgctgtgatgccacttctaatctcaattttattatacaatttgttaaatacagaagtaaatggaggcaatagtgatagtaaaaagaaccatgtgaactgggcgtggtggctcatgtctgtaaagccagcacttcgggagtccaaggtaggagggtcacttgagcccagsaattggagaccagcctgggcaacatcatgagaccccatctgtatccaaataaaagcaacaaaaaaatgagacatgggggtgcatgtctgtggtcccagctactcaggaggctgaggcaggagaatcacttgagcaaaggaggttgaaccatgattgcaccgttgtactccatctagcctgggcgacagagtgagaacctgtctccaaaataaataaataaataaataaaaataaaagtaacagaaccataggccttatctttatctgagttcctgtagcatgtgcactactcctgattaaccaagtgaaagagaaaatgagactaatctctaacctcagcttccttttctgccaaatggaagatcatctctaattaataatgagttagaatacctaggacagtatttggcacacagttgatgaggatggtgtacctagtagctaatggtgagtaggatgaataataatactataccttttggtttctgaaatgagaaatctaaggaactggcttaaccaagaagcagcaagctgttttaattgtgctgttaggagggctgtttgttaaggtacagaagaggattggcccatggctttctgctaagaacctgctgaatgtctgtatagaatccctgcattgtgcctcctatcaatcaggtgcttaggtttgacaagtttcctccaacagactcgtgtagaagtttctgtatcaactggaaaaaaccatggtgcttgggacattcaaggccgaaacttggtccctggatgggagaagatagctgtatcattggcagaggtgccttggtcatgtaccctctccagactagacactagatagtgggtagggtgggacagttttatgtcctctgccaccttatctgggactcttgtcccctgagaagtttgaaaatttggcacattttagtatttgtcagtgtacttcctgcttcttgatgcacttgtactgcacaagaattgattttcaggaaatatggtttttttttcctttttgcacagcgatgggttagcaaaatgcatatttgcatagaaataatctttagtgagctctgctggcaagtgtgtcaaatttataaatatcactactataaagacatacttttggatatggatttcttcctcagtttatttcttctttsattttttcatgtccaggtcactacgtattgcgtatatttggttggaattttatttttgagcaattcatttacccagattgtgtttctggagattaaagcatctcactgtatttttatttttttctacattgcaatttcaaaataatccaactcaaaggctgttgaaaggctccttctgtttaaggtaaagcctgtggcagcctttaacttcctttctcttctcctgctgccaccttggtccacaatttatctttgaaaatgctgggttttaatgggcagggtatagtgcagaaaccagatggttttaactcacacctgtgaaaatgctggggatctgcgaaacattaaagttaatggccagaataaggctgccaagctcggtggaattgtacttaactggcatatcattctggttaactgaactttccattaactcacagatctatcttttcatgcccccttctaaccccctactcaccacccacccagttcctcctagtgggcagtttgctgctgctgtcttacctcctcatcctcacccctttcacctctcccctggtaactgatttatttttccctcttggagktgcttattcttttcttcttccagttgcatctctccctctacttagatacacatttccattttacttctatttggtagtctcagaacttggcttttattggccagtatattcaatgattcacttgcacctttaaccttgtgttgttctaatctttttttttttttttttttttttttttttttttgagacagagtcttgctctgttgtctaggctggagtgcagtggcaccatctcggctcaccacgagctctgcgtcgtgggttcatgccattctcctgcctcagcctgcggagtagctgggactacaggcactcaccaccatgcctggctaattttttgtattttttagtaaagatggggtttcaccatgttagccaggatggtctcgatctcctgacctcatgatctgcctaccttagcctcccaaagtgctgggattacaggcgtgagccaccgtgcccagccttcttgttttaatcttttagacaactggacacaggtttgtctttgaaattgtcctggtttttcttgatgttttagtgctcctggatgtccaatgtcattcttgggctagttgaargaaagttttggctacccagttgttagctgctgaagtttaactgtgcattctaagcacaccagtattttattacatcatacctgggcagcagatarttttagtaaaaccttgaaaagatatgactattgggaagaaatttgggattctatcctttttctctccattcttctctcctgcaccaagtttctaagctcgtgattaaataaattctgaccctactctgataaaagtgaacccttgtggctggtcgcagtggctcatgcttgtaatcccagcactttgggacgccgaggcaggcagatcacctgaggtcaggagtttgagaccagcctggccaacatggtaaaaccccacctctactaaaaatacaaaattagtcaggcgtggtagtgtacacccataatcccaggtacacaggaggctgagacataagaatcgcttgaacccaggagacgggggttgcagggagctgagatcgtgccactgtactccagcctgggtgacaagagtgaaactccatcttaaaaaaaaaaaaagtgaacccttgtagtttcttcctctgtttgacagayggaccctaagacggccccagtgataccccacctcctggtgtccaaggcctgatgtgatcacccttcccccaccttgaatgtaggtgggacatgggacttacttctgaccaatagaatatgaaaaagataataggatgtaactgtttagattcggttacactatatggcaaagcaaagggattttggaaataccattaaggtcttacatgagacagattttgagttaatgagcagggggatcctcctgggtgggcctgacttagtaaggggaaaatcccttaaagaggagctaaaataagagagtctctctctccattgctggctttgaaaaagtaagctgccttgcagtaaggaactgcatttggcttctaggagctgagagtgccctaaggaagccagcaagaaaatgaggacattagtcctataaccacaaggaaatgagttctgctagcaacctaagggagcttgaaggtgattgaccatccccagtcaagcctctgatgagaccgcagccccactaggcaactagatttcagcatggtaagaccctggatggagaacccagctcagccatgcccagactcctatcctatggaagctttaagataataaatgtatgtggctttaagctgttaagcttttggtaatttgttagatggcaacagaaaatgtgtacaccctggatagtagacagagactgcatctttctttggcatttggctgcacagcaagttctaagttactcaccaggtttcagaggagagatgggaatttgatgatcttataagaaacctgtactctttggccagacacggtggctcatgcctgtcattccagcactttgggagaccaaggcgggcagatcacctgaggtcatgagttcgagaccagcctgggcaacatgctgaaaccccatctctactaaaaatacaaaaatcagccaggcatggtggcgcatgcttgtagtcccagcgacttgagaggctgagggatgagaatcacttgaacccgagaggcaggggttrcagtgagtgcggtggcagctgggacattaaccaagttgtgaaaggagccatgatgttattagctgagtyatgtcactgcacctccagcctgggcaacagagtcagactctgtctcaaaaaaaaaaaaaagtgtactttttgaggaaagttctatttttcattattttccactatgaatgaagaagaaaataatatacatacattactkggattcatacggacattatttagacacacttccacctacagagtcacatattgtatagaataaaatatcatcaggagcagctcatgtgaccagaatgtgrcaaagtctttgctctacaggtcaagttgggacttactgaggagaaatgaggggactkcaaagtccaggttgcaccatccactttatagatgaggaaagtaagaacccacagcatcttgcacgtagaattcaatatatgtcctgcttcttgaatcacattgacctaacaggtcatatgatttccatttgtttgcacaacaactcaagggcaaaagtgaaattggaatttttgcttttgaatttctgaaaccttgttttatttatttattttctaatcttttttttttttttttcgtggaatcatgttcccttcggaaaactccctgggtgccccagcattatgtggtaaaggacatgtatttccaactggcaggggctctgcaaagtttctctgcctcctttgctmaccaaaccctaaataattgtctggatgttccttttattgtcacctctgaaacaagacgaagatttggacggtttgctttagagtgcattaacttctttatcacattaatactgactcatatcttatttcccacttgcaataagaaaaccattcaaatcttkccctcacaggacaatatctttaatagcttctgtgtgtttcctatttttggctgtttctgtataaacagactaatctaatagcatactgaacccatctaacttggcagaaattcagaaaatcactcatttctatggcaagctgagatgctgagaagggggaaaaaaccctcacttttattgcagcaagatttttctcaaagttgcctttcatgaacataatatgtctatcatttggaattctccagcaccctggctggaaattatttattgcagaacgacacaatggtgaacgagaaggtattattccctgtacgatttctggcttgaatttgtttgcctaaaggagcagatatcgtatgaacatgattttgaatgctggcatggtgatgaaaggtgatgttcacctggagtctgtacacacaaaaccctgttcattttacctaaagggtaagaacatcatggcccccttcatatcctggttaatgtccccgctgaccctgagttctgcctccatcactggaacaagagcctgtctttgggaagaggtgtsttccctggcactcgtttgatttgtagccgccacacatggcaggtcccaagctgtctgaagtcttggctgccattcctaagctactaaaactttgctggagaacatcaccaatcacgctgagggatcctttgacaactcagcttcatgaggacagctgcagttctgcgtttaggctggggtcaccggggtcgctgccccagccccactctttagcctcagtccctctgtggttcccctgactgagctcctcactaaaggggaggaatccctggagcctccccatccaaggccagcgtgttccatttgagggtaactggatccctgaaattcacccccacacaatccacaacctactactagaatgccatatgcttttctatatgctgttgtttaatttcagttggtacatattttattttttgaaacagacttcgttagaacatctttagatttaaagaaaaatcaagactgtagtaccaagttcccatgtgtgtaacagccagtttatcctattattttaacgtcttatgttatttggtacatttattaagattaaattattgatactgaaatattaggttgtgcaaaagcaattgtggtttttgccattaaaagtaatagtaataataatactcggttggtgcaaaagtaaatgtgttttttgctattaaaagtaatgcggttttacttctgcagtttttttgccatttgccaattacttttgcagtttttgccagtacttaaaagtaatggcaaaaactgcaaaagtaattggcaaatggcaattgcggtttttgccgttacttaaaattgcattacttaaaagtttttaagtaatgcaattacttaaaacttaagtttttaagtaagtttaagtaaaatttgcattacttaaaagtaatcgcagtttttgccattacttaaaagtaatggcaccaacctaatattgttattactttttaccaacctaatattgttattaactaaagtccatcgtttatcatattgccttaggtttttaaaaaattttttacctaatgacttttttgtgttccaggagcccatccaggataccacttttatttattttttttttctttttgagatggagtctggctcttttgcccaggatggagtgcagtggcgcgatcttggctcactgcaacctccgcctcgcaggtttaagtgattctcctgcctcagcctcctgagcaggtgggaccacaggcatgcgccaccacgctcagctaatttttgcaggataccacattttatttaattgtcaggtctccttagcatcttcttggctgtgacagtttctcagaattgtctttgtgatgaccttgacagctttgaggagtgctggttgggtattctgtaggatgcycctgtgttgggatttttatgatgtttttctcatgagtttactggagttaatgaatttcagggaggaagaccccagaggtctgttttcatcacatcgtatcaagcattccaccttcatcatgactcttcactgttgatggtgactctgattcacctggtcaaggtagtgttcrttaggtttctccactgcacacttagtctttccctctactttccacactgctgcctttggaggagtgttgctgtgcccagctcaygcttgtggagtggggatttaatgttctcactcttcgagggtagagtatctgcataaactacttggaattctacatggaatatttgtgtcttctcccccatttatttatttaatcatttatttatatcacggtacactcatggacatttattttatgctttatgttataatcctatactactttrtttattttgttgcttaaatttttccagatggaacaatttggtcttcaaaagttgctgctgttggctcctgtgttcttgtgatgtacacacatcatggtgtggtgtgtttttatctttggttttgttttcacttcttttttgctttttgtgcctcctcttccctcttccccccacctcatacatacacaaagggcagcatgctactataatttctggaatctcagccatattcttcttttttttgttttaaataaaaatcatactagagcagtaggcagtgtgggtgagttctcccactttacattttactttgcataatttaggcccctttcaggccactyttccccctgtgccccaggtgtgtttgctaccatacctccccaggggatagccctccaaacytgattggccamctagtctggtcttaaagtcccaaagggaggccatcacaaactactcagtatggagaagacctgaatcctaattttggcttaaccccaaacttgggcgattcagttttacctgtgtcctctctataccatagtttatgacaaggggttttctgtggctggtctccaaggcctcttccaatcttgacattctrtgatcctgtaagtctttgaataatggcccaggatgccaacaagaagtcaccaatgagagttcaggtgttctgttggaaatctttgtaaaatcacagagaaaaggagaagaaaaagaataaagaggaaaaactggacacataaataggaagacaaagaatgaatgtggactggggagagaagagtcattgacagggacaagaaataaataactttgatgcaaatcctgggaagactctggaacaacatggaggcacctatgttaactctatttcattttggaaaagttgastagacaaaaggtgcagagtagagtatgcagtgatttcagggtgttgggctctgacaagatgatgccgacttagacagtgttagtcaacatcaaatgtctggatcaagagaggcaagaatcccgtggatttggcgttggccagaacttgtctggaatcttgttttctgccttsagtgtcacctgttgagagctctgttgacaaactggcatttgtccttgggagagtagcctcaggaccaggggtgaagagttcagtaaactgtgtttaacccaaggaaagatacagggtgtgtcagattttgtaaggattttcaaggagcagtagatagtggccctacagtggaatgaaccttcacaccgaggatctgcttcctttgttggaggtgggaaagcaaaagctggatgcttggaattgtcatggctgccgtctgagtgatgctaccttgagtggacggtttggccaactaaggagtaaggcctctccctcatgtcacattgagtggtgctaatgtttcctgaagtttccctttcttttcagttcagtgtttcagaatctcagccttccagcagaatcccctttgtttgctctaaatatacattcccaagccccgtgtggccattctgatttactaggtctggggttgggggattgtgggtgccgagaatcagtatttctatcaagctcccaaggggacctgatatatacatggagctgaaaagtacccacctaacagacttgccagctccttaaggataagaactatattttcttcctttttttgtatgcctccccatgcaaggataattacacagaataagcactgagatgcctgttgatggatttattccagcaattttwtttttttagctctctttgtctggaactttgcaaaataaacaccatggtcactccgtgctttgtgagtgacgtgctagaatggaatttcactgttttaaattcagggttaatttcttgctttcaaatgaattatgaaaggaagaggagagacctttggaaaagtctgaatgttgatgccgacgactagccaggcgcttcccttccagctggtttcgtgagggattaagaggccactgttgtgaatctcccattagtgatggtcccaggccccctcctcattgtgcatttatcttacaagaggcatatttaggagatgtttccgttctattttatctgcagaattactttccattctcaggtcttttatataagtattcccttgaacccgttccaaaaactggatttttaacccaatagaccataactgcagtgttttattgtgcttacatatttcaaaatgtgaatgtaagtagatttagcaaagttaaaataaaatgaaaacttttcaaagggcaccactgctcgcattcccatgttggagttttccctttggggttcttatgccattttaaagactctgaaaacaggaagactttttctcttgggtattttwwtttttttttcctctgcaagggatggggtcataagacattggtgaggttaggccttcctttgtctcccaggagcacacttgatagcaatgtagggtgaattccaaatctgtgagttagtgccatatatagcagtgttgtcagtaagatttctcactggcatctctgcttcccctcttgactctcttgaaatcccttcttcaggcagaagttggagtcatttctctaaaatagaaatctgatcttgccaccaccctacttgccactccctgcttaatcccttcactggctcaccatatcccttaggataaaataacaaaatcctttccagggcctgcaagacccctgccaacctctgcagcttactttgtaccactttccccagaaacctgctacctaccctgctccttgccacagggcctttgcacaggctcttgtctctggctagagtagtcttcccatcctgctttagctaatcaactctttctcatcatttaggcttcaaatggatcatcactttctctggggtgcaggggtctttcatataagtatttctttgaactcattccaaaaaagtggatttttagaaatagaaaaaactaatttagaaatagaaaattaattgagttttagtttttagaaaattatctaagaagtagatttttagaaatagaaaattaacgtagatcacagaaaattatccaaastcagttaattttcccttttccagcaactgtatttgtcctccccacttctcttccctgccttctttttttctccttagcacttacaatgtctcactcatgtagactcgaagcttcacaagggcagggattttagtctatttcattgaaaatctgtcaccagtcactggcccagagagagtcctcaaaaataattgttgaatgaatgaatgaatgaatgaatgatgatggcgtgatgattgtgtattcctcatctggctgtaagtttcacaaggccaggcactggggtcctattttgctcactgttgctgtgtgggaaagagttagtacagcagactgtcgcaagcttggctcttggctgcatctgggaacttggaatttaggagggctgtcaccattcccagatcagataaagatggctcactctgtctagactgcttgtaccaaaaatagggctcatgtggaatacctgctttcctttgtggaggctggaattttgttatatgctacagagagggtgcctacgtggccaacttccaataaaaactgtggacactgagtccctaatacatttctctggtagacaatacttcatatatattttcacagctcatttctgggggactaattaaatgcatcctgtgtgaccccactggaagaggacatttggaatcttgtacctggttttctccagacttcgcctcattcascatttccctgtgctcattttgccttgcatccttttgctgtgataaatctcagccatgagtgtgaccgtatgctgagtcttatgagtcttccttgcaaaccaccaaacctgggttggcgtttcagtgcctgacacagttgtattcctaagacatagttgggaccagacctcaagaaaatagccaacaaatactggstgaatgaacgaaagasgccataygcagtcagcccccctctctctgggttctacatatgtagatttaactaatgacagattaaaagcattcgaacaaacggagggtggtatctgtactgaaaatgtaccaactgcttttttttgtcattattccttaaacaatccaacataaccactatttatatcgtgtttatattgtattaggtattataagtaatctagagatgatttaaagtgtacaggagcrtcacatacattatatgcaaatactatacaattttatgttagggacttgagcatttgtggattttggtatttgggggggttccttgaaccagtcccctttggatactgagggacaactgtacaaatcacatttaggagtggatgcaggtcagtcgtgacatctcatccaccccttcctcacccaagattctccgtggcttgtgtcaaggcctcaccacatcagaatatttctgctcatggttgctgagacagagctggacaggtccagcatccattccccaaaacagaactcaaactgacgatcatcaagatattccagctatggcaaactgcggaagaattaggacagatgtatgacttatttcatataaagctaaatcagtttaatttatatgattgtcctttattctgagattatgttcaacagatattttcagtgttaaaatattcttttttttttttttttttgagacagggtctggctctgtcacccagggtctagcacagtggcacgattttggctcactgcagcttcctcctcccaggctcaagagatattcttgcctcagccctccaagtagggctacacgtgtgtgccaccgtgcctggctattttttgtagggacagggtttcaacatgttgccaaggctagtctctaactcctgggctcaagcaatctgctcacctgggtctcccaaagtgttgggattataggtgtgaaccaccatacccagccaaaatattcttttcaaagtgatwagaagtaggagaagcttgctctctttttattggcacttctgtcttacatgcactttttgattkaaattattctgkcttctatgaaatgacagtgattggaggtggtttatttttttttaagtctgcttactcggaaaaataaaacaaagttgacaacctgatttcagacctcccaattttttsttaaaaaaaataaaagtcttcttggtccatgaaatccagaaactggagaccaaactagcaaattcgcaaggagctgcttgatagaaaaacacttgagatcaagagtcagaaatagctgggttgaattccagttctctcatattaagtgacaagttgcagaatgcccctgtctttctgagctgtttttatatctgtacaatggggttaatactactagtatttgmttccagggattgttttggaggggagtgaggaataaatgatataattcactaaaacacgtagaatagtatttgacacagagtaggtcagcatgcccaaagtatcagagtcattattgagttattccgctacctccgtatttgagtcctttcttttgggctttcctacttaacgtcgcagatgttatttttttgaagagggtgtaggccaagaaaggggtgggagaaacgagcaaggtgttgatagaaccccttagtgtcctcctcataccacagacactctcttcccccacttacttggccawttttttttttttttttttttttttttggkggagtctcgttctgtctcccaggctggagtgcaatggtgcgatctcagctccctgcaacctctgcctcccatattcaagggattctcctgcctcagcctctcgaatagctgggattacaggtgtgcgccaccacgcccagctgattttgtatttttagtagagttgggatttctccatgttggtcagactggtctcgaactcctgacctcaggtgatccacccgcctcagcctcccacagtgctggggttgcagctgtgagccactgcgcccggcctacttggccaaattcttgcctgatcgcctctccacccctgctacgtgtaatagaaaggtagggccatgttggagagggatccaacatttattatccccattttacagatgaagaasttaaggtggccaggcatggtggctcatgcctgtaatcctagcacttygggacactgaggtgggtggatcacttgaggtcaggagtttgagagcaatctggccaacatggtgaaaccctgtctctactacaaataaaaaattagccgggtgtggtggcgtgtgcctgtaatcccagttactcsggaggctgaggcaggagaatcgcttgagcctgggaggcagaggttgcagtgagctgagatcgygccactgcgctccatgctaggtgacagagcaagattccatctcaaaacaaaacaaaacaaaaaaacaagaagttaaggattgcagagcataagtatcttctatggggctacccaactaggtcgggacagggcagggatttgaacctaggagctcttggattgcaatttttcattcacccctccctctccacccttcctgtcttcaagcctgagcaggtgatactgcattttgtaccgtatgactttwaaacagaaccacgagttcagaactttggttaggtcctgcccgtgttctctagctaacgcatggcaacgctggtttccaacctttcactgtgcgggtttctgatgagtacgctggcaggcctctggcttcagagatgccactacaaaggtctcctccttttcataaacattgctgcaaggcccgcttctcaagaaagcaacttgtgctacctcctgcgtgcttttatgcttcgctgtgaagtgcaaagttgggctggcaggcctggctttcttctccgacttatgtatgattcatcaagaggactccaggctgtggtgtgcggtgcaacccgggctgtgttcccgagtgcatcaaacggggattgggacctgktttccttcccactcacatgtaggtcacctacgggagcargggaggaaccatctgaggtgtttttttttttttttttagatttctcattgctgagaacagttccagctctgcygaccaaaggctgagtgtccytttattagtctgagcccctagagaraccaaagaggcaaccctcgagccaactgacagccagctgtggggttggaccctgtttttcatacagtgagcactcttgaacccagagaaggtgcaggttggagatgcagctatatgactctgtaccagagagagacctttttgtacatttggaataaaaatttttagcattagagattcgcttttttgtgtctaaatacaaatgtccaggagaataggaatgccatagtggtgagctaagagcaggcagttagttaagtgtatgacaagtatctcattataaatggatgctgaaatgtccaagtgtggaaatgataygcttcagctcttatttttaagtcatccttatctctttcacttattccctcattcaggcaccaaaaatgctgtttgactgggagagcaagtggagctgttcaaagttstagggacagccgggcgcagtggctcatgcctgtaatcccagcactttgggagggcgaggcgggcagatcacaaggtcaggagttcgagaccagcctggccaacatggtgaaaccccgtctctactaaaaatacaaaaattagctgggcatggtggcgggcgcctgtaatcccagctattcaggaagttgaggcaggagaatcatttgaacccaggaggcggaggttgcagtgagccaagattgcgccactgcactccagcctgggtgacagagcaagactctgtgttwaaaaaaaaaaaaaaaaaagttctaaatcagtggattctgccgataaacatcatctggacggaatgaagctgagggccaatagtttagaggctcagcacccgactggagagagagagagagagagagagagagwgwgwatgtgtgtgtgtgtgtgtgtgtgtgtgtgcgcgtgcatgtgtatacgctggtgtttaggtgggcttgagaaaagtgctgactttgtgaacgaggaggagggaaagggtccagagcagtaaagagcctgtaaataaattcataccagcttcagccccatgctttcgtttgggattcctcatccaaccctgacggcttccctgcgggacatatttccccctcttacagataggaaaccttgcccaatgtgattacgccaggaagtcagatttcaaatctaaatgtgcctaatgccaaaactgtacctcttgccactcaacatctgcagtcaaaggcttcctgactcaggatttgctggggtctggctctgggctattagaattagatgcgtgagaccctttcaatctaaaccttaagtattttgcctgttggacagatgcctggttgtccctttaatccatcgcccaaaaagcctgaggaaggatggcaggtggacttggatctaggccactcccttagatcctgattaggggacctctgcgactgctcatctgggaggaactaggggagcgctaatgtgttgtccttgactgggcaagaagggaaggagaattgtgaaacatgcacaattagaagtcgtgcacctgggttcatatcctggctgggccacttactttctggcgggtggggarggcagacaagttgctcatcctctctgcgcctcagtttcttcatctacaaaatgaagatgttggttatttctttattcaagggttgttgaraggatgaagtgctaaaaatgcttgaccagcattcacacaggcactaagacggtgagtactcactacttakcgctgtcaacatcatctccgtccacatcaatgtcgtcatcgtccttatgaaaagccckgggcatcattttgcccttgagctggatgtccatgttggaaaaacagctagtgraaggcgtgcccaaatctcagaagttggcgtttccttgcagatatcattggtggccattggaggggaaaaagatgctttggaaaccaggacacagagaaaagtgcctcgtattatacagagccaagagaggtcactgtggaagtacagaggaagccttggcctaattgcacggttaatacaattccgtaactcatcctgccaacacgaaggtagatggacggtccttatgctcgctgcggaacactgcctgtgttttcctaggagagacatctgcactctagtagtgattaaaatgcctttgacaggctcttgctattaagagtttctggctccagtttaataaaaggtagtatattataatggaaaccaggttattattgataaggactagacatattagagaccaggttaaagctttgatagtcccaaatgcaaggggagggagctaagggttattgcaaacctactgtgtgtcaattgctctaccagacacctcagagacatcacagccaaagacccccacctttgaataaaccaagtttggcctctctgatatattaatatatttaatcatcagactttcagtgttaaaggagattacagtagaggcatccagttgattggggaatagttgttgcaaatgataagctcttttgaataaactgatactgacttaatgaggttctgctgtgtactatcttttttttcctaatagaaaatagagtagctgccctccccatccgccattctcagtccttttgcttactagtaatgaccctcttttctctcactccatgggaacttttaaaactgataattaatggatttttagcctcaagtttctggaattctaagagggcctgaaaggtaagtgctcacttactgaggtgtgtgaacaaaaacaggcaacctagctcagcaagtaagaatggagtggcatctccccacctgctctggagtcatgtgtttgcttctggaagggaggcaagaggcattcaacctcctgttaatttggttgctccttcagatacgctcttcatggtacagccctgasctgcatcatttaaagaccaattgttaaggaccaatctgagggcctgtgcattagttaaaactccttatctggtcatagagggtggtgtggtttggacgcgttccccttgtctgtgcaattcccaacagaggcaagtgcgcatttgagacaggttgagggttcaagctgtccaatccctgctcatctgcagcacaccaaggaatgtggactaatgaaaaataaactgcatgcatgcartgcccatcacactgcctgcattttctaatcttcacaataactctgtgttgagaaatattcctgtctgtaatcccggcactttgggaggctgaagcgggcagatcacctgaggtcaggagtttgagaccagcctggscaacatggtgaactccccccaaccaacgacccttcccatatctactaaaaatacaaaaattagctgggcatggtggtggggacctataatcccagctacttggaggctgatgcagcagagtctgttgaacccaggaggcagaggttgcagtgagccaagacagtgccactgtgttccagcctgggcaacaagagtgaaactctgtctcaaaaaaaaaaaaaaattgtttctggccccacgttacagatgaggcttttaaagatacccagccaatggtccacagtgatgtaactcatcagtggtccacctgacattggaaattcggttgctttggaaccttctactacatcccctttccttactcactgacatcattcccagatcaaagaaagataaaagaaggaagggctggagacgttgttttcctgtatgctccttgatgaagggctcagagctaagcgcggagtaggtgcttaagcccttccatttgaaaggagctttaaacacctttggtggcagctaagagtgtcaaaatggagggatgtgtaggggacctagggcctgggtaacattgtcccagsccagggcctattgtgttgtgtgtgtctccactttccagcctttgggaacgcagagggggacctctgtaattggtaccagcatcccttccttgcagggtccgtccttcctctgagttgggggaaggggtctccatggtttcttctaccaggtagacccagaatcactttcaacttgctcacctgtctgtgcagtgtttgagttcttccctgggaagcttgctcacatcatccacttctctctgggttctccgtaccgctttccccaatccaagctaagctcttctcttagttattctaataactgcccaatatcaggcactaccctcaacactgtttcccatggcaattattttacatgacagtttaaaaaacaggaatgctcgatttgtattcccattttgcagacaagccaacgaaggcttggaggggttgaatggcccaagtttcctaagtggccaggggcagagtcaggatctgaacccaagacataggcccaggagtctgtgtttgttctttaaacctctctattcagttgcccagctcttttcattccctgtcctttccccctctggctgggtctgcctttccaaccgctaccaccttccaccaccattttttttttgttkcctctgcaagcaacatctgaaaggcccagacccagcttgttggccttgggctctgataagatctgtctgcactccttttgtctggcctgtacctgccttttctgaatgaccctgttaattgcaattgactctcatagaatgtggatagcagtgccasttgacaccagactaatgcttctgacttttccatggtgccccagcagcaggctggagggaagggcgggggcggtcagaggagagatagagcacttcagattccamtcgaatacattagagcattagagcttttctcttcctcagggtgctctctctctctgggttgggaggagatgtggcatttctaggaattcacagtaaaatcagaaataattaggagatttcacagttgtagctcctgtgaagattcaggaattttttttttcttctatttgcaagctttagtcctaggcatggaaaaagaactttgaagaaaacctgagagatatsagtgtaaaacaagagaatgattccctctggggtgctggtagtgggggcttaatttcctaaaggcttactgggtatcagggctgctttcctttataatcttttacccgtcttatgggggatgaacagaaacacactttagtgctagaaaagctgggccyaaaagaccagtctcctgtcccatacttggacatttattgttctttttgggcaaggtgaaaacttgaaaccaaaagtctgttgagtttggaagacttgactcccaggatgtacaaagtacttctgcatgtgcgcaaagtcctgtaggcccaggcatcaatgacacatgcagtgtgggcccaggcatcgatgacacacgcagggaagcaacccaagctgggtcagtccttacaaggagaccggcacctgggctcacaccttgccgtatatgacttcatgggaacctcataacagacctgtgggctcagaattattctctcactttgcagatgaggaaatggaagtgcacagaaggaaagtaagagtgtttgagatcctgtagtgggttcattgctgagaataaacccggagttgcctctgggaggacctggtggtgggtgggatggagagagaggcctcccctcagactccaggggcacagattggattttttttttttccagacagagtttcactcttgttgcacaggctggggtgcaatggtatgatcttggctcactgcaacctctgcctcccaggttcgagtgattttcctgcctcagcctctggagtagctgggattacaggtgcccgccaccacgcccagctaattttttgtcttttttagtagagacagggtttcaccatgttggccaggctggtcttgaactcctgacctcaggtgatccacctgccccagcctcccacagtgttgggatcacaggtgtgagccaccatgctaggcccagattggcttctgtgtgaggatgaagagtaataggaagatagagtggtgatctaatgtcaactgtggagggagtgggaggcaggtgttcgcagggcacagctggtttcctttttgaatcccacccagtgctgggggcaagtttcataagcctgtgaccacccagataggaaagtacacagcaacaccaggcagattcattttctttaaatgaggggttcaaaatagaaacacaaagcattgagtattgagaagaaatggatcttcaggtttggagggaggccgatagagagtgtctggagttgccaacgtcctctccttgggtcatgggtgtgtgtgtgtgtgttttcttcttgktgktgggtttttttttttttttttttttttttttggcttttgcgcctatggtgacttttagcgaatggatactattgaaggaatgtttcacttccaaatccagatctctgacttcccttgaaaatttggagtgccactcaagtcggccgctctgagctagaatcctggtgttcaraattggcaggaagggcacaggggcaaggtataggctcacgtctccacattctgcacctcccaggctcctgccattgatgtgagcgggttcctgtactgyatgaagcaggggtttgcatccgaaacaaccacccgtgctgaatatgtaggtgatacgttgatctgtacagcaaaccaccatggcacacatttacctatgtaacaaacctacacatcctgcacattgtaccctggaacttaaaagttggtgaaaraaagaaggggccgggcatggtggctcacgcctgtaatcctaacattttgggaggtcgaggcaggcarattgcytgagctcaggagttgaataccagcctgggcaacacggtgaaaccccgactctactaaaatacaaaaaattagccgggcgtggcagtgtgtgcctgtaatcccagctattcgggagggtgaggcaggggaattgcttgaacctgggaagcagaggttgcagtgagccgagatcatgccactgcactccagtctgggtgacagcgcgagattctgtcttcaaaaaaaaaaaaaaagaagaagaaaagaaaggaaggacagatggaaggaaggaaaagggaagggaaaggaaaggaaccagctgcaaaaattgtcctaactgagcattactgtaacatagaacagctgaaacactcctcaaagctgagaggagggtttgggagagaagcaggctgtggttgtgaacaggtgcctcctccaaaaaaattctcttccttggatttcaaaatgacccccgttgacaacaaagcctttcacgctgtgtttattttttttcaggtctaagtttcccccaggagattttttttttctaaaggaaaaggcagagaagcccccagaccggagccacaatcaaatgcaaatatgacaataggacccatcctggagagaaaaagccttctttttaattagaagcctggaaggacataccctttaattgctgcacttgtagtgtcagggttatcaatatccgtggctctttcattaataaactggcgagtcagaaagcagcaggagtgggaacctctccccacccaatcccctctcacgccccaagctctatttaatcaactgcagactcaatcaaatggggaaaagaacatgtaaatcagctcattcattctgctggccctaaataggtagaaggaagggaaacatgaaagggagccttcatctgttttcctgcagatgcccggctygtggttaacccaagcaagaggtagttaaacggccccgcagattgccagtgactccgggaatgcctargtttatgtatggattaacacagtgatagaccctgagtagcaaaagacgaagactaattacctgacagarctcccctccactcgcctgggtcattgaaattaatttctgctttcaagcttggcagaaagcagctgcagaatttcagttcaatacttaaattaacggggagccgaaattatttctgtgcacaggcagtattagaggagtggcttaccaaatagatcttgatcgcagacacggaaaaaaggattattcctccccttttatcaagagccgtaagtccttggaaaatgcaaagagggggaaaaagaagaaaaacagcaacgarkttattggagagttaamacttaaakactccagtacattgagtgtgacatgcctgtgtaggagactgtctgtcccccaaataattgacaatttctctccatctaacaagaaaatatatggcacttttatatatacttgaattggaatccctaatccagagataatttgtgaatatccattctatagcatcccatgttgtcaagaaggtgttgacttactgcaaggttaaggaaatgggtggagaatgtagggaggaggtggaggataaaggataggactaggaatcagagttgggatttgaacccagggcttctgtctccagattccttgttctgtccctttatgctgactttccttttttgctcaaagtctctctccttgcttctttctctttgggctccctgcttttatttcggccctgatggaatctgtcgactttactgagctccatgtatgtgcaccaggtcagattcaatgctgcctaggtccacagtcctcagttatttgttcctgtgattttcgcgccaccaggagccacttgttggatgagatttccgggcaagttgagtctccatgtttttgtcgtgggctactgccagctgagatatggatgaagactccctttcatgtttcccttctttggtgtccatggcagttcccacctcgaccgctatggtatttcttttgcttctgctgaggctgtgtgtgggtgcacatcaggatacctcagtggggaactcagggcgtgaggcacactcatgacagatgcaggaaaaacatctcttttctaactgtccagctctttaggattaggcaatactttaataatcaaccaaattctggaatcctactgccaaattatggcactcatcctacttggtgtaaaatcctgggatgatagcttataatagtaataataagacctgcttcccggtgattmtctaaggattaaatcagttcatggagatgaaatacttaaactgtgcctggcacaaagtaaatgttagtgctactattatccctgctgctgttaaccccaactagataagccaagataaggtgctctccattgtttacctgaacaggcagaaaagctctatgcagctatccagacccaagaggatccgacagctctggaacttgtaatatttgcagcatgtcttgccctcttaatgtctaagaagtcaaaaaaggacacgtatgcctagaaaacrtgaataattatcatctatcaaatttttaccatgtgccaagcatagtcatatttggctaacgaaaacaacaaaatcaaccgtgacaaggttttattagtaatgaaactgaggcttctggaggatctgtaactgttgcaaatttccagtggctagttcagggacagtgccggggcttgaacccctgtctctgtgtctcccagctcataaggtgtgctaccaagtcacccatgwgtagcaattaggcgacttctaacatgtccagctttaaacctgtgacctcaaggcaaatgacttccacatctcattagcactccccagagccttccagccccctgtaggagagggaggttaatcagccacgcgctgaatctgcttataaggctgtttcatgtatgatttttatatcttggctcctaataatggccccgttgtaaatgattgtctcactatgatatacgggttccttaccttctaggaactgatttaaaaggaagccctagacttcttgtgcctgtagagtttattcatatcactctttgcttgctcagcagttgaaatgggatggaggaaagccccctaactccaaaaaaaaaaaaaaaactttcttcccagcctgagacagttgccataattagtaacctgcagctcccttgatatcttgatgatactttattaaaacaaacaaacaacaaaaaacacagctgggtgcggtggctcacgcctgtaatcccagcgctttgggaggccaagatgggcagatcacgtgaggtcaggagtttgagaccagcctgaccaacatggagaaaacctgtgtcttctaaaagtacaaaattagccagacatggtggtgcatgcctgtaatcccagctactcagaaggctgaggcgggagaatcatttgaacctgggaggtggaggttgtggtragctgagatcacgccattgcactccagcctgggcaacgagcgaaactctgtctcaaaaatgaatgaatgaatgaatgaatgaatgaaatactacttctccctgtcctccccaccctaagcatctgatcagacaggtagtgctggtggacagatggacagacacctaccccatatgtcacctccctcctctatgcaaacaaaaattttaattatttctagaatgacttaggagagcaagtcatgtgggatatatagcgtcagggagcgtattttcaaaccaaaaacctgggcccttattttttttttctttttgagacagagttttgctcttattgctcaggctgctgtacagtggggcaaactcagctcactgcaacctccgcctaccaggttcaaatgattttcctgcctcagcctcccaagtacctgggattacaggagcctgccaccacgcctggctaattttttgtacttttagtagagatgrggttgcaccatgtttaccaggctggtctggaactcctgaactcaagtgatctgcccgcctttgcctcccaaagtgctgggattacaggcgtgagccactgtgcccagccaaacctcggcacttttatccaacaaatatttatttcgtgactattatgagtcaggcttaagaatacaytagtaggtacagcaggagagcatgtagaagaggatagatgtagaaaatcgggacggcatgttaggaatatagataggaattactaaggaaaattgtatttttgtggaattctttgaactcgttactattagtaaacggtgagttttggttctactcttcaatgagtttaagatgaaggaaatcattaaatagtgctttcttttcttcaaaagttgggttgcattgcatagttaaagttctttaaattcttctctaaaccccaaggctaagcaatatacaatctagttacaatggtctgcttgctgttaccagaatctrtcaagctctttcctatctaagggttttttccatgtactggtttctctcctgcgtggtcttgttctacccttgaggagggtaccacttcctcattgcttagttgtcagtataaatgctcctttctcagagaggcccatcctgaccatctgtgtttttttcctatcaatgctttaacaaatgaccacccatgggtggcttacataccatgaatgtcttctcttaccattctggaggtcaaaagtccaaaatgggtctgtcttagtccttttgtgttgctataaaggaatgcctgagctgggtcatttacaaaggaaggaaatttatttgtctcatgtttctgcaggatgtccaagaagcatggtgccaatgtatttctgatgagggcgtcaggcagcttctactcatggtggaaagtgaaggggagccagcatgttcagagaacatayagggagaaagggagcaagagaggggaggggaggtgccagagmctttaaaagaaccaactctctgggaacaaatagagggagaacattaatctagccatgagggatccacccccgtaacctagactcctgtcatcagccacggcctccaacattggagatcaaatttcaacatgagatttggaagcaacagacatccaaactatagcagggtctccttgggccaaaatcaaggtgttggcagggctgggctctgggggcttctggggagaatttgttctgactttttcgatttctggaggccacctgtgttccttggctggtggccacatcttccatccttaaaaccagcagtgcagcgtcttcaattctgtccctggctctgctccttctctccccctcctctccccctttgtcatctttttaggtttatttgtgaccttttagatcctttgtgactgcattggtcttccttgggtaactgcgcatactctcctcatgtcaagaacttacatccctctacaaagtcccatctgccatgccaaataacacctttgcaggtttcagggtagagcatggatgccttttgattttgatttggttgtttttggtagagatgatatcttgctctrttgccaggctgatctcggactcctgggctccatcaatcctcttgcttcccaaagtrctgggattataggtgtgagccagtacacttggccttttggcaccattattctgcctgccatcctgtcctaactaaagaaagtaaggtccctccatcctccatcttagcccttctttccttagcctcctaacactcaacgcaatttatatattttaattttttttttgagacaaagtttcactctgtcacccaggctggggtgcagtggcgtgatcttagctcactgcatcccctgtctcccggattcaagcaattctctggcctcagcctctctggtagctggaattacacgtatgtaccactactcccggctaatttttgtctttttagtagagactaggtttcaccatgttggccaagctgatctcaaactcctgacctcaggtgatccgccctactgggcctcccgtagtgataggattacaggccattgtgcctggcgtatatattttaaattttatttttcagtttacttggttttgcctccttctagaactagaacataagctctctgaagtcagggaccatgcctagaatcgccttccttttatytcccatcagccgaaactaactctgctrtgtcrcgctgtgttaggctgtgttggctgtgagtaagagaagtctcacccaactagctgaagcgaggtgggttggaggggggatgccttgtggaagtgacaactctaggcacgtaactggctcagactctgctgggcccagatatacagatgtcatcaagagtctttctcttccttttgagcccagctctccctttgtgacccagcaacttccttccccgatgatggccaagccttgaggatgtgaaactgcccartgccccaatctggartccaccatcctgggtctagctggggacatccttgaatcagcctctgggaatcactgaaccaacatgagtcacttgctactgtgagatctcaraacacatggatcaggacagagggcagggctgtttccccaaggaaatccaaatgctttacaggaaggggagtggatgctggcccggcccaggcgaggatgaggagtaactgagctgcagaccattgtttagccctccttccacctgggagactggctgctggttctcattgcttctgtgggtctccaggtttctatcattacacagattagcacayggttccatgatcatggacccgttcagtacacaatgaaatcatttgcaaagcaccttggggtctgttagagaagggaatggatgtctgaggtatgctaagcctaatctccatcttctcaaagctccactgccactgtcccgtaagggtgggcagattcctccccattctataaaataayagctaccatttcctgagggcatactgagtgctgacaggcacatcaacatcagaccatcaccttcttatacctcaraatagtctgcagggtgactcagaagctcctggctggtaagtggcagatccagagatgaaacccagatctaactggacccaagacagaaatttctagaacagaagccacaaacgtgttagctaagtctggttatgtcaagtggaatatttctggctttgggggatcccagctctttttttctctctcactctgagtatttagaggcttttattgctatttttctaaaaggcaacattagtaatcaactttgccaaaaatttcatatgaayggtgggcttttctttctcatttgctttcgcttagtattttccattattcatttggcttcttgaaccctccctatctgtaccccacacttactcttattcacycagaacaggtgtgtgccaccttggagaagatgaagccagagagaaaatcagtcagacaggaattatgttgaaaggtgamtgaatacattaccacctcccaggagttgaatgaaaaacggctatttctttaggacgtcaaaccacctttttcctctctaattcatgcatatccctatacaaagacccaaggtggtgaggggctggtttttagatagtctggaggccctctgagaatgcgaggcccttgttgtaaggaaacgctggtgggtgctcactccttcatcaggagccagccggctcccctgcacttactgctttggggaagagtttttgtcaagatcatttttgcagatggttgtaaggtaaacagtcactggtccctaggatatcttgctaatgagacaccaaagatacacatggacaatggccagaccatattttgtcacagaatgccgacccacaagctctggagcagtcaactcagaatggtcaggacttggtcagtaatgcccatttttgctaaattttgtccccacttccaacgcaggaycaaccagagaaagccacatatgctccccaaaccaatcatacaggatgtcctggtctagggagcccacctccggcttccccatgtccacagcctccaatcggagcatactggaagtcatccactttcttttttgtttaaccataaagctttctttctctccacctcctttgagcctctgccaaacacaactgatggtggctgactgcctggctgcaggaagttctgaataagtgacctctatttgttattatttgggtyccctttgtttatttttacactagctttgcactaggttaattttttcccacatggcttttcctgtttgtttctttgattgtttttaattaataattagtttgcttatttatttgtttattttttgagagggagtctcgctctgtcacccaggctggagtgcagcagtgtgatcttggctcactgcaaactccacctcccaggttcaagggattctcctgcctcagtctcccaagtagctgagattacaggcscccaccaccaagcccagctaatttttttggttttttttgtattttagtagagacgggatttcaccatgttggccaggctggtctcaaactctggacctcaaatgatccaaccgcctcggacttccaaagtgctgggattacaggcgtgagccaccgtgactgacctgtttttaatttttttagagacagagtttcacactgtttaccagattggagtgcagtggtgcaatcctagcttactgcagcctgtaggtcccgggctcaagcgatcttcccacctctgccacttgaatagstgggactacaggtgggtaccaccatacccagctgttgaaaaaaaaatggtggggtattactctgttgcccaggctggtgttgaactcctggcctcaagcratcctcctgcctcggcctcccaaagtgctgggattacaggcttgagctactkccccaggctcttcccccgtttgttaatacataccatgaccttggcctttcccacctcttaggttttgcttactttcccttctgtcctttacttatgactctgcccccttttgacctctgctaaaattatttgttactgttgttatgttattatttcatgtgttaagtctacagtgtataacttgggtttacttatctcatttaacccttaggaaaaccttacacttaaatactcaaagccttgattttgcaggtctgattgatgggcatacagaggaattaaatgaccttgtcttccacatatggtataaggcacagtagtggaagcaggatccaaatctgtgtctgtgtttggatcaacagccctggccaccatcttgattcatttctcttatctgtaattctatggagggaggttccattgtatatttttttctttcaattacagtattatttgtatattggaagcctattgtactttatctgtgtaactgtcgtagcagctagaggctagtaggactggctgaaatgtcagaggaaggagggaagaaaagggagaaaagcaggacaaatgaacgcagattaaggaaaataaaaaagagtgtttggctaacttgcataaaaaggatctcatttttctttgtaacacattactacatacagtgaccatagtgtttctctaatttcttcaggacktactttgaagatgaagaagtatgtgtatccgctttttgtctttcagaataacatactgctgtctgtaaaaatacagataatttctctcttaaattccataagctggagacactgcccctgtttcaaatgaatacagattcattttgtcacctgtgtgaaattggtgtccrtgtgccttgcttcctaggctgtccaccatgacatcagcctgcccrtgcaatgcttgagatttgccctgtgactcaacccaaatctaaagcccgagtcgtatgaatccaggacacctgcctgcaaatgcatttttcatgtataggttattcactctggtctttgagattatgtaattagcatatgttgtcatagtgatgtatttattataatggaggtgttctcaggaaaccagatttaatacttttaaatcagaggccaacatggacttttaggaattccattcacagtaaattttatgcgtggtgaaaggttatggaatgggtttccatgccatgtctccccctgtcccacaaatctcagctggcctgcaaaggttccactgtggatttttgccagccagccacgctgatgtagacagaatatttcggatttatattattgcttacttggcacatcttccattggaaatggaatagagaaaaggtggcttggctgtttggtttatgtcctaaaaccttatcgkaatgtgattctccttaacagagggattcgtaagcttargamtgataragawttggcttttctgctgttggattgatagctccttgactgctgaagccattgcccatctgttcaactgktgkattcacgaggaggttagacccctgacccaaggcccaggtacctggctttcctcagttgggatcagaaggccacaaagttttcttatattttaagcatcaaagtagcaccactgtacagcatctttacttaatctgccctctttcacgtgtgtgcatccctggcatgcttaaacaagaaaggcaaatgagagagagcgagtgagtgygagcgagagagccctgaggtgccagaaggctgtggttcctttgtgtctacagaaaagatataacgattgaattagactcttaaatatctgtggatgtcaggttgaatacaagcagctattcagtgttttactctggcaggagaacaagtcccctggaggtcagaagccatgcaggtccctggaagtgtgagcagattgttaaaatggtatcaaagatgggctggcatgaggccagagtctatccttgatgctcacctgaggtctagggctaaactcttgcctttacctgttccatgcttagccgttcctgctttttgcctagaacctcagtgctattgctcacacagacccagytcatgtccccaggccatgaccactgcctccccttctcccacctgtgcaggtgttaagcatcagtacataactgaggagtaggagggcagcagcccaaatctttgatgaagaacctctttcgtatcaacttatgctttggaacgagacactgttggatgggaatctggcttctaacaaactgattggttggactcatgccttattctttcggagccttagttttgtcatgtgtagaatggggagtattgctagctattcccatagggagtgagagagagtgtaagtaaaatgcaatggcaggcacagggatggttgccattatcagttacattattatgaggattattttctacctagatcaggtataaggtggatgtattattggcattcctaggactgttttaaaggaagtacctatgaggcctcatgataagccagatgtccagaagccagcttgagaccagggctcctggtcacttaaaagatgtttggggctgggcgtggtggctcacacctgtaatcccagcactttgggaggctgaggtgggcagatcacgaggtcaagagatcgagaccatcctggccaatatggtgaaacctgtcactactaaaaatccaaaaattagctgggcgtggtggtgagcacctgtaatcccagctactcgggagcctgaggcaggagaatcacttgaacccgggaggtggaggttgcagcgagtcaaggtcacgccagtgtactccagcctsggtgacagagcgagactccgtctcaaaaaaaaaaaraaararaaaaagaaaaagaaaaaggtgtttggaagccatgtcccatgaattccaaatacaattgaggactctataaaggactataaaaaaagttgtaataaattatgcagacccctcagcagttgactcacctctctggtgctccaggtatttctcagcgtgttcggggtctccctgtgttacctggacagctcctgccatcattagcacacagccaagattcctcgaccacccatgactctggatttatcatcctcaagaattgggggctgtggaaaagatgccaaatttgttcttttcagatttaggttcttctgtgataaaaatagacttggtaaagaagcagatatttctttaatacgtgtatatattagactgtgaatttattcatcttccttattcatcayataagtaaattatatgattggayccaggcataaaacgtgatttgactcccccttgcccatcacagttctggagttcacatatcatttgttactttgaaaaatgaacttttgttatttgattatggtgataaataatatacatggtagaaggagaagaaaatgaagaaaaatttagaaacttggacagaggaaaatgaaaatgttctattaattccactagcatgagataatcactcttaatattttgktgcatgttcttttctttcttctgarkgatagcatttttttcaacaaattgggctcgtaatatataggcacatagatatataattaaaaaaacaagaatttctcatgtcattaaacattgcttgaaaaaacatactagtaatttcctaagattayaccatgtaaatgaattgtattttatgtaaccattccctagtgttggatagctaggccatttataatttggacactattttaaaaaataactcrggcttatttwactatttatttttgccttacactttttgtamaagtaatcagagcagtaataatagatgactccccaaaatccttttgcctctaatgattagtctaagcccataatgctgtgttccttgccagtgattggtttagaaataggtatgtgacccagttctgaccaatggatatggagggtgcttatgaggaaggtttcctactcctaaaagagatacacaggaagagagamcttctgcttcctctggacactggcgcagcctggactagcagttgscagcttgggtttggacaacctccgaccttagttgaaaatgaccctgtgtaggacagaggagcaagtggaaagaacctgggtgcattgtggcattttagagccactgattcagctgtcctatgggcctcctaacccgaacctccactggtcatgaaataagctgttagtttggtgcaaaaggaattgcagtttttgccattgaaagtgatggccaaaaccacagtaacttttagcaccaacttaatattttgagttgggtttgaatcacgttgtctattacatgcagcaggacacatctctaatcacgcgagaggtctgagcaaacgtcttcacatttcacactgcagatattcttacaaaaggcaaagcagagatccagagaaattaagatctgctcaaggtcgtatccagctttgggaaccccaactattgcagaaatttctgaagtcgtcatattgctacttaaagcaaaatgccttctcctaaatccaggtagagagaaactctcaaaggccagggtctggactcaagatgagcacaggatttagaatcagaaagtgtgagttcaaattgccttcggctcttcacctgggtgggcgatttgaatagagctcacagccctgaaaaccctggttttcagaytctttattggtaaatgaagtcagcttagtgatatgagaattatgaaacataaatccctttgtaaaaatataaaataatcttacaatcatcatcgtcatcctcatcatcgtgttccttcacaccagcggtatttatggtatttatcaactaactgctgtgtactatgctctattgaaaatgttagcaatatagtaatgaacaaaacagatgttatctctacccttatggtttttatattttaataaaagtggcagaaaagaaataggtaaaacaataaactgagctctttggagaagaggcccacgttcttttcagattctgatttctccgtgatataaatagttttttaggtgatcacttgtttttaatgtacctacctatctawacctttctctctctctctctctctctgtgtgtatgtgtgtgtgtgtataaaattacatatccagtatgaaacctaaaaataagattttggggcctgtgaatttttttaacctttcttaacctacatcctaattatttgatttgacattgtgatgaaacatactgttgttttgaattttggaaatagaccagtgattcttcagtagggtcgtaaggtcccgtcaatgcagcagtcaaattttttcttggtgggggggatgcatatgtgtatgtgtgtgcatgagtatcttgataatttagaaagattaattaaacattgatcatctatgtgaccacatttaaaatgagcaccaccacatccaaatgtctgagtttacattttgtgtcggtacttgctttggcagaactctgtgcctttccccaagtcttctgtgaccttctcacctggcctgcatcctggtccttatcaaccgtattttacagttaaggaaactcggctcaaactagcttcggggactcgctgtggccataggtgccctaggctgcagtctgagagtgaaactgaggtctcactcccttcatastctgctctccgtctctgcctcatctggcttctcagggtggtggggcgtgggcactaatttgatttgatcacttagagacaacagcttacaaaatgctaccgagcagtgcctgtcctttctgagaacttgatataataacgttggcttgatctcctcagcctgtgtcttgagggaacaagtaaattaaacaagtaattagatccataatgtttttagaagttagaagatttaaatatatgaatctcatctgagtgtgcagccttttgtctgctgtgtttcctgccaaaagatctcttgacaggaaataaacattaaaataatctttaatcccttgtttggtctattaccattaacaattgatgcactttaattttgtggggttttaactacaaaatggaacggctaagtagtgataattgggtttggaattatacggtcatttatatcaacagagatgcaaggggctgggagggagggtgattaattatttactatttcctggctgtggttcctattatagaattttctgatatgttcttctgtgaacaattatcaccaaatgaaagtaaacaaatctgtgatttgaagccttatttagaagttagtctatatttaggtgatgtgggcttgattttcacagaccctgtgggctgtctgtgtgtgttccttttctcagtaccccagctctgtattcgagcgtggttatctttgtgcatcttaaaatccacaatgcacagcctggggagaagccttggttttgccagggggaaaaaaagaaaaacacaacattgagtgaggtctagggtgaatgccaaaggtctgttttgaaatgggggtgtgggttattcttctctctttctgatttgcttcagtacagtatgggatggggaagaatcaaaattattatgtcaacatgaggatgaaagttatgctctgttgtttctcataacatttgtgtgtgtgtgggtgggtgggtgtgtgtgaaaggtaggatcacctctctgtgcctcagtctccccatcatccttcggtggtagawcaatgctatctgatgaggccttttttgggatcacccactccaacatgcatgtcctttctctgtcccctcctggtgcctgtattagtctgttctcacattgatgtaaaggactacctgaggctggctaatgtataaagaaaagaggtttaattggctcatggttccgcaggccatacaggaagcccagttagggaggcstaaggaaacttaaaatcatggcagaagatgaaagggaarcaggcatgttctgcatggctggagtaggaggcaaggagcgaaggaggaggtactacccacttttaaacaaccagatctggtgagaactcactcactgtcatgagaacagcaagggggaaatcagccctctgatccaaccacctcccaccgggcccctcctccaacattggggattgcagtttgatgtgaaattttggctgggacacaaatcccaaccatatcggcacccactgagcacatcctcgtggatcttcctggctctccttacaaggggttccttccaaacccaagcgccacaatccttaggcagattgctctgacacagaagactggtgagttctagacttgatgtgtttcatgggaaacaggaagacatttaggggaggctgtagatacacagccgctctgtttagggaaggctgtcgatacaccgctgctctgaccatcatggcgtctggtccatgctcagattctggagtgttagggtcttcgggcacatggtggatgagcgttttgcttcgtgtactcatttatttctgaaaataatgcagccccttgtagggctttctggctaattgagtggtgccatcattcatgcarttgcrcaattcacacaccaggctgccactttggcccctgcgtcaccttcaccaccacccaatgtgtcctgctcatcactgaggtttgtcatttttactytgagwctgtccattgtcatcatctccaccatcaccccttttgttytcattgccacccttgcctggggtgagtgaagacgctcttctctggcttccacccttccaaatgcccttaacccacagatgggaagaaaatgaggtggggggaaggggactttcttgcttcctcatagttctcccccatcctgtaaaggagcctrtgcttcccgactcccagggccctgcagcatgtcaagaacaatattggacaagcttgtcagtgagggtccaggtggttccctgccactacgatgcatgctggggtcagtaaaaggagaacacagaagaatcagcagacccagagtctaacccctcctctagttaaagacgtgaccctggccgggactgaagccagaggcccacagcctactggacctttgtttcttgcagtcaggttctgatgacagattttagtcccctcttgaatttccttggatgtgatggaagtgattctcagtggacaagaggtcacattgccttttctagcttggaaggtggcgcaaataactgcttgaggctccctctcttgggccaagcttgactctggattttcattgktgtccttttttattaaaacaggttttgkttttttgtgtgtgtgttattttgttttttgtttttttgtttttcgggggctggagtagtgtgcaragcctggcggtgattgttctcattaraaagtatagtgtaatactcaataaattacttttgttctcaccttgggaagtggactmagaggccaagtgactttgatttttcactttatcctggagtttctcaaccttggcactattgacattttargccaggagattcttkgttgggggggatttcctgtgagttacaagacattaagcaacatcactggcctctacccactagatgccagtagcatcttctatttcctcaagtctcaaaataccaaaaacatttgtagatactgccagatacccctggggaacaaaatcacccctggatgagaacccctgctttatcctcttacagttttggttctttccatgagaaagtatttttaatagcaaagtaatgaacaagaaagtattaataagacccaaataataatataaactactmctttactaatggtcattatgtgccatgccctgctctaaacacttgccatgtagtcactaatttaatcctcacaagaattctgtaatgtagtgtagtttcccagggcttccttgaaaacgtgccatagactagatagcttgaaacaacagagatttattctctcacagttttggaggccagacacctgacatcgaggtgttggcagagttggttcctcccggggctctcagtgaaagcctgctccgtgcctctcctccagcctctggtggctgccattaatccttgacattcgtcggcttgtggcagcagaaccccagtctccgcctccgccttcacatggccatcttcactctctgtctttgctcccttttcctatagggactcaagtcattggatttagggctcactggaatccaggatgacctcattttaccttaacaagttgcatctgtgaagattccatttctaaataagatcacatgctagggctgggcacggtggctcatgcctgtaatcccagaattttgggaggccgaggcaggcggatcacttgaggtcaggagtttgagaccagcctggccaaaatggcaaaaccccttctctattaaaaatacaaaaattagccaggtatggtggtgcgtgcctgtagtcctagctacttgggaggctgaggcagaagaatcccttgaacctgggaggcagaggttgcagtgagccgagattgtgccactgcactccagcctgggcaatagagtgagaatccgtctcaaaaaaaaacaaacaaacaaacaaaaaaaaaacaaaacacatgctggtgcacacataaatttggaagaaatgctctttaacccagtatgagcacgtggtattcttatcctcattttacagatgaggaaattgaggcacagacagattcaataactacgtgactcacagagataaccgtgtagcagaatcaggaattcagcccagttttttcagttgcacagcctgagctcctaaccatcgcgcctggggttctcaaaggctcgtccccaagcgacaacatcagggtcatctgggaacttgttagatgtgctcaccctcaggctcgccccaccccgccagacttcctgaaccagaaactctgggagtagggctcagcaatctagttttagccctccaggggattctgtggtgcctaaagtttgagaacttctgatcaaaaatgccagataagaaaaaaaaacctttcgagacatcatttgaatcaattatcaaatgtttccaaagtgcrcttgctttgcaaaccactgtactactcatctctgcctccatcggagcgagttcaggagagttgtgtttacttttctaaaggagccttttccttcccattttaccagtgcccaaaagtcttagaaaaatgacaatgttcatatatttgcccacatgaagatagaaagtgtcatgtcaaagataaagggagaacagcattttctttttttacaagtcactcttacttaaacacacagcatgactctccttacacatttatttcrgaagagcaaagtccgggtccccaggctcaactatcagccgccttctcatcccaasggctgtcaccaccagaaatttaacatgctgttagtgcatgcaaaaaaaagcccagtaattgtagsgctcatcagtacattgttaattgatcctcatttcctattattttacctcaaagcmaacacatcattcaccatagtgacaccagagttgtttatcttctctgtgcaagtgtgtgctctttttagcaagctttttggatcctctgtttcagagggcctttcccatctgtttactattgtggactgtgctgctttttttgtttttaattacaggttatataaaatattgtcagcaggagggaggttattattaccttaaagaataagtggtagatgcggactggccactgtgagcccatcactaaaatgcacttccgtacactaaaggtccctcttccctggcagacagtggttcattttatttgaggaggtatgttgtgggcttggggaaacagaaggaaattggagacattgatatgcttcctgagaggtggaaggggccacttaacacagctttcatttttcagttgccartgggagaggagctggggtgggcatataatgagtaacattcaaagctccttctgtctttttttcagagaattcacaaaacaactcagggcctcctggtcctgcaaaagtgtttactgtttatttgtgttgtttctgcttgttttgcttgccaccagctccctactcacttgggggaaaataacccatcaaaggaatagaagctcaggataaacgtttcagacctttcagtaagatagtaaaatttctttcattcccagacctctctccaaaagaggcagccatcattaaaagtttgttatggattcttccagaaacgttctatgcatttagcatcagttgcagatatggatagccttttcaaaaaatgcatgcaactgagactattggctatgttttgtttattacctactttttccatttaatagtatcttggagattatttggtaccagcacatgtagctcaacctcctaatactgcatgacggataatatgccatcacatggtgtcatttaatatattcattcctatttatagacattgaagttagatccatgtcttactatyacacatgacttagtaatgaatgttcctgcatgtatatttggtctgcttgagcaaggatattgggagggaggatttccagcagcagaagtggtggaacaaaggcactgtgtacacctttgaaacaattaacttcaccaaaattactaaactgtcctctagaatggttaaaccaatttcctctctwccattcacacgtgagaatgcctgtggccccccagaaattatctccagcagcagcaacagagaggactggaatgccattgacaggtcccacaagtcagcaatcagcacgccattttttaaaattwatgttgctattgtatcgtaaggttcttctgaagcgaccacttcataacactgtgtagtccaatccctaagctgggcaatttttttttcccctttcaawacatcacattgattttctgtatgactttatctgcttaatacaaagtgggattgaacagttatttgtctggatttgatcattccttattaaacatttatgatttagctttcaccgcggcatcttcttgtaaggtgtttcttatttttatcattttccgtaaaggtaggattgtgttgacagccctgtaataaatgtctcttggaagagatgtgttgctgaraggtggggarggggtgggggctctgtgcatggaatggggggaaaagcttcagggaagggcagtgcaaattgtttctggactgatgccatctyytaataatagtagttaatagactgggtacaatggctgacgcccgtaatcccagygctttgagaggccgaggccggtgtatcgcctgagtccaggagttagagaccagcctgggcaaacagcctgargcaaaacctcatctctacaaaaaatacaaaaaatcagctgggcgtggtgatatgcatctgtggtctgagctactcaggaggataaggtgggaggatcatttgagcccggtagatggaggttgcaatgaaccgagattgtgccactgcactccagcctggatgatagagcgagaccatgtctcaaaataatgataataattgtagtagtagtagtggtggtggtggtggtggtagtagtastagtgaatgccctgactttggggtttgcagtaagctaggattaagtgcttcacagtgaggcacagtggggagctactctgaggatgaawtgcctartaaataarkgaggtttgtataaccgaggccagatcttagaacctcctgctatctgtacatagaagaatgttttagtcagaggcaaggcaaggtcaccaggattcactgagagtgttggtcagcatttcatctgcatatacaggactggaaaataagagagcgyaatgagacatctagtttttttctctttcgtttgttctgtttcccactgagagaattttctagctttatgtggagaaaacagtattggaaattattactcagttcaagaaaacctcactgagcacctaccatgtaggtgctcatcccgataccactatcaggmcctttggaccagttgcaaggatgcaggatgaggaaggcaatgtgagaaaacagaaggagcaccaggcagtcgtgggcttgatttttattttactattttttaaaaaacataaaacaacatacattcatcattttgctttctttggatgaagaattgagcctggttcagcatctcttgcaggctgtaattgagggtggtcattgactggggctggattcgggaaggatccacttccaagctgcacagttgttggcaagatgtagtgttttggtggttcctgggctctgggactcagctttttggctgttggttgttggctgttgccacatgggcctctgcaaaaggcagcttgtaacgtggcagctgacttttgtccaagtgagaaggtgagagtgcaagaattggtgagagagaccgcagccagggtgtttttttaacttaatcttggaagtcacatcctatcgctttggttttttgactgagattattcagtactgcaatagtctccctttaaagtggacaattcattggcttatcgtatagtcacaaacttgtgcagacatcaccactatctaatttcagaacatttttatcacccctaaaagaaaccctgtacccttcagccagcattccctattttatacccccgatctcttgacaactactcattgactttgtttctatgactttacctatttcgggtaattgatataaatggaatcatacaatacgtggccaactgacttctttcatttaatgttttcaaggtttgtgttatttcrtgtattaatattatgttggtgcaatcacttttgaaccaatctaactaatacttcatccccttgtatggccaaataatattctattctatcaatatattatactttgtttatccattcacagttcatgtcattcccactttctggctattatgaataatactgcgatatgaacatctggttacttctggctcttatgggtaacacttctataagcgttgccacaggttgcttctgatttctattatgagtaatgctgctatgaacattcatatacaagttttagggcagacttctattttcattccaatatctctttatggcatgtcttagcagtgatgtctatgacatccaggatgtgtcttgacatgtctgacatcatttaaataaaaataaagtagggaaagaaaacagatagtgattgtgtgtgtgatcagtgatggcttttgaggaggtgacatttgaactacaccctgaatgaagagagccatgcaaagacctcagcaaagaaaatctcaagcacaggtgcagcaagtgcaaaggccctggggtggaaacacactcgatgtgttcaagggagagtaagtggtgaatgggtttggagccaacarggataatagacaacgctatcaagarggggsccaaccacacatgtgcagccactgtatgacgtctggattttccttgasttatggtgatcactattgggaggtggtaagcaaacaggtgacataatttgaatcatggktttaaaagacgccatggttgccatgaggaggacaatgcgtaggaggcaggagtgaaagctaaaggatatgctgggaggtgaccctggagttaaagaragcaactaaggtgaccaggtgacaataatggagatagagaaaacaggatggattcaggaaacatgaccacactgagcatattcaaatgtaattgtcagttttcgtgtctccctcccackggaccacaagcccctaactcttcatgtacacaccctgactcccagtgtgggctggccacccaggaggcacccagtytatgtgtgctgcgtgagtgatgtggaatgactgcccacgtaggaagtggcaggttggagaaaaagcagtcacagctcctggctgctgtggctgctttgagcttcttcctcgatcaggctggatcattaccagcctgtaccctcaaaggatgcccttagtcctgtcccctctcactagcagggattccaagcttgtaaataaagtctcccacttaaaatgtgagcagagtgaagagctggcagtgtcaaaactctgtgtccagatgttttatgattttcccttttccagatgagcccggtgtatccgtatcagtgtgtctaggaagaccaagcatgccgaacggccagcagagtagaaactctgtgtgcccatccattatgtactccctgaattaggctccttgaggctcaattattaaagtgggatttttcttaattattaacagttaaaaataggaaaatagatttcaaggggaaaaaatttgcaggcaacaagagtccaattctaaatgtgtgcatgtgcgtaaaacggaatttgccaaacatgaataggcacttacaatgtgactggaattggctctgtcatgtgtcagcctaatagcctaaaccctggttcaatacaatgaacttgggaaggtttgcttaatgaaagaactgacgttttctgtgcagcggctgcattcatcagcctgcatcctgttcattacactacaaagggctgccaatgggaattggtaggatcatctattaggtaaatgcgatggggacaaaagatagcagagcccggggctttgtggaattttctgtggtggtccgggttcctggagtagggagctgtgatgacgggcaacagatttccaagttggcacgcgggcttctggagtcacgggctgaattccggcactgccacatcttgccacgcacatcctaagggagtgtagagaagagagttttcagttatgcatgacactgccttacccattgtggattcagtagggatattcataactgtgaatttgaatataactattaaataattgaattattattattgagttactgaatataactattgagttttccctctccatctgggcacatgggaaggccgtactttcctgacatgtgatttgctgtggcgagtggaatctgggggcaagagacgtgtgtctccttgaggcagaaactttaacagattccagcctgctgcatcataatctcctttccctctaccacgctgactggcagtattccagattccgattgccctgtcagggtgggtcctagtggtaggacaaaagcaagaatcctgagctgacccaagacacacatggaaacattaattgtgcttctctgatgtggctttaagatacttgctctgtcgcccaggctgtagtgtagtgattccatctcagctcactgcaacctccacctcctgggttcgagtgattctcctacctcagactctcaagtagctgggattacaggcatgcaccaccatgcccggctaatttttgtatttttagtagagatggagtttcaccatgttggccaggctggtcttgaactcctgacttcaagtgatctgcccaccttggcctcccaaagctctgggattacagacgtgagccgctgcgcctggccaagatactgagatgtgggggccaggcacagtggctcatgcctgtaatcccaacactctgggaggctaaggctggaggattgcttgaagccaggagtttgagaatagcctggttaacatagtgagagccccatgtttctaaaaatttaaaaaaattagccgagtgtggtggtgtgccacagtagtcccagctactcaggaggctaaggcagggggattgttggagcccgggaggtcaaggctgtatagtaaactgtgatcctgccactgcactctagcctgggtgacagagcaagacactgtctctttaaaaataaataaataaattaaaaagacactgagatttgggggttacttgtaactgtgtcataacctggctccttactgccatcggcatgcctagagggatcccagttttacacatcagaacaacccaagccccagtgtgtcacgccattacatgcttacagcctatttttacaaagtttgaatattgtaatttgcctttaaaaaattgttttaaagatctgcctaggtcarcaaattttatttactctctagaaccatttgattggggtactgccttaagaaataaagcagattccttcagtcgcatgtgggcctggagtcactggaaaatgcagacaaaacaagatctgctgattggcaaggtcatcttgggaagggccatcgtgcagtaaagagcaggtccattaattcaggggggatttacatcagttccatctgcctctttcctaatgggactgtttggttgtgttctttcctggagagattagtgattgaaaggaggagatctagaaagaagagataaaagtttacatttaattttcatgccatgcagcgttctacgaaggcttcctaaggaggctccatactaaattcagacataagtcagaaggcagcttctcccaagacactgttgatgtccagggggtgacagttccatcacaaaagggggttaaaagggtttaggggaagtttagttgtcttccttttatctctaactctaaaacccaactgctggctgaattaaaagtctcttacataatgrtcagaggagttttgagtatcggatctttgtgtacttgytttttaaattcagtcacgtcttaaatagtacttttcactctcctcctctccacaccactttatgtgtttgctagtagcttccatgaaactctatgggtgaacatgtctgcaactctttggcatttaaattttaggtttctgcccctcgtagcagactatctttctagaagcagagctgtaagtctcttttaacaccattttcaagcttggacaggctgacatttttattgaatgggttatctcaatatatatctacttttttgcatcctactttttttagaaaattaaaaatgatatgatgggtgtggtggctcacgcctgtattcccaacactttgggaggccgaggcgggtggatcacaaggtcaggagttcaagaccatcctggttaacacggtgaaaccctgtctctactaaaaagtacaaaaaattagccaggcgtggtggcaggcacctgtagtcccagctactcgggagactgaggcaggagaatggcatgaacctgggaggcagaggtagcagtgagccaagatcgtgccactgcatcccagcctgggcgacagagtgagactccgtctcaaaaaaaaaaaaaaaaaaaaaagataatgatgaaaataatagaatattgatgagaacacccattactctgctcattgttcaaatgaactcatttgagagctctctcctttgtttctgtctttctctcgcatcagcttgcatctgtttgcctatgctataaggcatcagtggttaccaggcagtgttgcattttttccatcccatacctctgtgtgtgttccttatctgtttctaggatgtgccctctgccccgtcacatcacaytctgtgctgctctcagccaaagctcttcttaaatacactagccatcaaaaccatacaacttggctgggtgcggtggctcacacctgtaatcttagcattttgagaggccgaggcgggtggatcacttgaggtcaggaattcaagaccagcctggccaccatggtgaagccccgtctctactaaaaatacaaaaaattagccagctgtggtggcacatgcctgtaatcccagctactcgggaggctgggacagragaaccactggaacctgggaagcggaggttgcagtcagccgagatctatgccattgcactccagcctgtgtgacagagcaagactttgtctcaaacaaacaaacaaaaaacatacaacttaactctcatacccccacgcctgtcttttctcctgttcgacttgactcctcttgggaattccgtaagtactttgagggcaaggaccacaagataaatgtcgtaaggtaaccaggaatgacattccaagattccattctttcctttgtatatccactcatcattcattatattcttactctgggctaggccctgggaacagttgagtaagaacaagcaggaacaaacaattagaacatttagtgtggcaaggggcgtgacaaagttaccaagagaggtaggtgagagacaggagttgttatctgcggggaacaggtgaaggagtgacagcagggggtgaggataagaaggaggaagctttacccctgagaagagcaggcatcagatgggctttggaatctacatgggtgtttgtaggtagaccaycctggaagttgagtgatggggaataaarggaagaaagtgcattctgaacagagggaatagcaggtacagcagctcagacatgggcaccttcagagcgtgtctgagtcttcctgatgagacacgtggtgttcacttgataactccctggcaggttctcttcatcgggcctccacatagggtatgcgaacctcttcatgtttttaaaagggagagatttaataaaggcaatttggkacttaaaaattgttagaagagctaaaagagtagttttgaggttgaccttcagaacggcttcctgaataatacagaagtgaccctccaggaaggcccttccactgaagctacaactggagctaagcagatggataagccaaaaccacctccgttgctgtggccccatctccaccacaaggaagctgragaagggaccccagaaccggaagacaaaaaacttccttcacacactcccttgctaagaggagaagccccaaagaagctggatatggcccttccctcacatttgctgtcccaagtgtcccatggcagtgcctaagcaattggtgggatggatttgtgtctataaacaaagttgcaagggagtctggaaagggagttttaactccaacttcttcaactagaatggtaggatccaggggcagcattgctccccaggggatgtttttacaatgtctgggatattttttagttgtcagaactggaagcaggaagaagtgctactgtcatctaatgggtcaaggccagtgatggtgctgactatcctacaatccataggacagtacctaccacaaagagttacctacccccaaaatgtcaacgtgcccaggttgagaaacgtgacctagctggaaggtgaacaggaactaaatgagtcagtttcagatatccaacacaaatacgtcacttgtttctgttccaaaagtattataatttttgtttgagctaaaaactagttacagttcattggataattgcctttcatcccttcaatatgtgttcccttgaaatttgcatccatgcatcccacatggcacccctattgattatttcagtgactcagaagacttcattattcaaaataatctctaataagatgtttagggagaaggaaaaataaagtttctctccacgttacgtttttttcttgcacatgtactgctttttcataagcacaatcttattaatagaacaagtcctctcaaaatggttgccttttctcccttcatcctcccccaccagtaatgtagagctgttatttggctcgtttttctttttcctccagaggcaggaagagggaatgaatggtggccaagaattttaaattcctgttcccggccgcccccggaagctccatctttgttgtgagggcttctctgcgtcagtagaggccagctgagctcttattcaccccttattctctggttccctttcaccagcaggtccagctctaaccacagctggagtttaggaaggccaggcagcgtgtgttgaatgccagccactcttctacccagggtcatatccttggatgtttttctgtgcatctgtctttyccgaccctcccgtgattctggaaggaaacacctttccaagctccccagtgaccctggttcatcccggaaatatgcaggaaaagcattatgagcattgcagtgccacatgctgcattggtgtgttacgttatgagaactattagggctgatctctgagaaacttaccagtggtgtgtgatcggaaatcatgtcaccctctgaatgtgggttatgggataaatggctaggtacacaggcttcagagtccagccagccccaggtttggattacagatggttgctgtactagatgaataatgtccccccaaattcgtgtctatctggaacctcagaatgtgacctcatttggaaataaggcctttttaattaaaaaaaawtttttatttaaaaaacagagatagagtcttgccatcttgcccaggctagtctcaaactgttgggctgaagcagttctcctgctttgacctcctaaagtgctgggattacagacatgagccactccacctacccagaaataaggtctttatagatgtaactgaaataaagatagagatgtgaatgtgatcgtactggtttagggtgggccctacatccaataagaatgtccttagcagagacagaacagagacaccgagagaggaaggtgatgccaagacagaagtaaagattggagtggtgccatctaccagccaaggaatgccaaggctgtggctacaccagaagctggaacagagcctgcaagcatttctcctgcagaacccccagaagggactcagcctgcagacactcagatttcaaacctctggcttcctgaactgtgaaagaatraattgctgttgggccaggtacagtggctcatgcctgtaatcccagcactttgggaggctgaggcaggtggatcacttcaacccaggagttcgagaccagcctgggcaacaaggcgagaccccgtctctacaaaaaataccaaaaaatgagcygggtgtggtggggcatgcctgtagtcccagctacttgggaggctgggatggaagcatcatttgagcctgggaggtggaggttgccgtcagctgagattgtgccactgcactccggcctgggtgatagcatgagactgtgtctcaaaaattaaaaaataaaacataaataaatttctattgttttaagacaatttgcctgtggccctaggaaaccagtatagayaacttgtgatggtttagcttatttagtacaacaaccctgccccttctagtttttatgataacctcattaattgccggtactctcagagccctgattttcttacctataaagtagagattccctatctcatttggaggtgattttaaggcacaaatgagacagtgtatgtaaagcatttggcatagtgcctgattcagagtaagtgaccaataaatagctacccttactatttagaatgctattatttagaacataagtatatttaagaaagcaccatcagtattcaatttgccttgctaataaaaagggatcaagatatggattgtaaagtagaaaaatacatgtcaattaaatggatttacatcttaaaaagtggtgaggtagacacacaggcactactcacttcattccttctcatctcaacccgttaggatttggccttcaactgggtagtggaaaaaatatgatccttggcagtctactacgcaaaagcaggaacatcatctgcttttgggtagttaagagttaagtatcactttgagctacaggatcatgattaaaaagcattctgttatcttacttcacaactctccacttttgtaaaagtttaggataccggcagggcagcaaatacctttaaatgattttatttaaatgtcagatttaattaaatccatgaccagaagacaaacccaaaggaaattttcagggagctttagaattttccttttccatgttcaaggtgataaccgtagcataaaactgtcccaaccacatgcaaatgcaagcaggggcattcatcatgaaaatacagctctcaaggcggaagtgcttgttaactttgcactctatagccaagtgcgatgatcagaaaatacatacattgaagacaccagaaaatagtgtatggattggtgattttgactaaractggaatgtgggtgtgtgcactcctcatgttccggtttctgtgatcattcaggcatgcacaggtatcctgatgggtarccaggtcattaggmccaragtcggcagtgtagcatggcaagagaagtcattgcatctccaaactgtgcctaaattgcctgtaatgggttctttgcaacttgcagaaccagatcttaccatttgcaaggagaatagctgaaaagatacttaaataaaagtgatcggatgaaattttaaaaacgggaatgaccaaaaagattcccagaggaccgttactggtctgcagccccccattttagggtctggcatttgtactgattatggcctgacagctcttgagtttccaatgataacagccatctgacttgatcggagttctatggattttcactaaaatagaatcatcgccttggtgatggatagaaaaagtaaagcaatacatcctgataaatgctgtgccttcctccttcgtctcyctggcggtgaccttgtgcaatccataagagggcaaggctgagagccccggccaccgccgccgtgtgtcagaacttggaaatttaagtagctttgaaacccgtcaatggggtgaagggggaatggcctgagaaagcaatggatcatgcttagagggctcagagggaaatagggtacgctgaaggtcaacgtgcagacatgtcctgaaggaacagctcaagtcctcattctcattcacgggaggctgcggccctgtgaggtgagatcagtagaagagtacaataaaacaggaattttcagagcatgtaatttcttcttggaagtgaaaggcactggagaatggtgcagaataagyactagccttagagagaggatgccctgccccagtctctttctctgagtagcagagagctggctgtgctaggaaactcttcgcctctctaacaccacgtttattctccagcccagttatcttagccaactgtgaacattttgaacactgttgatcatcggtaatgacaccagcaccataacacgaaacccctctaaaacagggcttccaggaaactcacagactagttacatccccaagccttgcatacttgattggaaagagaagcttctggatggttgaaggggaaaggagttagacgttggcaggcacccattagtgttggttacgacttgctaaaagaaaatattaagataaaaattagatcataaatttggagccaccattacgaagcctaaagtgcaaattgccaaacaagtcaagagactcattagcattttatgtaaatcagttattactgttctccacttccttaattatccatgttatttcaatacaaccctttctttgatgtcccaattctatatttaaatagtgcaagatttctatcgtatcctcccgcagaggtttgtgccatgcaaaaaacatgccaagagcagctattttagagactacagggaaatgtttaattggttcatcccatttgagttatgagggtgtattactgagcacataaaatcagaaacatggaaagtactagcttggagaagtttactaaaacctgcaagagaccgcttgaaattttgcccccaagactttttggattctcgatgggaaccgactcaaagagaaatttcgcaaacttcatggaattttgctaagtgattgatttataattgaaatatttggaaataaaatccaacagctctctttcctttggctcagagacttattgttttggttggatgaagagaacacttgtgacagagggaggaacatagggtgcataagagagatgtggggaagcactccccatccaactcgttccaaccagttcatcttttttttttttttttcttttttcgagaaagagttttgctcttttccccaggctggagtgcagtggtgcgatcttggctcactgcaacctctcccttccaagttcaagcaattgtcctgcctcagcctcctgagtagctggaactacaggcgtccgccaccatgcccagctaatttttgtatttttagtagagatggggtttcaccatgttagccaggctggtctcaaactcctgacgtcaggtgatccaccctcctcagcctcccaaagtgctgagattacaggcttgagccacagcacccagccagaacttcatagtttactcttattattttctcctaaccactaggttccacacttctggccacctgcctttatctcctgccccataacctaacctgttttaaaatacttattaaacaaagaaaaataaacaagaacaaatggagaatctttcactatgactgcaactgaaaagaggagtaatggaaggacatgtactcttcccatatatttttaaacaattactgkatctgatttttcatttttcattttttttttttctggaagaaagagcagatctggataaagtcagtatacaatgtggtctttggtgmcagacccaagttcaagaccaaggtgtatgcatgggtttgttcaagttgtctacccttattatcccctcagtgaaacatgattaaccatgcttaccttgaagagttatcttaaatatttgtgttaatattatatatgtacattacatggtaagtgctaagtaaatggtacatgtgagtctttgctctaggcaaggcgctgtgctgaatgtttacatagatgatcggatcctcatattggatcctcaaaacgttcatcaaaatgggtaggattatttttatgtatatttaacaggtaaggaaaatggggtttctggaggtgagtgactcactcaagatcacgtggaatcaagcagagaagctggggttttaattcagaagttctttaagctacagctgtaattgagacaagaaccgtacactgtagtaagattaatgtaaagatttaaaaaactgttcatatcgttcatctacataaataaataatatttacagaaactcatctctgcagactaaagtactttaaatatttaatctaatttattggttatttatttaacaaatacttttatgggccttgccatgttccaggcacggttgtaagcacttacaactagtgactcatttaaccatttcacaaatatttattttgagagcaagcacgggggtttatgtgatggctccacagagcagtgaaaagactcccgccctactgctcscaacctcaratgtccctggscacwagcccatctgtatgkctttaaaaaaaataaattaaatttttaaaaacatgactttctggccaggcgcagtggctcatgcctataaccctgcacttagagagggcaagacagaaggatygcttgaggccaggagtttgagaccagcctgggcaacatagcgagaccttgtctgtactaaaaaattattaaaagaaaatatatatatttttttaaatcatgacttttctgatcatacctgtggcatactcattatagaaaatttggaaaatgtaagaagtcataaagaagtgggaaaaaatttaaatccttctctgtcccaccacaaaccatttaaatcaatccaagattttagtggaaagggaaagcatatgatctagtacaaagaattttttttagcttcttctccgctgcttgtttaagaatctcagagtaatccagacgttactactccataagcaaatctgggacagtaatcagacaaccagacaaccagactgagagcccccaagggttcaaattcctgagcgccgtgtcttctctatagcttgctgtcttgttctatttggatataaagctaccatcaagcagaagaagcgggatgctctctacagagtccgaaacaaaacacagaaaattaacctgctaccatcctctaaagaagcgagggtctcagactttgtccccttttgttcctgcattgccctccattcagatcttgtcacttaggccttggtagcatgagctattaacagccctccatatttactatttttttttttttttttaactctgggasttcctgttgcagaaattggatcacttacctaaaaagctccccacccccacctttggtgactggtgggtttcatcaccaggaaagcacattgttccaactcaaagtctacagtctaaaatcatcatcatgtattttcatcaggatgaaatatcgggcactctgctcagtgcaaggttttattaatgatgtgctgtcaggggctggatgttctgcatatttgcatattaaacagctgagtgaagaaacattgcttttattgctgcagggaataaatcagtttaaagcaagttctcatcatttatactcgtttcagctaagtcttcttttattgaaataaattgttgaagtgctttgctcattctttgaatactgatgaactttaccttgataggacctcaggaaaaataatattttcttaaaggtgcagtattgttccatttttgagtattactttaatacattattgataagttaatttagaagtatcaagtgaaaggggaagaaaaacagttttgaataaaaacggwgtttcctctggactattttgccaaatgcatttttattggtagaacgtaagcaaatttaaaaaagcaacaaaagcagtttttatgaatacctagcgtactttttttttttaatgaaccatgagctgtttttgcattcaaattctcgtaggcattatattgcatctacacataaggacacagtgtttacagaccccaaagcttgctgtcccctgggcaggtgcatgagggggtcccaggcaatcaggctcttctcaaacctgaattatacccggcctcarggtatargggtcaggcagctgtttgacaggattcttgcaaatgtttttggtttctctgtctactcattacgtacactctgccagaggttgaaaactcaatgttgagatyacatacatcctgaaaacactgkttaaataaaattttggcctgcatcctgtttttgaaaacttgcaatggcttgccaacgttttcaagttgagaagtttcacaaaaaaaattcggatttccagcttctttcaaaaacacaggtcaaacatcctgagcctgttctgtggtcagttactcattagcagcctctgctctaggaggaatagttatgggtcctttcagacatgcaacccccmaaactccatgttgtttacagtgtgggacacctgactttcaccttttatgatacctgcctggggcatgcatgtggtgactttttccatctctggtctctatcttatctcttgtgatgaactcaggtctataaagcatttgggcactgcctggcacataggatatgtccagaaaacactagctggtattaaaacagaggaaacatgggaactgagggtggtcagtgacatcacattgtatttcctttatggtgtccttctgagtacagaaccaaacatttcttaggcgtacaatttcctgcctccaaattaatgttatttctaaaaagtagcccgttccactcctacaaatctttgcccaaatatgtccttttcagggatgacatccttagccactgtttaaaatagcaaatttctttccaaactctgccgtccctgaatctctaccctgctttatttttctccttagcagacatcatttctctgtttaatctgtctacttgctaattgtctcactgccctccccctccccactggagagtgaatgaaggcttaaggttttgyctgccttggtctctcctgggtcctgagtaccagtggccttacgtggcatttggtagattacatgcttaatgaaaagtgagtgaatgggctgggtgtggtgggtcacacctgtaatcctggctactcaggaggctgagacaggaggatcgcttgagcccaggaggtcraggctgcagtagggtatgagcgggccactgcacttcagcctgggcaacagagcgagaccttctgtctaaaaatatttatctatattgagtgaataaatgaatgaatggattattttagtttggcctcaatctttatagaaactcaattcaacaaacatttgagcacctgtttgttcagggccacgtgctggttgcaacctggaaggaaaagctgggcaaggcggagatccagtgctcaggaagctgagtccatgccaagatgtgataattgtataaagaactacaataggcataggtacagatctgtaaaatatgaaaacaggaaaacacatggagtcttggagggtagggaagtcttgatgagtaagattgggtctgagataaacctaaaagagggtcaagattttgacrgagggctggaagggaggaacgataggaaactgaccttttttcagatctcttcttgtgcgtggcctggggttaagtgctttacatgcatcccctcattgacttctcagagcagctccataaagagtccctgtgcttcccagtttactctggagacgactgaggctcacagaggttaagccacctacccaggctggcaccgcacactttgttcagagtgggcctggcatacggcatcagttcagcctggccctagacccttttcctcccacaaccatattgcccccagtggagagacaggaaagcagggaagggggcaattgccaagcctgtttctagaatctcaaggatgccatttggtgaagctgaggctggtgcagttactctgtggagacaccagcgtcttggacctagggatggattcagggaggattgtgtcccccagtgacctgctttgtgaaaggtagagaatagattacaggtgcccgagatcctagaacccgtttcttaccatgatggcgttgaggtagaggtagaaagatgggtgaggtggctgggtgcagtgggttgcgcctgtaatcccagcactttgggaggccaaggcgggtggatcacctgaggtcaggagttcgagaccagcttggccatcacagtaaaacccygtctctgctaaaaatacaaaaattagccaggcatggtggtgtgggcctgtaatcccagctacttgtgaggctgaggcaggagagtcacttgatcccggggggcagaggttgcagtgagccaaaattgcaccactgcactccagcctgggtgacagagtgagactccatctcaaaacataagtaaataaataaaaaataaatataatacagacacaggcttttctccccacctcttttaattcttgaaaggaacagtaacaagctcctattcctgtttccttgccaggagaagtattgttttcatataaatcatttgtgacagaagctccttatttttaagtggaaaatgcacatttaataacatgagaataatgtccaaacatcttctcattgatggctgccaagagaacagcagcactcttgctgcctgcagaaagagacactcagagtcaactgttttaggggccatgctgtcattgctgccgcatttgcttaggtgggctctgagcagcagcttcccagacactccgtaaccaatggcagctgagtgcttttgtgccttgcaaatcctctagtcagagcagacctggcttaggaccccagccctaccactaactgactccatgcgctcctatcggttctttattttacctctgcaagcctcagttttctcatctgtaaagtagggataacattagcttcagccctcacaggcttagagtgaagtttaaataagaaaaggtatctaggctgggcgtggcggctcacgcctgtaatcccagcactgagggaggctgaggctggtggatagcttgagcccaggagttcgagaccagcctgagcagcataacgagacccgtctctgcagaaaatacaaaaattagccaggtgtggtggcatgcatctgcagtcctggctactcagaaggctgaggtgggaggattgcgtgagcccaggagttcaagaccagcctgaacgacrtaaaaagacctatctctacaaaaattagctgggcatggtgtcacgtgcctgtagtcctagctactcgggaggctgaggtgggaggatcgcttgagccccgggaggtagaggcatgatcatgccacttcactgcggcctgagctacagggactctgtctcaaaggaaagaaaacaaacaaacaaaaagccatgtagagctgggctatccaatacttgaaggtagccagtggacacgtggggccatttcaagctaaattaaattttaaataaaattaaagattcaatctctcactcacacattacaagtgckaaacatccggacacatctagtggctcccactgtgggtagcacatacagaaagaacgtttccgtgacagtagagtgtcccattgcacagtttgggtatggagcacttagcccagtgttgggcacagtacctgctgtgatggttaaagcttagttttattggccaggcatggtggctcatgcctgtaatcctagcactttgggaggatgaagtgggaggaaagtttgagcctaggagtttgagaccagcctgggtaacatagtgagaccctctgtctacaaaaaactaaaaaaatttaggccatacttagtggctcacgcctgtaatcccagcactttgggaggccgaggtgggcgcattgcctgaggtcgagagttcgagaccaccctggctaacatggtgaaaccccatctgtaataaaaatgcaaaagatagttgagcgtggtggcgcatgcctgtagtcccagctactttggaggctgaggcaggagaatcacttgaacccgagaggcggagattgcattgagccgagatcatgccacagcctgggcaacagagcaagactgtctcataaataaataaataaataagctggacgtggtggcatgtgcctatggtcccagctacttgggaggctgaggtgggaggatggcttgagcccagaggtagaggctgcagtgagctatgatcttgccactatacatcagtctgggtgacagagcgagactctgtctcaaaaaaccaaaacaaaggtcaattttttttccacattcatctataaaacaataaaggaaacatcctagacacttgaatcagagcccttttaattatgacttcaaaaaacagggctcgtgccacccaagatttcctccatatacaaaaaaaaaaaaaaggaaaaagggaagaagcaaaggggcaatacagggctctgcccattagaatctctagggacagaccgaggtttgagagttcctgctcctgatctcaggggaatcctgaattacaggtgttaacctgattakccccagcccagctcttcgttaattacctgaagtgaatgggacagtttccaatactcagcacaaaggcgtgcgcagtgactctgtggcgtactatctatttggccttggaaagttactctctaagtcagggcttcttttcttcaactttggtgtgagactccgctggagagctggttagaaaaacacaagtctcgggccccaccccscagagcccctcattctctagttctgggttggggcccaggagtctgcttttctagcaagcgcccagatgtcactgatgcttacagctctcagaccacagttggagcagtgatttttaaaagtcttttcatttgtaaagagttgttctccatgctccaaatgactgtgacgactgagaaaatgcatgtatgtaaagtctgcagctggtgacattgtagacactcagcaaatggcctttggtgttactrttattttatttttactaattattttttacacctacaaatcaggatctgctacaatcgcttgatatttgaaaattgggcctaacccactatgccactcttctgtcatgaaataacaatcttctatttaaactagtaaacttaatagtttaaaatacttggtagtttaatagtttaagtagagccactgaaagatggctcacacctttcagctcagtttttttgtaccagtgaggatgaatgtttctgcatgtgggtagttggcaccagtcttcaatgaattatttttcctttagccgggtctggtggtggcgtgtacctgtaatcccagctacacagaaggctgaggcaggaggataccacgagcccaggagttggaggctgcaacgacttacgatcatgccatggcactccagcctgggtgatagagcgagaccctgtctctgaagatacaagaaggccacatgtggtggttcacccctgtaatcccagcagtctgtgagactgaggcagaargattgcttgagaagtttgagattggcctgggmaatatagcaagatcccaaccctattaaaaaattaaaaatgaaaataaaattttaaagaaaggtatttctccccttcacggtaatttggagccartacttcttgcaccattcatttgtccacagcatgggacaaaggataatgccttaatgcctgctgcaaatagaacagtggtgcttagcagctttagataatgcattgtaggtgttttgcaaaaacatactttcgtgactaaacatcataagctccaagtgagtgatttccccgcgtaaatgaatgwttctgtgaggataacacttctaagatgtgagatttcaataaatgaatctgtaggctgctgtgatggatacctttggtggggtaggaaggatcgtcatttagaacctgggttctgactccagatgacttgttttgttctatcccagaaatattcctaaaatcgatttccagtttccaaaagagcaggtaaggaaaacactgagtgttacttggtctttaaaattttttttaaattcatttttatttttaaaaaatagagacaaggaggtgggcgcggtggctcacacttgtaatcttagcactttgggaggctgaggtgggtggattgcctgagctcaggagggcgggtggattgcctgagctcaggagttggagaccagcctgggcaacaaggcgaaaccccatctctactaaaaacattaaaaaaaaatttaggcgtggtggtgtgtgcctgtaatcccagctactctggaggctgaggcactagtatcacttgaaccggggaggtggaggttgcagtgagccgaggttgtgccactgcactccagcctggctgacagagggagactctatctcaaaaaaaaataataaaaataataaaaaaaaaattacatgaaaaatagagacaaagtctcgctttgttgcctaggstggtcttgaactcctgggttcacgtgatcctcctgcctcggcttcccaaagtgctgggattacaggcacgagctgccrcgcctcacctcttgttttcaataccattgataagttgtggtcttcagggacttgtgggcattttcaagttaaatatccaacaktcgtgatttagggcatgaagagctcactcatcaagatgtatgtaattcagattttctgagtgtttaattcggcgtctttggtcacaaggaacagagktttacttgtgccacctcttctaagaaaaaggtttactgtaagagataatgttggcaagctgaggaaaggaggcagttttgggtaactgtctcttgcgatcccctcctgcacaactgtggcgttctctttttctgactagctgattctgctgctgctggatttattcattcttctccctcacarttttggctcgcacatgcttcctttttagctcatgrccgtgcarttcaactcaacctcatggcatctttttatcagctgtccctgctgcaacaggcttagagttggtttcccaattccctagcgcagaaatccactggcatgagtcatctttcccattggtagattgcagagcaaacttctggacagatttgcccttggctcatgtatgattggacctgcggtctgtccaggtgtactcagagtggggaaggggagcggtggcaggtaatacaaaacccacctaagtagaaggacctatgaaccatgagggttttccttagcagggagtgccagtgggtagggatgactggttttgcagtttagggccaagtgagttggaatgacagctgtggcgtgttgagtcagatcaagtccagaattcctctccaccccacccatttgcagttccctcagatttattacgggacctggatgtgatgcaagcatgcccgctggctcaggctgtgcctcacagctgcaacatccctggggtggagaagccatgtgggacctcacagaacactccaccgtccctgctaatggctgagaaaggactctgccctcatggatggggttgggggacctgttatcttcttccaggttaatcttggtttcagctgctttaaactctactttttagtgggacgcatcatactgaactatggaagcaccatagttgtcacctagttgagcttctctttgttcccatatgtttcagtgaagcagttatagcttcagaaaagagggagccaggaaatacacttgtaattcatcactccttttatagtcagagcataggaacactcatagtatgtatcagaaactagtgaacacatgttgttttacagctctgtctgcaaaattgcatcgtgggcctctttggggagtgttctcaatgtgatttttattctggggtgtcctttggccacaatcctcaggattattttttctctgtgctgttcactgtaacatcgtccaccctctgagatcttgcttttcagtctactggtatctccacttctctctgcagcgtgatgtctagtcagagtttccattctgtttttatgaccctgggaggactgggasagatctgtgaggtcatcttgtccaccctcagccagggcaggagtattccctaatggtagagtcaagtgtttggtttggtcttgtttctaatgactcaagtgatgaggcctggggacgtcccttgggaagctattctgcagcctaataactttcattctgtgatttttttttgtatgtgtctaatattcagagtctgacacaataaggccataaagagctaagtctgtctatggtagatcttcacctgggaatgttctcctaatagtcacttttgttataaatcttcacctagcatgggagttaagtgcattttaaaactagacctggggactatgtrtcctaaaatgcaaaaatagcccccaaaatgaaaattaatgttgagaatctagtcaatctgccagcagtacgtacataactgttctgtgtatatttcacatggccatatatgttttgcttgtgtggtgctaaatgcaaaggcagagaagcttctgctattgaatgcttagcacagaactcctgtcctccctctttgaaattattccgacagttgcccctcatttggcttgccaaggagtaagatcttggcttgtgtgtttctcccatgtgtggtgtatctgtaatctcggtcactgttgagagcctggtgggaggctgattattgttgagggaaagatctgagagcagggccaagaaagggaaagagagagagaggaaaaaaaacaaaaaagaaaaagaaaaaagagaggtgggtagggagggaggagagacatggayccacggggaatgggaagagaaatagaaatagggaatttgaaatggaaataaaacaaaagggcaggaaaggaagaaataaagagaatgagataaaaggaaaagaaagtgcaagtagatttgggatctatagattggggaaagacattcatacagtcaggaccagatgttcactggaagttttttccttctggatccttctttggctataggaatctggttctcaaagtgtggctcccaggccagcaacaccagcatcactcagaaatctgttagaaggccaggcgcggtggctcaggcctgtaatcccaggactttgggaggccgaggcgggcggatcacgaggtcaggagatccagaccatcctggctaagtcggtgaaaccccgcctctactaaaaatacaaaaaattagccaggcgtggtggcgggcgcctgtagtcccagctagtcgggaggccgaggcaggagaatggtgtcaacccgggaggtggagtttgcagttagcagagatggtgccactgtactccagcctgggggacagagcgagactccctgtcaaaaaaaaaaaagaaatctgttagaaatgcatattttctgttttcaccccagaaatcctgaataagaaacactaaaggggagtgggcccagctatttgtgtttttggargaactcctgttttaatttgttttttcggaagtcctccagtttgagaaccaatgataaggacatttttccgggaatccagttgttttaggaaaggcccagtaggcatttatgtttataagcaactccaccctgcactccatatgccttctgtagctatctaacagagacagagttgacttgcagaaactgttttctctggccaggagacaggcttcgttttcgaaactcacccaggaaggcagtgttcttcttttcaaaaggcatttttctgttgactgtgcaygaagccacatagtaataaacagtttccatatccaagcagctaaggcttgtgccttgcaagttaagtggaacatcasgatctatatctcagttttccttatgtttccccagttggcacatcatggccaacaagagagtagggatcattaaggagtttattttcatctttattttatcatttaaaacacatttttttttccaatgagagtactgatgacataaaaggttatacattgaataaccacccaaattagcagtgtttcatatttacactgttcaacacagttctcttgtstctgttcatgatataacagtaaatccaagttgctttaagtagatattggaaatatgaacccaatatgttcttaacatctcyatgtcgtaattctaatttaaaatcaaaatctcatcaaattacattttagattaaagsattgtacctatcgaaagaagagaatcgaaaatgcgaaagtccttcattttcagtgtggcctgagattgttgaaggatttgttctattgcatgctgataaatatttatcacggttaagtgaacaatcatttggagacagacaccattttatgatgcagcttctcagggcgtcctaattgtgactctgccttgccattctatgttttatcggaatacgcagacatatactttatgaggttgggtaatgaagagagagagaccccaataaacatattttctaagagtaatggttatctatagctcaggaacccttggttagcacagcctctattacacagtactaggcaagcagttcatagctcaattagatctaacttgcttcatttttaggcattatgttattctaaattaacactgtatttcatattctccaggtctgactattaaccagattttggaacctttagggcttattatttagtaatccctgaagctctcaagtaggcgtttttaaattcatgcattagaacagattaaaaattagctagaaacgcatgttaaatggcccactccctttcttttgctaattgtgctagaaatgaaaaagaaaatgcaagtgaggtcagatctagtgtggtacaaatgaacttgctacttggtttgctgccaattgctgccgaaacaggagttatttaaattagtaaataatttttgaaatcttcttagaatgtcacaggccacaattcaaattcacagaccaggaatggttattatttctatatatcttaaagttttctgcaatagaaatgcatttcaaatataagctagaaaaaaaaaatgtgaggccttattgtgtagataaaagtgacaagatgtccaaatgttttgaaacgcagtgatttatttaagttgtagaaagcttggttttatttcttgttgcatcgtctttatccttagatcttaatcagaaataggaaaattttctgagagaaaattcacgagatcattcatgatgagtcactatatcagttactttaaaaaaaaaaaaaaagatcctgacaaatcctactttttcaggtcctgatgcactaagtctcattcacttctttctatttttcctctctctattgcatattaacccaccatattgagagaatagaaacttttgccttcattatatcacctttacaccccaggacaggtgccctcctcagcggagacaactgtccccctccatcctgcaggagttttgcagccatccttccagccactgcttctctaccggggcaaatyttcccccaagggataattgataatgtctgaggcatttttaattgtcacaacttggggaaggggcaagggattgagggagagtgctcctggcatctggtgggtaggggttagtgatagggttcggctgtgtccccacccaaatctcatcttgagttgtagttctcataatccccacgtgtcatgggagggacccagtgggaggtgattgaatcatgtgtgcagttacccccatgatgttttcatggtagggagtgagttctcacaagatttgatggttttatacgatgcttttcctcctttgcttggcacctctccttcctgctgccgtttgaagaaagacatgtttgctttcccttccaccatgattgtaagtttcctgagacctccacagccatgccaaattgtgagtcagttaaatctctttgctgtataaattacccaggcttgcatatgtctttattagtggcatgagaacagactaatacagtcagggatgctgcagaacatctccaaacacacaggactcccaccctctacttccaccccaccaacaaagaatgattcagcccaaaatggcagtagtgaccttgttgagaaatgctgttcaagccatacgtcaccattggaaggttgccaaactgtgctttgcacacacatgctgtctgcacgccttgtatttttctctttgcttagtcctgctcatgctctctaaacaccccagacatcatatctctttaagaaactctggctgagtcccataatgttctggggcaacttctgtcttcccttttccctctggcaaagaatccttgaccaaactttagctcagctcctcagagcccacttctcaactagaccttgaccttgctcctctctccttgctggatcttcatagtccagtctttgtaagagtcattctaagtcagtctagagagaatcccttcacccttcatgtctgatcacccttgcctgccttcagcaaaaatcctgctaacttggttaagttggaatactcctacccttgtggttccttgtagtaatttgcatccactgaccctcccactcccctgctactctgttccttgactataaatctccagctgtctttattatatttggagttgagccctatctctctcccctattgcaacagccttgacccctgttgaaataatcctgcataaagtcttccttaccattttaacaaatgtcaaggtaactttgttttttgttttttttgtgtgtttttttggagacagggtctcactctgttgcccaggctgcagtgcagtgatgcaatcttggctcactgcaacctctgcctcgcaggctcaaatgattctcctacctcagcctcctgagtagctgggattacaggtgcccrcccccatgcccagccaatttttgtatttttagtagagatgcggtttcaccatgttgaccaggctggtctcgatctcctgacctcaggtgatccatccattttgggctcccaaagtgctgggattacaggtgtgagccaccgagcccggccaggataactttttaacaaccccccctccacactgccaactttttgaggaccatgtgttgtgtagggccggatatagtgcacatggtgaacacataaataatgtttgttggccaggcgtggtggctcatgcctgtaaccccagcactctggaaggctgagtcagaacgattgcttgagctgaattgttcaagactgccctgggcagcacagtgagaccccgtatctacaaaaaataaacaaacttagccaggtgcggaggcattcacctgtattcctagctactcaggaagctgagatgggaggattgcttgggccctggacgtcaaggctgcagtgggccatgatcgtgacactgtactgcagcctgggcgacagaatgagaccctgtctgaaaattaaaaaaagaagaagaaatgtttattgaatgaagacatgaaagcatttggtggaaatagggcacacacatgaatatattcacagttgcaaactcagaaggatactcccaacctggttctttgtcttgtccctccatctgggtgctttccagtcacagcctggatgcatgtatgaataaacttctaccattaagtccctgaattatttaagcactgccagtgattctatataaaccgttcagtaaaatgaatggcatatgcgtatgtttcaagagctccagcagcctacccaggatggcttgatgttgtctcttagcaccgtatcaatacctgggggttttcaaatattgcaggtggccgaagcctttgtgttgaggtttctgtagtgtttatccatttgtgaaaccaggcctcaatctatatgtccaacgccattcgtagaccccctttgataatctccactaagcagacatactcgatacatcttcactaatgagttctgacttcataaaatgtattaatgacttctttttgaaagtaagagtgctttgaataccagtcrttattgctttagaagttcataaaagcaaaagcacagtatttcccccagtgtttgtgcgataagagaatagatgtaggtccagcgcctagaattttagctatgcttctcttgtttgtgattccaggtttcagactgcctggtagaaggaggtcacttctgattgtcagtgactttggtgagttcttaccttgtaaaagatttacaattatttcattttcaacatagctttatcttatgacaaaggtgacagaaaggaaatctcctaagttggcctacagggtgctttagaaaacatctggctgggcatggtggttcacacctgtaatctccacacttygggaggctgaagtaggctgaagtgggaggatggttagagcctaggagttcgagaccagtctgggcaacaamgtgagatcctgtctctacaaaaaataaaaaaaattatctgggtatagtggtgtgcacctgaagtcccagctaactgggagtctgaggcaaggaaattgtttgagcctaggaggttgagagtgcagtgagccgtgttgctgccactgtactccagcctgggcaacaggacaagaccgtgtctccaaaaggaaaaaaataawaaagcactgtctctctctacccttgcagtatccctgtaggagagagttactattagctcccagtttataggtgagtgatatggtttggatgtgtccccacccaaatctcaacttgaattgtatctgccagaattcccrcatgttgtgggagggacccagggggaggtaattgaatcatggggcccagcctttcccatgctattctcataatagtgaataagtctcatgagatctgatgggtgtatcaggagtttccgcttttgcttcttcctcattttctcttgccactgccatgtaagaagtgccttttgcctaccaccatgtttctgargcctccccagccatgtggaactgtaagtccagttaaacctctttttcttcccagtctcaggtatgtctttatcagcagygtgaaaacggactaatacagtgaggaaatccatgtgttaggaagggagtgtggttgtacttcaacctggaactgtctaactcytaaggttttattaatatctagtccatttctctcaatctaatagtaaatggaagagaagcamcaacttttgttttccaattccttttgaacatttgaaaggttttctgaaaggacttaaagaaaccatagcttccttaccagttcccaaagcttcagtccttaccaaagtgtacattgcctttaaggagatttgtttccatcaatccctcccatttacaaggaattacagaagagtgatgcccccttcaaagtggctcacacctggctgacatctgttcattaagaatgcctgcctttgggttctaagacgtccaaggagctcttatgggtaacacctgtagatttatagacgttcctctctgactgtaagggccatatgcctgaatctctcacccccatgtttataaaacttaacaattgtggaagcaatgaattgaaggactagggtcaccagtggagtcccataaataggttgtttatgatccctgtgaaacaagaagaccctyttaatttcatgcttcttaaactggggtatgagtggccccaggtttccctgttgggggtactgataccagagttcatttgaagtcattggaaaccaaggcatattttcttaaagagacaactgtttttggtgaataggccatgttgtttatagtwaaaacaaacatgaatattctgtaatagaagatatcgtttgcatggtgttttaaagctaaaacttgagttattaaacacccttctctccctggggatgccttttgctatggggttgcatccacggaagagtttgaaagcccaaccatatggacatcatattattcatttttatttgccatccagagcttgccagcaaccttttagatctctttccttggaaggttcagcaagatgcttgtaaatgtatgttgctttgttgcagacaatgtatatttaaaaagcaattatttgcccatctcttgttcaactcagatattgactgcctttctgtatttctggctgggcattgtttatctccacctcatggtttttactatggttctagaggtctagcctacaaagagaatgcttcccgtccccaccactacccacaggaccctctgcatatctcagaggaatttctcagtgttccagttaattttctctctgtttcctttattacttctaagttccattgcaaaaatatgctgcctgctctgtcagccaccctatatgcctatttagtcccagttttccagcttctatttttttccacataatccctaaccatgataatacaaatataatagaaataattatgtttgtttaaaatatacacagaaccaaatagtcatagagtagtatttcaggtggggggccctcctctagggcagtggagacaatgtcacctgtcgggaacatttggcaatgtctggagacattgttggttgtggtgcggtgacataactattggcatcgagtggatggagggcaggtgtgctactaatcgccctctattgcacagggtggcccttaccacagagaactatgcagctctaaacatgcgcagccccaaggctgagaattgttgatctaggggaagatgtgatttcattcttcatgcttgtaaattattatttaagctgtgaataccctctcttttcccactgaagttgtggttgtaagattctcagagttgagcagactcggcaacattacagaaaaaaaatcaagatgtaaaaaggatttagacgtctggacgtggtggctcatacctgtaatcccagcactttaggaggccgaggcaggtggatcggttgaggtcagagttcaagaccagcctggccaacatggtgaaaccctgtttctactaaaaatataaaaattacctaggcgtggtagtgtgtgcatataatcccagctactctgtaggctgaggcaggaggcagaggttgcggtgagctgagatcgcactacttcattccagcctgggcaacagagagaaactgtgtctcaaaaaataaaataaaataaaatggatttagaaatggtacagtcagaggttaggggtcgggtcaaagcgatccccccagagacctgtggaaagtgtggttctgtctacaagctgcgaccatggtctttactgcttctgcaaatacttgacaaaaagggccacactcttagctggacttttcctccctttcctgaaacaatgcccttcccattgtcaaggcagaagcagcctccactgagaagcgtcagacaccacgtcagtcttgctttccattgctttgctccagtatccatttgaaattcagtgcaaacccataaattccactttgcctctggtagcagcctgcatggtgtgtatattgaacactagaaacacagtaaatccagcccatttattcacattaaccagcaaaggcattctgcatgcccatgtaaatactggaaattactgacatggccttctagaccatgaaaagacagaagcatatggcagaattcatatgtgaacagattgctttttctcataagaacgctttattggaatatcaactattacagctttttgaagttactcttcctgctcttgatttaagtcctgaatcaccccactactctttttttttttccgctgcattctgctatgtatctttacatctgcttcctgcactttctaaatggcctacttaaaccttgaggtaggtccttcagtttcccataaattaataacacatctatgaatatttcccagccagtcttagaagccccagtctattccaataccaggattgtaaacacagggaatagatgaagcaagctgcttctttcaaatgctcttccaatatgaagcaaaatattattgatctagactgcctgctactttcatttaccatgttactrctcgtgggattacaggcacaaaggtttcataaatttcaaatgaaatatgaacatttgktgtcaaagtactgttaaggtatgaaaaccctgctagtattagttcccttttgttattattctattattattattattattgtgtttacatccacaggcaatcacatattttaggttgtggggagcaaagcagcttccccccactttttctctcactccaatttgaatcctcccatatgtccctccctcattttttaagcaggaaacaatgaatgagtttttgctcctcttgccctatttgccgtgtctcttttctgtgattcgggagcacattgatacccttcttttggagcagagaagcttgtctttcatgatagaagtaggtcatgggggcggttagytgacttcatcagagagtagcatgcagatcccacctgtgaggctatggtctgccaaggagagttcagcgggctggatcagagagagcagagccatgctggcaagtcggagtctttgtggaaagcagccaaggtcacagctggaaataaaactgtgtattccaaatcagaggggcaatgcaggaatggatcaaaggaatgaaggatcaagttgtcagccaagagaaccaagagccagacacagggaacctgtgacaaaaacgaaaaccaataaaaacatatattgagcattgaccaggtgcccaatattttaatgtcccatgggtgtgcatcaggtacgctgtggaaggacagatgtcattccttaaaggggctgsactgaattagaccaggggttctcaaagtggggtccctggaccggcagcatcaccatcacctggaaacttgttagagatgcagatcttgggccccgccccagacctcctgaatgtgaatctctggtggggagggagacgaagtgggagcctgtaggctgcagtctgtgttaagctttctgggtgattctgatacacggtcaagtttgagatgtagcaggagaagcaggaaacataggagagaagccactaggggtgggaatcagaaatacggtgtccctgcctacctaggggctacattcctccgggcaagtctttttaactctctctgcctggcaacttccttaacaaagagtgatactaatacctgccttcctgtctttgccacatcacgggattttctacagctcatattggttacagtgatagcagctgagatttaggctgcacctgagtaccaggcagggtcctaagtgacttcagactctatagacagtccctgacttataatggtttgacttagattttttcacctttgggatgctgagaaaaccatacacatccagtagaaaccgaactttacattttgagtttcgatttttttttttcacctgggctagtaatacgtggtaggatactctctcacaatgytaggccacagcagcgagctgcagctyccagtgatcacaagggcaaagaatcgatattctaccaggcacggtgttgcctgataaccttgcccagctgtaggctaatgtaagtgttcttttttatattttctttaatttttttaaatttccacctgttttggggggggtacaggtggtatttggttacatgagtaagttctttactggtgattggcgagactttggtgcacccatcactcgagcagtatacactgcatccagtttgtactcctttatgcctcacccttttaccactctttccctctcagtccccaaagtccattgtatcattcttatgcctttacatcctcatagcttagctcccacttataagtgaaaacacacagtgcttggttttccattcctgagttacttcacttagaataatggtctccagtcccatccaggttgctgaaaatgccatcagttcattccttttcatggctgagtagtattccattgtatatttataccgtagtttctttatccacttgttggtagatggccatttgggctaatttcacatttttgcaattgtgaattgttgtgctgtaaacatgcgtgtgcaagtatgtctttcatataaggacttcttttcctctgggaagatacccattagtgggattgctggatcaaatggtagttctacttttagttcttcaagaactctccacactgttttccatagtggttgtactagtttacattcccaccagcagtgtagaagtgttscctgttcaccgcattcacgccaatatctattattttttgcatttttggtaatggccattcttgcaggagtaagatggtatcgcaaatgcaacaaaaacaaataggtgggacttaattaaactaatcagcttttgcccagcaaaaggaacagtcagcagagtaaacagacaacccgcagagtgggagaaaatctatacaaatctatacgtctatacaaggactaatatccaggatctacatggaactcaaattagmaagaaaaaagctaacaatcccatcaaaaagtgggctaaggacatgaatagacagttctcaaaagaagatacacaaatgaccaccatacgtgaaaaaatgctcaacatcactaatgatcagggaaaggctaatttaagtgttctgaacacatttaaggtaggctcggctaagctatcatgttgagtaggttaggtgtgttaaatgcattttcatcttatggtattttcaactcggtatagggtttaatcccatcctaagttgaggagcatctgtatctgttttggtcctgacaataccccatgaaggaggtgcaattacccctggcttagggttgagaaaactaagaggtttagtaatgtgcttgaggccatgctacctgtaagcaagaatcactccaggtttttcttgtttcaaaactcctgttaacaactgagttgctatactgttttagtaggtcaagatatactatgtgtttcaaagggcttataaattataaatgctacttaaaatgatgtaaagtggtattattgttgtcatcatgtatatattttcaactctctcattggcatcttgaggtttctcttctatgaaattctttgccctaggatggtcccctttgtcaaagagagacacattctgaacaaggtcagacaacacagatggagtttggattcgggcactggtgacagtgaagactcagatgaggttcttgagtactttcaattaggtttaccactgaccccatcagtgtgcagacgaagggagatgagagatacagatggttaatgggatttttgkrgtatcttccagcctttgtgagcacagaggtttcgctacattttgaaaattaaaattcatttcattcgcattacagattttaaatcctagctcctttttaagcttttaattccaacttgcatttcttattattctgtttacaaacctgacaaattttagcagtcgttttgaggagatctagaataatgtttcatctcatttttgaatttaggtacagaccttaaaaatattatgctacatttctaatattaatatcttgctttcttatttaggaacttttcctgacaaacttcccaagaatgtaattttgttatatccatatgataaaccttaagtattcttaagccaggtgcagtggaattcccctgtagtcccatctactaaggagactgaggcaggaggattgcttgaggcctggagatcaaggctgcaatgagctatgactatacctgtgactagccactgcactccagctgggcaacatggtgagaccctgtctctaaaaacaaacaaaccttaagttttcttaatgttctgacacttttataaatgtagtatttcaacttatggtcaccattctgtaatgattatcatttgtacatttaaaatagaaactgttaggccaatgtgttattctagaataggacttgacagactttttttwaaataaaatgccagatagtgtttctagctttgcagttcagatggtgtgtgttacaactgttcagctctaactttgtatgaaagtagccataggcaatacacaaatcaatgcaccatctgtgttccagtaaaactttatttataaaaacaggtcacgggccacatttggcccatcagccatagtttcccaacctctgctttggaaggcctaactcagttaaacattacaagttcatgcagcacggtgtgatggctcacgcctgtgatcctagcacttttggaggctyatgtgggtggatcgcttgagctgaggagtttgagactgggcaacatggtgaagccgtgtttctacaaaaaatacaaaaaaaaaaaaaaattagccaggcgtggtagcttgtgactgtactcccagctacttgggaggctgaagtgggaagatatcctgagcccaggaggcagaggttgcagtgagctgagatcgtgccactgtactcccacatgggtgacagagtgagaccctgtctcaagaaaccgaaaaacgaaagaaaaacaagttcatgagataccacatacgtgaatatatgctaacacagcagcattattttttggttaatcaatgattatcaatgcttctgtgattttaaaaaggagagtcagctattccctcttctgcccgctgatatctacagcctctaccagatggtacctcacttaattgaggtttgccttttttcaggctcttctaatgatcttctggccaactctaaatcacctttaaacttcatggaatttatgcattcttgttaatttatatccatgtaatatcagggtatttctctttgtagctgcatcttctaagataatggtttttcatggagactggcattgtcccgtccctatgagggggacatttgggaatggcatttttagtactcacaaggtaactggggcactcttggtcttggggaggggaggtggctggggacgcagagggtcctgcrgtgggtggatacttacaacatagaaatgtcctggctcttgatgctggctacaccctcagtaagagatactgtcctagggtcatttttttcaacccacactagttacgtggactgtcttagtcagtccaggctgctataacagaataccgttgactgggtggcttgatttttttttttttctcccagttctggaggctggaagtcagatrtcagggcaccagcatggttggtttctggtgagtgctcttttctgcatttgtggacagctgccttcttgctgtgtcctcacttagtagacagagagagagagagagagagagagagagagagagagaccatctctcttgtgtgtctttcattcatgagaactccacctttgtgaccttattacttctgagaggccctacctccaaacaccatcttattgggtgttctagtttaacatatgcatttggaagagagaggaacatattcagtccatagcatgaaccaaccacgtgcacagaggtgtgccccaatttactgtcagtgcagccttcacaggcaggaaacccaccaggtccaaggaaggggcactcagctgttacctcctgtcataggaccattcctcactgtgccatcatattatacttccatatcgtgtgtcttgtggcattcctgggcctrcagtgagcctgtggccacctcatagtcttgttggccacagcctctagaaccagggattggaggaacagccatcgctagcatggtgcttggcactgagcgggtgcttagtgaatatttattgaatgatttccaactaatggaagaaagctgaatagcacaacacccagaggattgaggtttattgaaaaccaacccaaagggctatggtgaaaatcatctcaaaaggcagagggcaagaaattgatatttattgagggctctcagtgggtgttgtagggggaaggaagtacaatgtcctggagctaggctgcctaggtttgaatccagggtctgccagatgtagatgtgtgatcttgggcacgtttttcaacctctctgtgcttaatcttctcctctttaaaggtgggctagtgatagttacctcacaaggtagctgtgagaatgaaataatgatacataaagcacttataacaggacctggcatgcagtgagtatcagtgggtatttgctgtggttatttagttatctactttacatgtacatgtaaagaactagggatatctgtattaagacagggtcttgttatgtttcctgggctgatctcaaactcctaagcttaagtgatcctcttgccttggcctcccatagtgctggcgtttcaggcttgagtcactgttcctggcctacttaccttctttttgatcttctgaagtcaccccctccatctgacaggaggttgaaggtccgatggccacataggtggcagtgctggaatttgaacccaggccttcctcccttacctctctctacctctatctcttctatctacctgtctctactccctctccctacttttctctttttcccagcctccccccgatatactcaacatatatctccctctccctccacccacctgcctcccccacactccttctttccctctcctctgcagggagagcttggaaaccaagagtctatgagctcgaagggagcatgcaaaggtgccaggcaggccctcaaagctgggaagctgcagtaggggttctttgggacccagttaagcagtgggcccttgctctgagatgcagtctgctgagctgccatctggggacacatcttgagtttctctccatgatggcgcagctctcagcgtaaagcagtctatggagtgagaagggaaaaggccccagtaataaaaggcaaaggaagccctggtgaagtgactcatacctgtaatcccagaacactgggaggccgagatgggaggatcatttgagcccaggagttggagactagcctgggctacataaaattatatatatatatatatatatatatatatatatatataaaataatgcagaagttttatatatatataaagttttatatttatatctataaagttatatatatatatatatatatatttatttattttcaagacatggtggcatgcaactgcagtgtcagctactccggaggccgaggcaggagagtcacttaagactgggagctcgaggcggcagtgagcagtgatgactccactatactccagcctgggtgacagagtgagactttgtctcaaaaataaaatataaaataaaataaaaaggaagaaatagccagtagtgctttcttgtagacagagaagctggtgaaatgatgtaaccaggctgggcatggtagctcacgcctgtaattcccagtactttgtgaggctgaggtgggcagatcccatgaggtcaggagtttgagaccagcctggccaacatgataaaaccccatctctactaaaaatacaaaaattagccaggcacagtggctcatgtctgtaatcccaaatgcttgctcgggaggctgaggcaggagaatcacttgaatctggkaggtggaggttgtagtgagctgagattgcaccactgtacttcagcctgggcaacagagcaagactctgtctcaaaaaaaagaacaaaaaaaaaaaaagaaatgatgtaactggtagggagaaagccaaaggttagaaagagaacatgaattgagaatggaaagatcgcagaggaagcagatttgtctgcacacctcttgcatgtgtatttggagaagctctgtgtgctgcgggtcgagggaaacacataactggaacaactgtccttttccaccattgttaaatcctgctttgctcactgcaggagagggggattatataggagcttctggaaacagatgccttgggagctctcctccttttccagaactcccacacttgctcttgtagatcatcataggataactctccgctccctttcctaagaaaattgatctaaaaagtaattatggaatcttgcagtgcttgttgggatcagagaaggctcctccgatgatgggatgttaggtagagggctgcagggaccttgcttttagtcaggaggcaaatcaagagccaagagagggaggggtggtcgtgagtttttatgatgttccttctcttctccgctccttcctgacaagagtctgtctcttttctctgtgtgtcataactacccacattcaccccggcagcccatctaccttgtttctctcataagtcagcttctctcccatctttcctgtgaaaatttctaacaaaatgggagttaaggccgggcatggtggctcctacttgtcattccagcattttgggaggctgaggtgggaggattgcatgagctcaggagttcaagaccagtgtgggtaacatagagactctgtctctacacatttttttttttaattagctggggatggtggcttgcacctgtagctccagctactcagagggaggctgaagcaggaggatcccttgagtccaggagtttgaggctgtagtgagccctggtctcaccactacacttcatcctgggcaacagagtgagatgctgttttgtttttgtttttttttgtttgtttgtttggttttttttggaaaaagaaagaatcaccataaaaaagatgggtaactcrgaaatttcaaatgcttgaatttcttgggttgggaagaatatcccaaaatgtgtttccaactacctcactgattttgacttcacagggagaatattttgatttttatgctctgagttgctggtactgctgtgggcacagaactgggtatgacagaacatttttctgaactatgactctgatcttctcaatctctcagtgggaaagagttttggaacttattatttttaaaaacttggtaaaagatttataccataatatttatcattttaaccatttctcagtgcacaattcagtggcataaaagggcattcctgttgtgcaaccatcacccctatccatctccaagtgaacttgattcttaaatctcccagccatctgtttcaattcactagatgttgttccacccagcacgtcatggtggaaaggggcaggctgtgattttttttttttttaacctccagcagctgtgttccctgtggcaactatgtaacctctctgagcctcaacatctgtctataaaatggaaacagtgcaacctaccttagcatttgatgatctcaacttggatcccatagcgggtatctccaaaatttcctcatcttgactacgttctggtgaaacttaagatgtcagcacatgacctacctcccttcccttctcattcatctgcattttcacaatgcttggttttatcttttatacatataatgcacaatacatgtagtgccaacaagaattatagtttctgtaagtagtgtatgattgcccacggatcttcagtaactcattaggcactgacgggctgacatgagcaacaacgagacttagtatctgttgcagctctccatacagtttacgaaactctaatccataaaagccgtttgaaatttccattaggagatttgcacaagtggttaaaattagtcatgcattcttggtctaaactgcaggaagggtatctttactgtgaaaatgattatgacatgttaaaactgtgtaatagtaagcagacagttttccgagctgctgggtgaattctggaaatgctctattattttctccctgttgactcctttctttcaggcaagacagccagcatgttgacttggaaaacaactgaggctgagcagtttcagagcattgacattacgtggcttcttttgtgggccaccccaactcttttattttttttaattgctgcttcttcctctaaaatacaacttgttttttttttttttaaagaggaggaagccttaaaaaccagcgacagtcttggttttcttaacctgtccgccatttaacatttctagaagtgcaacattgcttctaaggtaagggcaaggaccatgacttttgcatgctgaaaatgagctgcctggtttattgagttagttattcctttttagtgccgcagtgttttcagtgttagagaaaaggctgtgattttctttgatattaaaaagccaaccacttatattttccaaagccatttgcattcagtctgacggccgctaaaaatgtatgtggatttttcatctgagaggttttctctatgcatattgtttacatttatcaaatgttgtcctgcccagtactttatattcattgttgcttccggacctagctgacaacatggtctatatgaaaaacaacacaaaacaacacataagagagtcaaagggacttctttggggagaatataaaaacaagccaaggcgaaagtggctgtaaaaatgcgttgtgttcccaagtggaggctccttctttgttctgtcatcagtttgtcagttgtcaatcaaacctcccttcgcctcacacgtttgctaatgtaagaagtgctggctctgctcttagcctgcagtggtgcagcttaaaaattctgggagggtttcatgcagtaaatacttaaartaacagaaaaggactggggaaaagctgatgttgtagctgtatgatcacccatgtaaaactgtttatttagttatttatttatttatttgcttttttacttccttttctatgcctttggtgactttgtgtaatgctgtatgtaccatcagagcacatactgcttttgtgcacacatacattgaaaacaaaatgaaaaaacaagaataaaacaaaaaccctattcctattcctacaattctggtactttgccacaaggtggtggtagtgtatcttgagtaaggaatatgacctgctagatataagcatctgtttatttacacactaaggaatgtttgagtgtggaacgtggtttagatgctgtgcgtacagcagtgactcagataggtgtgtattctcaagaagctttcattctaatgacacatactttgtctccagtcagagttatggcaggttttttttttttttttttttttgactaaattcacccatatttgatggcaagtgtgatcacagcatgtttataaaaatcattcttaattaaggcatttccatcttatcaagccccctatttaataaggatatcaaaaaagaaaacagttttcgtgcatatgtgtagctttttagattcactttttccttatttgacccatataaactttgtctgtctgtgtctgtcagtctcacacacatccttcaacacatctcttatttctttccagagccaggctaaagcacccttgccatcttctctctctgctgttaaattagatgccttctccaggaatctctctgggggcatcctgagccttcccgattccatttcagatttctttctgtaatcaagagctccatctctgttgctttcctggggctcttcctctcctctttttgaagcttttcatttccctttatattctttcattcgtcaactacaaagaagctgcaggcaggaacaagagagctcagcacacttggtgcagtctctctggcttggtaattggtcccaagaaaatagtttttttccaattatggcaacattgaaaacttatccaggagaggawaggctctttcagctgctctttctcgatccttgcagtttcccttttgacctgtgggtacacatggtactgacgcrattggcacctcagatggttcttcctgacagctacccttgcamctgactcaggatacaaactacctttttttttggagacagatctcactttatcacccagtctggagtgtaattgacgcaatcctggctggctgcagccttgaccttctgggcccaagcagtgttcccgcctcggcctcccaaagtattaggattacaggcatcagccgtcatgcctggcacaaactgcctttggaagtgaatcagtcagttgcctagtaggcctaaggagaccatgatccatgtaaaccatggaatattttaagcagaaaagaacgtattccccttcaaggacaaagtgctggaataattgacatccaggttatcacagagccttcctatagtgttgattctgatcactcaaataatcttagtgttaaagggtttatttttatttttctaccttcttttaccaccccttactcccatcagagcaccatcagtcttttgggaataaaataattcctcagatatattaaaaagctatagaagcagaagttaacgtacatgcaaaaatctctacatttctcaacaattgtgtaaccactaaatatagggaaagaagtgtgcaaggtataagacattggccatgcgtccttgtctgtgccacctcaccaggagcattgctcctttttatgcacaagcatcagaggttctggacatcttcttgggctagttggtatagcttccttctcagctcattctgcaaggtttgctttggaaaagtctgtgcatctgagctctctcttgccatatcaggaaccgaagtcagaaataaaggctacagatgctcaaaatctgcagtattcaatctttttaaggcccagcatggtgtctcatgcctgtaatcccagggctttgggagactaaggcgggtggatcacttgaggtcaggcattcaggactagcctggccaacatggtgaaaccccatctctactaaaaatacaaaaattagcctggtgtggtggtgcacacctgtagtcccagctagttgggaggctgaggcaggagaactgcactctagcctgtgctagagagcgagactctgtctcaaaaatataaataaataaataaataaataaataaataaataaataaataaagtatctgtccccaagtcacaatgctattcggttggtgcaaaagcaatcgtggtttttgccattacttttaatggaatagtaaataacacttgatctttggtcttctgacctgaaatcccatggctaggattgtcagatagaatacaggacacctggcctgttacagtggctcacacttataatcccagcaccttgggaggcagaggcaggaatatcacctgagcccaggaatttgaggctgcagtgagctatgactgcaccattgcattccagccagagtggtagagcaagaccctgtgtcttaaaacaacaaaaacaaaaacaggacacctggttaaatgtgaatttcaggtaaataacatattttttaaaaatgtatcccatgcagtatttggagcatatactctaaaaattttctttgggatatacttctaagaaatgatttgttgtttatgtgaaactcaaattttactcggcatcctgtgtttttatttgctagacgtagcacctacctgtgacatctttttgtttctgccctgctgtgtcacagggtcttggtatctttcctcctgtgattctgacactaccttgggaaatgactctgtatcaagcgtttaccatctgctgaaagctttgcatactctgttgcttatcatgacaactgccctgaaagttgggtgtamttgttacccctttccagattaaaaaacctaggggtcagagaggttaagtaacttgctcaagacctcacagtgaactgtggtggaccactgggattagaacccagtgagttcagtggctttgcctccaagtgcgtttattattgtccgcactccaaaatggctttaaaaaattaaaaagatacatgacgttgaaatcagtgacagaggcataaggctccttgagggaagaaaccaggtgttggccataaaaaaattatttttcacagcgcycagcaaagggcttgtatgcaaaggaccctcagtataagctggttgttgactgatgtgtttcaagagtaagtcagaaaaataaaaagaaggcagggaaagagttcaaaactcagtgtcacttgcacatccattttgccctagaagtgttttaaattttatcaggctcataaactatgtttcgaaacgtgaaaataaattggccccctgaccccttatgaagtgacatcattcatctgaaaggtttatcgccctgcgtgtcattttgaagttccctactctcctcctcgttctctaaatccatgaaaaaatagaaatgggaggaagaactggagagaggggttctgtgtgtgtggaatgtggctctggaaagcccccagccctcctgttaacacaatgcttttatcccgtaatctctgcctgcgggagacaaaataacagttcatctggaaaacaagattaactcatttaacttacgtagtgatcacagagagaagcttgttggagttgtctggctgaaggaaagcccgcgattctcggccattccggttcacagggcctgggtagcgggcccagcctgttgcaagtaatcgggctctgtcagatcagccttggtgagattgggatattaccagggtattctgttcatctctgacacaggccctctcaatctgatagacggtgtgcctcttctcttcattagaacatcttcctgaacacttgcctgtctgcactgccctgctaaggggttttcaggtgagcgtgctgtgggtaccttcacatttcaggccttttaacagggaatgaaaaccaactgccctgtgattccaagtctgctgatgcatgtgaaattggctttgtgttggggcctcttcttccaaagcaacagtaagcattttttttttttttgtgataatctctctctgtcacccacgctggagtgcagtggtgtgatctcagctcactgcaacctccgtcttctgggttcaagtgattctcctgcctgagcctcccgagtaactgggattacaggcacccgccacccgacgcccagctaatttttgtatttttggtagagatggggtttcaccatgttgcccaggatggtcttgaacccctgatctcaggtgttccaccctccttgtcctcccaaagtgttgggattacaggcgtcagccaccgcccccggccgatagttgcctttcttaccagcctgggccaggagcagttgtttattttctgctatttcgtgtgtttctttttgctggcagtgacatactcctacagggatgtctgcctcatgttgacctgcttgtgtttaccacctagaggcctaagaacaggctttccccgttcaaatcacccagtggcgtgcacacttggggcacctggggactggtttcctgaatggcattgagagtcattactttccacacacagttaactgcagggagatttgtctctgaaagtagtcttcaagaaatgcggcagctgcttctagccgctccatccttccttttcccagtgcgcactaaccctccagagccttccgcatctgctatgcagcattggccacrccagtgggatgcaagaatttatcccttctgttgatgcaattaaagctaatggatctcatatatatatatatatatatatatatttatataaatatattttatatttaaaaatatttatattttatatatttttatatatttatgcaagtatatatctaaatatataaaatakatataaatatatacatatatgtgtatatatagattttgttttttgagacagggtcttgctctgtcactcaggctggagtgcagtggcgtgatcatggctcacygtagcctcaacctcctgggctcaactgattctctcatcttagcctcctgagtggctgggaccgcaggttcatgctaccgtgcccagctaattgtttaattytttgtagagataggatctctccctttgtggcccaggctgatctcaaactcctgagctcaagcgatcctactcactcggcctcccaaagtgctgggattacaggtgtgagccaccatgccaaagcctaagggaccttagaattttttctcctttcttttcacattttgttttgtgcttgcttatttattgaaatctggaccacaaataacttacatgtttgtcaaggccagatttcaggacctaaccaacacccgacaggcatcttagaaagtggagggtgtaagttataaagagagattacttccaacacgtttctttaaagcctgctggctaaattaggtgggrccttmtttgtgtcctctctgttcttgctagtctggcctttgtataatagggaagcagatatatctggaagcctctaagtgtgcatcatggaaattgtttgaaatgttcaaagtgatgtggatgtatatatacgttaaaaaatatcactttcccttttgaagacatttactatttctatggtttgtttagcaacagcctggctgaatagttcttcaaaaaataggaacatgatgctcatatctggccactgtatatgctttggagggaacttgaagactaggtggctgcagccactcagaatcttgttgaatatttaacatttttttgtgaatgtatcaactaagaagactatcaattttagagcatacagctgttctagaataatagtttgaaaggccagccgcaaagattgtggtgattaaagtgtgagcagatgacggaatgataaaccttaacgcttaaaaatgtgtttttatagtgccattcctatataacatcgtctgataaatgtatttgagacgaacaggccaaatgaaagaaccttccataaggggaygcagcacagtttgaatataagtgttccctccaattcccatgttagtgctttactatgagtattgaccagtgttaaagagtgagcgcacaggagccttctcaaagcctcctgcacacactctcccactgtaaatgcacgagtattgatcacaattattccgtaaacacatcttacaaattccctcagtgcacgcgccatctaaattaatccaaattcagaacaaasctctcttggaaaaggaaagagcatctctttcaggagcttccctcttggacattaaatcttccataatctgtgctagttcggcaaagaagccccaacgtcctcccaatcatagggcgcctgagctcttggtctcctatatcttatattcattatagatgtcttatatccattcctgtatcctttgtgatgtcttgagtgagaaaatgctctgaccaataagccaatgttcaattgacttcgaaatgttatgtgggataggctcattcagggtggtacggctgtagacaaaatgctatatgcattggctgggcgcggtggctcacacctgtaatcccagcactttgggaggccgaggtgggcagatcatgaggtcaagagatcgaaaccatcctggccaacctggtgaaactctgtctctactaaaaatacaaaaattagctgggcatagtgttgtgtgcctgtaggcctagttacttgggaggctgaggcgggagaatcgcttgaacccaggaggcggaggttgcagtcagccgagattataccactgcactccagcctggtgacagagtgagactccatcttaaaaaaaaaaaaaagtcttatattgattaaaagagacttaagacacatagtaccagatggattgtgtgatgctcattttgatttggatttaggggaacctgctctcaaagacatttttctgagacaaataggaaaatttgaatatggagtagctaatagatagtattaagagagtagccttcattttttaaagtataataatattttaattgagtttatgttagagatgcataccgaaaaatctacaagtgaaatgatatgataactaagacttgctttaaaataatgcggaaaaaactgttagagtaatagcgtaaataattcaagattggaaaatgttcatgttaaattattgttggccgactgtgggttcatttaattaggttctctgttttggggtatgttgaaaatttttcataakaaaatattattcagaggtctcaagaggcaggctgccaagaatagcagttagaaatagctagtatcaggcctggtgtagtggctcatgcctgtaatcccagtgctttgacaggctgagggaggagaaytgcttgagcccaggagatcgagaccagccagggtaacatagggagaccctcatctctacaccgaatttaaaaacttagctgggcatggtggtgcctacctgtggtcccagctgcttgggaggttgaggcaggaggattgcctgagcctggtagaggtggaggctgcagtgagctgtgattgtgccactgcacttyagcctgggtgacaaagtgagactctgtctcaaaaaaaaaaaaaaaaaaaaaaaaaaaagctagtagcacaccccaaaacttctagacagggcatggtgtgagctggartagacaactagttcatggtaacaggaccagcagagctccgtcttgatgctgttattatttggtatctgttaggagctgaattatgtgtccccaaaattcatgtgatgaagccctaattcacagtacctcataatgttactctatttggagatacarccttttaaaggatggttaagttaaaatgaggttgcttggatggtccctaattcagtttaatttgggtccttataaaaagaggaaatttggatgcacagagacaccaggaattcatatgcatggaggaaagaccacagtggcaaaagacacattgaggaggtggctgtctgcaagccaaggcaaggggcctccggagaagccaaacctgctgacaccttgaccttgaatgtgcagccttcagaactgtgagaaaatcaatttctgttgtttaagccacctagtctgtcrcattttcttatggcaacccctgtagataatacagtcccattctctggggaaacagatacctccgccagggtcctgatctgaatatgatttggggtgatggaacagaaacacccgaggastgtcgttggggaacaggaaacctgtctgtagtcctggctctgtctccaattggctacgagggcttgtgtgtactctagttctctttccgtgacactgcatttggggggaaggtaagggaactggggaaaagaaggcaaaatgatgacttaaagagactgatgaacccaaagctctcttgtgaagccccttctagaataagtccgtctcacgttacagtgcttaggaagtgttagatgtactgtcatttcttcaacatatatgtcctatattagtctattctcacactgcwagtgaagacatacctgagatggggtaatttgtaaaagaaagaagtttaacggactcatagttgcacatggctggggaggccacacgatcatggcggaaggcaaaggaggagcaaaggggcgtcttacatggtggcaggcaagagagcctttgcaagggaactgccctttataaaaccatcagatctcgtgagacttattcactgtcacgagaacagcatgggaaagacctgcccccatgattcagttacctcccaccgagtccctcccatgatacgtggggatgatgggagatacaattcaagatgagattttggtggggacacagacacaccatatcatgtcttggcagccatctatattcaagacactattctaggtatgacataaaggatggcaaaaagtcagttacttaaaagtgtggaagcagagtgtcccaggcggaggaaacggtaaatgagacctctggtagtaagaagcagtgtagcatgtttgagacactgaagtccaatggaacttgggcggaataaatgaagggaagattcaaggtgaaggctgagaggtgtgcatgggtctgatcacacagagccttgtaaaccaaggtgaggacttaagattttattctagctgcagtgaggaaccagtgagtggttttaagccagagagagattgataagacatggaatgatatggtgtgatatatgaaatgacatgtttgaaatgatagatgacgtgattgtgatataatatsatgcggctgaggacaacactataactgctcggtagagaatggattgtcatggcctgggtgtggtggctcataatcccagcactttgagagctccaggtgggatgattgcttgagcccaggaatttgagaccaacctgggccacatagtgagaccccatctctattaagaaaaaagagaatggattgtgatgaattaggattggaaacacagagatcagttagaagatttatcagtgagaaaagagttcagttgcaagttaaagaaaacacaagtaaagctaactgtaacacacagagctttgtcttttcttgctgaataagaagctgagagggaggcaattgctgtcactggtccagccggctcagcaactgcacatttgtcaaagttcttcatccccagctttgtgattctctaggttattcattcttctgggatcgtagatggccaccacaggttcactgtggaaagaggggtaggaatttttaccagctgggtctgactccaccccacccccacccctacccaccgttttttgtttttgttttttaagatgaagcctcactctgttgtccaggctggagtgcagtggtgtgatcttgactcattgcaacctccgcctcttgggttcaagcgattctcctgcctcagccgagtagctgggattacaggcacatgccaccacacccagctttttgtatttttaatagagacaggatttcactatgttggccaggctggtctcgaactcctgacttcaggtggtctatccaccttggcctccccaaattctgggattacaggcatgagccaccgtgcccagccgtgtctgaccattttatcaggaaaagcaaaagcttttctagaatctatcaactcccttctgcatgtgtctatttggcatgggctgtgtcacatgacccctgagctgcaaggaatgctgggatacgatggaagcctgccagaggtagagccttgggaagggctgatagggcctctaacctaaatgtccaccaccagaggtattacagaggtttgagcaagaaattatggtggtcccagggatgatgcattctgataatcattatcatcaagaggaatgtctaaaggaaaggggaaaaaaaaaatcagacagtcacattgaaatgaggtccttaagataggccctaatccaatatgcacataaaggggaattttgggcacagagacagaggcagagatagagggaagatgatgtgaagaaaaacatagggccgtgtagaggcagaggcagagattgaaattgtgctatcatgaacgggggaatgtctgggactgccagaagctcctgaaggcaggaagcatcctcccctccagcctttggagggaatgtggccctgttgacaccttgatttcagacttctgggttccgcaactgcaaaagagtacattgctgttctaagccacccagtgtgcagtagctttctgcagcaaccctagggatgaatgctcctgccaaatgctgcctgcccttcaagatgagtgttatttggcagaggaagatgatgcactgcttattttaggggatgccctcacttttgggtccctatgtcacctgtgtgtactccatgccrgtgtcttcccagcccctgccaggcaagttcgtgtggttctgtgataaccctcatctctataggttctgtgataacgctcctctcactgtgctgctccttgggtgacatcacacccaaggagaatcatgggaccacctccagagagattttcttagaggtgtggaacagaaaaaaaagcgtctctattcgaattgcaggatcttccttatagtcctggagaaacgtggcccagcattgtcttggtccatagcctgagcttaccctccctacgcaaccacagctgtgtgcagcttcagccaggtttgctttacctgatctcactggcttcatgtttattatcttattttcagtttcaaaagggcatatcctgccccctttcccaagatcagaggataaggaatgtcttgatgttctcagtcgtaaaattaggctaataacacctcccatggttgtctgtgaggacaacagaaagtaatgttttctctgaaaagtttaaaagggtaaatggcttcatcacatggtgatgacagtgattattccaagagatggctgtaagctccctgagaacagaggtgctctgtgtaaatctagtctgtctccccaggcttagtggttgacctagactataccaagagtaagtgtgttttttaaatttaatttaaatcaattcattaagcattgctaaattggaaaaccatggaatatagagatccagtagttaagagcctactgggagagacagcataataattacaataagtgcagaacttgmaataatgtaattgaaataatgtaatacaatcctgcttaatattacactgtatatattcattgacttatagactgagctccttatcttgttcattgcyatggctttagcaccttttgaacagtggtgcttggcttttggtaggtggtcaacaaatgtgtattaagtatatgaactgttggaagggtctgctgtgaaggatgtgatttgctctctttgatggtggacaaagaaggtttcctggtggaagagattaatgagttgggttttgatgaatgaataggagtttccccagacacacggaggagacagaatggaatgaaagaggggttttccaagaagaggcactgaagggcaagacttcattgcttctttgatactccaatgccggcttcctttgggttggactctgatggatctaatcgaggattaggatggaggtaggtgggaacatatttagaaggatgccctgtggtttttctccttcctgctatttatatttcyctctctgtctttcccacctgtttggtgatgaggaaggagctgtgtactggtttgaaacctattcacgacatagtggacccaacaccaagtgtcttattgtaaatggatccacttttactacagttactttaatggcatctaaatgataaatgttaataagcatttttgcttgggaaagcacaatggtattagcctgccagactgcaaacgttatttgctttatggaaggggatttcaaacaaggggttctggtggttgtatttttgcctcaacggttatttatagagaaagtatgggccattgcatgtttatagtatctcttttttatggctgcccaagttattattttttattggtttgggtacttaatttgcacatttgtaaacaattatgtagttacacagctgttgtaccacagagaccatatgcatttccatgttaagagaaaagtccgtgagggattctcactggataccatcataaaagaattattgtggtgccaaaaaaatttaaaaaaacgactagctcagaagttatcattgtgtttttatagtatttggagttaaataaatttaatgtttttttgctcacttgagttggagccaaactttataactgaataggagggttctctttcccatatttgagtagaacacatgatgttcaataaaaatgaatttgccagtcagaaaaatttatcttttagaaaattaatacactgagccaagcatgggtggtccatgcctctaatcctaggtactctggagggtgacggtgggaggatcccttgagcccaggattttgaggctaccctgagctatgatcacaccacagcactccagcctggccaacatagtgagacactacctagatagcttaggagagttccaatgtttctgaaggatgtttttttaaaagaartattcatttaggtgacacatatttattgagacactaatatatgccaggaattattctattggtkcctttggaggagacatgaataaaggcatggatgtgactgaggaggtaaaggtgaagaattggggaggggtggatggggctgactcatgacctaaagaacatggcatctggrgctctyttgaaataatctgcactaaccactcattcacatttttttgagtctgtaagatcccaggcactcttggtagcaggggggttaggtgggtgaagggacaagtagaacttagttccaacagagctaaagggtattggtgaagactatgagcccctcatgacgcacaactggtttcaaatccaagcccatcatgtatcatctgtgtgattgtgggtgatctctttcttcccaaagcctgttttcttgcctgaacctgatcaacagaaacagtcagtgcaggtaatgtgtttagcacacagcctggcatacgaacttccacacaaaacgggtgaccatggctgaagggttattctggggagccttccctgtggaagccccattaaccatccctgctcattcctcccgtgagaccaccatttgctaaatcttctrtcaggtgatgtgggatccaagaagaaacaataatcagaagcttgccttacaggcatgcacaatttcgggtggactgtcacatgtgcactgaaaaagtcgagaaatgttatgatggccctggaaggaggagtgtctagatgaaatgcgaataaataggagacaagtgtgtcgttaattaagaaggagaagggggactttaaggttaccttaaaagaaaagagacccctcaatgctttggaagagcctttttaataagctagtcaggtaagttagattgctctgtcttacactggtttagtaattttcatatatacttatttcctctgaaatgtattagtaacatttgtaatttaccaaatggaaaatatcacttaactttaagcttcatcaagttaagaatgaatttgtaaccaggggtattatgttttctcttattataacaaacaccaatcaaaaacaaacaaatacatgacgggaaagaaagaaaacccagcatttattggcagtatttttctgcaaaatattatttgtttccctttgcagttttattcattttaagcacgttttcaccaaagtgttctattctaagctagtctcaattcaatttaaagtggaaggtttttttcagtttagataatttacatataaaagcgttactgtacattttatgaaatgactgttttcagaaaacaacgatttcaatttaatcgtattgttattctgcaagttgaaatgcctcactcttgcttcttggtcttactgacaatattccttcttgccctaattttaaatggtgagtgtttgaaaattgatgtgcttcttttagaccctaccagtaagacttaaggcccactgtgattcgtctgatagacttgaagattatgtgcgcgtgtgtgaaacaagggaatcttaatcatctgaacctgacggttatatagatctttctgaattatttttctttcttttcacaagaaagaattatttttctttcttttcacaagaaattttgcttgccaatggtcagatctgttaacacgaaaactaaaaacttatacatcattttatattttgaaattcccaatttgcaatgttatttttttttcttctttttttttttatgacacttttcttcyggaaaaaatccttaggacccagttactctctttcaggattttatatcataatgtgtctgtgagagacagagccagatgttcaggatttcagaccaccatatttgtcctaggaaacctgccagcatttcacattcttgacccttgaattgaatatgaggctctgactatataacagaaaacacccgagttttatgattctgcaagcgtggtttacactataaatttccaccggtctctgcttgtctcttctagaatttagggttattctcaaactctattatacaagcagtgcccaagtgccttcctccaaaagtacattagatactttcttggggagagaagaaattagacaggagctacaaagatggattaaaattaatttggtcctaactaaaagataagttcctcccccatcctcaggatgaaaccaagagcacttctccatcatcaggggagccaagtggacgctaatcaccaccgtgcctggagagttgcctttcagctggtgaatttactattgccaactcctgcattcttattagtctataagattgaggtcgtttattggtgatcacttgtagatatatatttatataaatctcttagcccagaatctccataaactgtttttcatgatgtggataccacgtgggatatgtcccacaattggcaagtgccataaatatattataggccattatactttctacagtatctttaattgatatgccccatgtctaagaaaaaaagtagyttttcatgatgaaggtgatgaactacttctttccattattctatttcccccttttcttcttcaggctttaaagatatcataataccatttacatttactgtttaatttttaggtctgtatttaaaaatctgtgtagtgacaacaattattcttattgtatgaacatattgtcggctggagagtattcagctgtcagacamagtgttctctaaagtgttcagccatcagacagaaactctattgctggtggcggggttgtgggctgggggaaccagagtatttgctcttctttagaagtcatcaatggtaagcctagggcagcctgaaccacttgtgttagaaatattttttataaagcaggacatgtgctttgaaatttgattcstccgtcactggctgtgtgaccttaaagaaataaattgacctgcctgagcctctcggaaatattggctggccagtagcatcctcacagagtttttctgggaatcgaatgagagattacatacacagggccaggtacatagcaggtgctccgaagatacccccgacttcctttcctacgaataaagaggcccaactttttgtccatatgaagaggttggcagagcaaacgcacacgtgcgtaggagctggaattgtcgataatgtcacaatctcaggaaacccaactttgtaaatgtgactttcctttgctactttttgcctattaagcagccatgtatgtaaagtattaaattagcatccaggcactttctttttttctagaaggtggtattttgcatattaatacttgcttaaatcaagaagctaagactttgtattatattttgctttacgtgccttgattaaggtcatgaycctgacattccagtcccaaaggagaccaaggaaatgaccagcacgtggctcactccctgtctgtccagtagaggacaccaaggcacgatgaccgcagctcctgtagtagttatggtcactgactcygggttcagacggacttggggttcagtcctagctctggcgcttaccagttttctcaagtgactttgrgcatctttactcaaggctcttggtctcagttttctcatctgtaaaatggagatcgcagtatctaactcatgggtgtgtttaaggattcagtgatggagaaaatagctgaaaagtgaccgtatgaaatragcagcagttgtcaagtacttggcatagttcctgtcacataggaagcatccagtaagtagtggtatctgttgtgattatgatcatattttatttcatggagttcagtaagagtacaaagcgaggagtttttctgcccctccagtagctgtagaatttgtgtgatgactatgtgagcttatcccctggtaggtataatggaaagactaacaagagtagaagagggatgtaactggagcatgatttaaaggaactgtagtttgtctctgtttttttttttttttttttttttcctctaaataaacaaaggaatagaagatcctgtgaagagctgggtgtggtggctcatggctgtaatctcascactttaggaggccaaggcaggaggattgcttgagcccagtagttcaagatcagtctgggcaacataatgaaaacctaatgtctacaaaaagtataaaaattagccaggcgcagtggctcacgcctgtagccccacctacttgggaggctgaggcaggaagattgcttgagcccaggagttagaggctgcagtgagccatgatcacactggagcactccagcctgggtgacagagcaagattttgtctcaaaaaagaaaatgatgtgaggaagccaggaatgatgagtacctggattaaactaccttaaggctgattgagtaaaagtgaaagatcatcccgtcaactgctggcctgccrcttgtgttcgttaatagaacatttccctctgattgtcaggctttcttagcagctacagaatacttattttcttctttatattataagtttatgccactgcaacattttagaatcacctgggaagcttttgaaaactcccagcatcatgaagcatggtctcttgccttggrgtcagtgtctgtcaayrtggcttttgctaaagagccttcccctatgagaagtgaggcaggagaaggcggagtgaccacaagatgccctgatggtgccaagctattattataaatgaactgaagccacaacagaagtctgctaccttgttcttatctgcatgtttctctctttccagcctcatcttctactaccttcttctactcccacacttcttctaccttgattcccagccttcttttctcttttcttttcttttcttttcttttcttttccttttcttttcttttcttttcttttttcttttcttttcttttctacctctcgggattctgagagcatcctgtaatgttggaaagctttctgctaatccgggcattggagtgctctctgggttcactcctgacagttctttattgctttcccacctctgccaaggtcaaaaatggaacttgcttcttgttctcgtatcactcagactaagcagttgatgtaacagataacccccaaatttcagtgatttcacatttaatctgtaaaaaatgaggatttgtttrtagccccaaagacagtctagtttggattatttgaggacctagacttcacctgcacagtggtttcaccatccatccccccatggcctccatggtaccctctgattcaggctcagcaggagcgggagaggatgcataggactacatgttttctgggccaggactggaagcagcatatctcagatccaacctctttmccttggcaaaaattcaggatgtgcaggacgaggaggaaaatgggagtagtgactatttagccagtctttgccacatcccggttcatatctcactccgtcatttataacctgtaattaaatctttagtgagtacctgtcacaggttgagcagtcttctagggcctctggttaccagcaatgaaaaaagccccatttggtaaaatacagtagttggattcattatctctgtgattaacttgcataaaaaagagacagttttcattgatgtgacctttagcaacaactcctaaaatattttttttccttcattcctgcttttccttgttccagaagaagttaaggtaaatggcttttagcacattgcacccccagcttttagcacattgcattatcattataataaatgtttacggttactgatattattwtagttctttatcgacattattacagtccattatttacagtccttatgttatttaggaggggaatttggggacattgacccacttatgtgtagtcccctagtgaaatgacaagaatccccagagctgggaaaacatttccatgcaattmcctctcagtttacatcaaaatcakctcgtcacccttgagattgaagctcgcactctgtaagctctgaataaatattaaccatctcctgaaccytgaaggagacattttctggggagcagtgatttgatgatttgatgaagttgtgtgtgtgtgtgtagtttttcagacatatctccatctgattcttacctctaagagttcctcaagggcaattgtgttgctttgtttttccttgcatctctggaggctgagcacctagtagtgattccaggtacgtagcaggtattttacaggtgcttgttgcattaatgcactttattggtgatatggtttggctgtgtccccacccaaatctcatcttgaattgtagctcccataattcccatatgttgtgggagggaccgggtgggasaatattgaatcatgggggtggttcccccatactgttcttggggtagtgaatgaatctcatgagatctgatggttttataagggggaaacacctttcacttggctctcattttctcttgcctactgccatgtatgatgtgcctttcgctttgcactatgattgtgaggtctccccagccacgtgaaattgtgagtccattcaacttctttttctttataaattacccagtctcaggtatgtctttttttttccttttttcttttcttttcttttcttttttttttttttttttttgagatggagtttcactcttgttgcctaggctggagtgcagtggtgcaatctgggctccctgcaaactccacttcccggatttaagcgattctcctgcctcagcctcccaggtagctgggattataggcatctgccaccatgcacggctaattttgtatttttagtagaaatggggtttcaccatgttggtcacggtggtctcaaaatcctgacctcaggcgatctacccgcctcagcctcccaaagtcaggtgtgtctttatcagcagcattaaaacaaagtaataaaattggtttcttagggttggatggcttaaaacaacagaaatrtatcatctcacagttctgaaagtgagaagtccaaaatcaaggtgtcagcacagccacgttctttctgaaggctccagggatgatctactccatgcctttgtcttagcttttggcattgcgggcggtgcttggtgttccttggcttgtaggtgcatcactccaatctgcctttgtcgctgcatgtcattcacattgggtctctctgtctctactccttttcttctcttttttctcctttccttttctttcctcttcccttttcctttcttttcttctcctcctccttctccttctcctccttctccttcttcttctctttgttctccttctagttctcctcctttcttctttcttacttttactcctccctgcttcccttccctccctccctcttcctccctcnnnnnnnnnnnnnnnnnnnnccctcttcctccctccctccctccctccctccctctctccctccctctctccctctctctttttctctttctctctttctctttctgtgtctctcttttctctctctctctctttccttccttccttccttcttttcttccttccttccttttttcttcttttttttggaaacagtcttgctctgtcacccaggttacagtgcagtggcatgatcacggttcactgcagcctcaacctcctggggtcaagtgatcttccccacctcagcctcccgggtagctgggaccacaggtatgcaccaccacacgtggcgtatttttaaattatttgtggagacggggcggggaggtctccctgtgttggccaggctggtttcaagctcctggcctcaagggattctcctccctcagccttccaaagtgttaagattacaggcatgaaccactgcacccagcctatcttaattcaatacacagtagtgctttttgttcccccatgggatagtaggtaaattaatggaggaagggagtcaactaaacaatttatttgagcaattaatggaggaagggagtcaactaaacartttattagggctttatktaaagccctagggttagttggttggttggttttgttttgttttgttcctttttttttttgccaggggatgctgtggttgaatttccctctgtggtgagagttgcatggggcaatgaggaggtagtccagaatagttctatggaaataggaggctttcagtttcttcatctgtacaatgagagttgaggggagctgagtcgggagttgaaatggtcactgggtatcatttccgtgggtggctctaacctgttagggctgtctgcacagtgctgagcttttgtgtttttggtcatcccaatgtgcttttcctttttcctgagagcagccctctacatcttccgtggtgtaagttgccttattccagcacgtggcatcgccagtcccagtgcccttggcagaccatgcagaatgcatccatggaatatgaaaaatgaggcccagtggggcacagtggctcacacctataatgccagcactttgggaggccaaggtgggcagatcacttgaggtcaggagtttgagaccagcctggccaacatggtgaaaccctgtctctactagaaatacaaaaattagctgggtttggtgacaaacgcatgtaatcccagctgctagggaggctgaggcaggagaatcacttcaacccggaaggcggaggttkcagtgagctgagatccagcctgggtgacagagcaagactycatctcaaagcraaacaaaacaaatgagggtcctcatcagcgtgcctttgacactgtcctctggtcctggtgatctgaatacatcaccrcagaactgccagggtacgtgtttcctagcccatagcgagtcccagtgaaagcagagatgagaaagaaaggagggacacaaggtctgggtcctgagttccagtccgtgggggccctggtgctactgctgtagttcatgaaacattcccttcgattctttgaactctctcatacctttcccttaaattcttctttttcscttatgtcaagcttctttcagtaacaacwgaaaggctaatagtagtgctgtgtggggaggactttggacttggggattggactccatgggagaggtcagctccttgtctccctggtggtgagacagggaatggtagagtgtgtcctacctrtgtgcctgccttgctctacatcagtgcttcttggatattttggtatcaggactctaaactcttagtagttatccaggacccaaaatagcatttgtttatctgggtcatttttactgatatttatcatactagaaattaaaatagaaatagtcaaattctttattaattcgtttataagtaagaaacctattacaagtgaacatagataactcccttcctctttcctctctccctccttcctttttttttttttttttttttttttttgagaaagggtctcactgtgtcacccaagctggagtgcagtggcccagtcacaggttactgcagccttaacctcctgggttcaagtgattctcctgcctcagcctcctgagtagctgtgactacggacacatgccactacacctagttgatttttgtattttttgtagagatggggtcccactgtgttgcccaagctggtctcaaactgaactcctgagctcaagcgattctcccgccttggcctcccaaagtgctaggatgatgataggcaggagccaccacacctggccatggataacatttctataaaatataaccatattttcaaacaaagagaaaagtggcgttgtgctacatttcttctccagtgcttggttccctagaagacagccagattctcacttcttttcctgcattcagtctcttgtgatatcacatggcatgtggcctctgaaaaactccgctgtctagttgtaaaagaatacaagtaagtagtcaagtgacaccttagcattctgatgaaaagagctttgacctcacagagcttctggaagggtctcagagacatccstgagggtcccttgactgcactttgacaaccacaggtctacatgatctgtatagccttttccagttttcacatcctatgattccaagagggaaaacaatcttccttgtaaagagagttaagtgacattgtgtccttgtctacactcagctgctaatatgctatgggacctcaggtatgtcacttaaaccttgtgttggagtttcctccttgttacatggaggtcacaagaataacaaactatgcatagatcacctaatttagtcattccaackgtgtggagagatagaggattaggatggactttatttcctaagtgagaaacgttggctttagtaaaagtgtagtggtttgtagggtcatccccctaaagatatcccgccccaccaaagatatccctaaagacatcctgctggtttcagtggctcatgcctgcawtcccagcactttgggaggctgaggcaggyggatcacttgagctcaggaattygagaccagcctggccaacatggtgaaaccttatccgtaaaaaaaataaaaaattagccagacatcgtggtgcatgcctsttgtcccagctatttgggaggctgaggtgggaggattgcttaagcctgggagattgaggctgtagtgagctatgattgcaccactgcactccagcctgggcagcagagcaagaccctgcctcaaaaaaaaaaagtaaaaataaaaataaaataaatatatatatgcatgcacatcctaattcctgtaacacgtggatatgcccttacttggaaaaagtgcctttgtagaatgcaagcatccttatggaagaaggtcagagggagatttgagaaagacagaagaggaggagtccatgcaaagataaaggcagagggtgaagttgtgcatccacaagctcagatatgcctggagccatcaggtgctggaagagatactggaagatctcttccagggcctctggaggaagcacagtcctgctaactcttaatttgggacttctggcttccggaactgcaaaagaacaagtttctgttgtgtgtaggcacccagtttgtggtaatttgttacagcagacatagcaaactaatgcaaatgggctttgcttgaagtccctcagctgctaagggtcagaaacaggatttgaacctacagttttgaggcctgaacctgctatgcagtgctttcttcctgatagtgaaaccactgtggtcccaaacccacagggctctatttagatttaaacaagactatgaatgtaaacagacacagtgcaatgccagatccagagcaatcgaaggtcatagtttcctcatccctcgaagctgccaccttgcaacatcatccttgtgttacttccagttgtttcttatgataagtaacagtgactttgatatatccattttttagttgtgtacatggtggtgatggtgttttactccttgctataaacgcttaaggattccttagctttagggaatgaaactacttgggcaagaatataaaattttgttctattttattttaaagctctggttacatatggtcaagttgcttcccaaaaagcgtctctgtcaggatgatcttatgaacgacsttagtacctcaattttactgtcccatccttttttcctccttccttgcctccttccctctctgcctccttccttttcttcccatttccttccttccagcattatcatataagccacgtgctgggatgtaccaggcacactagctctataggtaagatatttcctaggactcatcattcacatgagtccaggagaaatacatcttttgtttgtttgtttgttttttgagacagagtcttgctcaggctggagtgcgatggcaccatctgagctcactgcagcctcaaccgcctggtctcaaatgatccacccaacctagcctcctaagtagctgggaccacaggtgcatgccaccacgcccggcaatttttttttttttttttttttaagtagagacagggtcttgctgtgttgcccgggatggtcttgaactcctgggctcaagcgatactccctccttatcctcccaaagtgctgggattacaggtataaaccaccaacccagcctcaggagaaataaatcttttaggaaaaaaaagtgacacagttttctcttgtggcttatcacttggaatgtggagagtcatttccattagggaaccaccaggaatcttggcaacttagcagccacaggagatgcagaaactgagtagtgatttaaaaattcagatcactttgtttgttcccctagaataatacattattatcattaacaaagtaactcaacttacagtatcaaatcaactgcagagccattgatattgatgttaccgtactatccaacacattatgtttagtgttgatttaagaaaatgttgattttatttgatgtcatgggtgggaaattgcttgcttttgttttttgagtgaatctggtttaactgggctgtgtaagccaaggagttctaactcttcttgggcaactgagaccgtggctaatatttcattatctgtattaattaaagacagggcctggtacttgacatggcagtgtgatgtgtccaaggttagacccgaggtaagaatttagagcacagaggcacgctcacatgaagctgccaattcctctgctttttcaggtagaggctgaatgatttccgcacctttttatagattgcatgacttcaaagatgcacactaatactacggctccttgggaaatctttctgcactgatccctttgaatcttcagtgtttcaacatagacttgttacaaagagaaggaatataagcctctgttctttcttgtttccctttgttaattcctttttcctttcrttccttcttatctatccctttcttaccttctttatttcctcgtttatttgggctttttcggttgtgaagatcagtaccttgaaattcagaatagatggcatgaagcacttcagctttgcattcaagtactcatgtgtatgatcaagcatcgtcatgatcattattgactggaaagcctgtaagaagaagcggataaggccagggtgcagactgggcagtagttccctgtcatgaatccactctgcagttgttttataacatgcaacaaaaactaaagtctaatagcactccccaatgccaattttttttctttctcttttttttttttttttttgagagacagggtcttgctttatagcccaagctggagtgcagtggtgccttcacagctctttgcagccttgaactctgggctcaattgatcctcctgcctcagccatctgagtagttgggacaacaggtatgcactaccatgcccagtgaatttaaaaaaacaaacaaacaaaacactttttgtagagaaagggtcttgctatgttggtgaggctagtctcaaactcatgccctcaaatgatcctcctgccgtggtctccaaaagtgctgggattacaggtgtgagcccccaaccccaaaacttgaatctgggccacctttactgacttacttattactatgtagaatatggtacaggtgacgctgcagactcttgaagttaggtcataaaagatgatcctgcttccgtctggttgtgtctctcactcatgggatgcttaccctcaaaatttggccaccatgccatgaggaaactcaatctagcgtaggtaggaagaccgtgagaggcccaaatagagaggaattgaggccgccagtcatagtcagcttcagtcatcagataggaagccaacaactgagccctcagatgattccagtttccaaacactgtgaagcagaggctgactgtcccctttgtgccatattcaaattgctgacccacagaattcatgaatagcgcatgtggtagatttacacttcaaagtctttgggtaatttgataaagatgtggtaactgggctatgctctaatcaataatcttagctaagatttatcagaaattaaaactgtatacttaactaaccacctagataggtgcaggcatatatgaattcaccgaaatttgactcaactccyttggttaatttaaataaaataaaagtaaataaggggaaattgcatactcctatctggactgttttcttatggttttggaatctctggcaggtagaagtaattatttctgtaactctyaggcagggcttaggaattatctcccttaggtttgacttctttctttcttgagaataagcgctgtgtttcgcaagagtaaagaagtggcatttattctgttgtcacagcattactgagctcgagtggatggctctttatttccttctcgtcttttcttttctagtctttgtcaggacccattcctttacccctctttgcttttacggttttcacattttaataatgtaaaaccatgttccccaaacttccgccttttttgtcccatttgctccgctgttacatcatttgtttttaattacgttcatatttacttatgtttttatgcacagctatttataaagaagattctataatactaaagtaaatagaagagcaatatcatttgccataaatacaaaggatccctgaaaataaatatactgccagcctgggcaacatagggagatcactgtttctacaaaaaataataaattagctgagtgtgatgttgtgtgtctgtagtctcagcttcccagaaggtcaaggcaggaggattgctggagcccaggaggttgaggctgcagtgagctacaatcataccactgcactccagcctargcaacagagtgagaccttgtctcaaaaaataactggctgggcatggtggctcatgcctgtaatcccagcactctgggaggacgaggtgggcggatcacgaggtcaggagatcgagaccagcctggccaacatgatgaaaccctatctctactgaaaatacaaaaaaaaaaaaaattagccgggtatggtggtgtgtgcctgtagttccagctactcggtagcctgaggcaggagaatggtttgaacttgggaggtggaggttgcagtgagccgagatcatgccactgcactccagcctgggcgacagagtgagaatccgtctcaaaaaataagtaaataaaataactaactaggctaggcacagtgggtcatgcctgccatcccagcactttgggagtccaaggcaagaggatcacttgagcccaggatttcgagaccaacctggacaacgtacagagacctcatctctacaaaaaataaaacagctaggcatagaggcacacctgtggtcccaggtagttgggaggctgaggcgggaggatcctctgcacccaggtagccgaggctccagtgagtcatgatcatgccactgcactgtagcctgggtgataaagtaagatcctgtctggaaaaaaaaaaacacaaaaaactaaataagtcgtccatccgtccatctattcatacacacacgtaaaatgaaaactaaagcaaaagagtagtattaaattctagttagagacttaggatttccagtgactgaaattggaatgttaggtgttaaagacacacatcaaaatgagactcttggttttttttataagtgcaaggattgcaagatacctgaaaagggagtatttttcccccacatgcatctcaggagggtagcctcagatataagcttaggagtcctgaatttatcatcaatatttatatcgctgtttggcccctaacaccttccctatgatagccctaattggaatatagtaaatgtttgttgcatgaatcaacctatttaacctgtgcgtccttaaatcttacggtctgcgggttgacatttctagtgaagggagacatttctttacctacctgggacctcagaccttggacctcactgaacttgagagcagagctggtttatgtgtaactgaacctgatggttagtttcctgtttcaacttgattaggtcccagtcacagggtgcccacatgtttggtcaaacatcactctggggtgtctgtgagtgtgtttctgggtgaggtgaacatttaaatcagtcacctgattacagcagattgttctcaagtgcctgagcttcgtctcatcagctgaaggtctgaatagagcaaatagactgaccctacttcaaagagaactccttctgcctgatgactcaggtggggacttcagtccttttttttttttttttttttttttttttttttttttttttttgagatagggtctggctctgttggctaggctggagtgcagtgacgcaatctcagctcactacaacctcagcctcccaggttcaagcgattctcctgcctcagccttcccgagtagctgggattacaggcacccaccatcatgcccagctaacttttgtgttgttagtagagacagggtttcaccatgttggccaggctggtctcgaactcctgacctcagatgatccacctgccttgacgtcgcaaagtgctgggattacaggggtgagccaccacgtctggcctgacatcagtcttttcctgccttcagacttgaactgaagcatcagcatttcttgtgttttgatcttgctggagttggactgaaactacacatcagttctcctggctctccaccttgcctatagcggatcttgagactttttcttattttatctatctatcaatccattggtcatcaggttctccagagaatcagaaccaataagagatgtcatacacaccacacacaaacacacacacacacacacacacacacacacactaatatggttctgattctctggagaaccctgactaatacagaggcaagatcctgttttgacgtgcttgaactcgaggacttatgccgatgttaactctgagtgttcctgttttatactcagccatacagatgctcagagcatacctgcacaagtcaactttttgtgtctgcaggcatgggcctgccctgtacatgaggagacagcagacagttcctctccctgctgctggcctcttcatcttctcctggcgtcaccacggccaccgtgatgcctggctcaagtactagttctatgtcaatgatggtaccaatggactctaactttagaatgttgttgactgaaggcccctgccccctgccttgctttaggtggaggatctggtcaaggctttgtgaatcaggggatgctccacacctttctgctctctgcaacagggccagggatctgagtcccttcttgtctatccagaaaccgtatacccagtgttctctttctctcacctccgaataggtgggccttcccaatttacctgtgagaaaactagtgtgccacctcaagcgattctggcctctgttgactgtctgaaccctgtgttttgttgagtggtgcagactagagatgaagacagggattcggcttcgcttgctttatcaagggaatgttcttgggacaaatgtgtgacaggtgaggaaaacaacataggaaaggagacagaagtgaagagaagatgtggtctcaaatgaagtctggcttcaggtttatccttggggggctctggaataaaaatcacacctcaaacttgacccgcttgaggccagaaggccgggctgtggtaccttcgtgtcggacagtcataggctatcctcatggggacctgtatgttgccaggtgtcttgggcaaggtggacaaggatgccagcaaagtgaaattttccagagaaggtcacaaaagctaggaaatggcacagcagctgctaaaaggggatctgaccaggccaccaacagcttctgcttcttcccaaagtcacctttgctctctcctgaccaccgttggtgtctcaaagtctcacatgtgacaacacacatatcatcaaattcatgagtatccatggcacacaatgttttccttttcttctcttctctttctttcttgttttgttttgttgttttattttgttttgttttactgagataggatctgtctctttcccccaggctacagtgcagttgcgtgatattagctcactgcagcctcaaacttctaggctgaagtgatcctcccacctcaacgtcctgagtagggagggcactacaggcgcatgcctccacatctgactaattactaaatttttaaaaatttttttagacactgagtctcaccgtcttgccctggctggtctcaaactcctgggctcatacaattcccctgcctcagaatcccaaagtgctgggattataggcatgaggcaatgtgcccggcccacaatggttttcatatagctattgtgtattgcgttattgccttagtcacagaagcccataaaaaacagattccaataaagagactaggtttgcagagtgatgagtggggcccttgaaataattacatttagtgggttatatgtctatttttttggtcgttccttgctcatctgtctttatttttgtttatttatttattcatttatttgagatggagtctcactctgtcacccaggctggagtgcagtggtatgatctcggctcactacagcttccacctcccatgttcaagctattttcctgcctcagccttctgagtagctggaattacaagcgcccgccaccatacttcgctaatttttgtatgtatatgtgtatatatatgtatataatatatatattttttagtacagatgcggtttcatcatgttgatcaggctggtctcgaacttctgacctcagaatgatccgcctgcctcagcctcccaaagtgctgggattacaggtgtgagccacaatgcccagccttatatatgtatttattaagtttggggggaacaggtggtgtttggttacatgaataagttctttagtgatgatttctgagattttgatgtacccatcacccgggcagtgtatactgtagccaatatgtagtcttttattcctcaccctactcccacccttctccctgagttcccaaagtccattgtatcattcttctgcctttgcatcctcatagtttagctcccagtctacagggttatattaaaagaggaaaaggggtataagaatctaggtatcatggatgatgtcctggtcctttgctgagtcccatttttttcttcctcacctgatttcccccatctggcagaaacttttacagagtgtttgcagaagagaagcctgtaaactctggagtgtgtcctgggtggtttgtccttgggccactttattccctcaccgatcccttccaaaggccatgagttcccagtcagtcatttccctatatcagtatttattgttttaatcaattttccccatcccaagagaaaggcaccaacatgagtccatgtgttttaacatagcaggggtttccctgtcagagcccggtggacttctgtggccataagcaagtcaaggtgggctcctaagtggcagctgcccacttccagaaagctagaggttctaattatgtcttcctgaaaaacagttcaattaggtaaagtgacattttttaagcccttgtgtgtgtccgactcataaaagttcagaaggttgttactgagaggagactgcagtcattttaagatttcagtagctgctggagttgagtagataatttttcccctttctaatattatatattaggtgtgctcttgtgtctgggtgaaacagagcaatcacaatgattgttttttcagtatggtaataattaggcataaaatcaatatttatgtgtaatgtgccatttgaagattctccctgtgtatgatgctgggttttacaaaggaaaatctggattcaggtggccaatgaagtgtcacgatataaaaagagaattttgaaataatgagaattccactcctttgggagtattggcatatgttaaaatacaaatatatctgtatttttctcacttttattagaagagtgcaagtttgttcaaaacaactgctggattatctagtccctgaacagccatttatatttttgttacgcttgtggtttttaaatcatcctcatttccttgatcgcatttgcttctcctggctrgaatgtgtaggagacgggtcggggagactgtgcccatttgacagrtgtgaatgcgracagaggctgcagctggttagaccagggctgtgcaaccctagagccattgcctygaccacaaagccacagtctcctagtcctaatattaagaggtaggaggtagatagagattgtcccttaagccacattccattcttcatatttttgtacccattagagtagtgctgatcatttgccttcattgctggggtcccctaaatgcaacttctcatgctgccaatttagtcctggccctaggaagacgtaggtgataggatagaattcaacaactagaagccatggtttcctggttggatagacttcctctgccaccagaataaaggaatagagggttcctcactgtgccccatagctgcaaagtcacaggaagcttgcagcaggccagtggtaacctctgagtgacttctgagttcccagagctaggaccatgacttttcccctggattcttaagtacccggctaaaattgtgtttgccgaatgaaagtgtgatcctggaggccatgttgtttgtggttcatggaagggtgcttgttcagcttggtcaaagcaagatggtcatactgggttttggtgcccagacgttcccaacactcgcagcagagggcattaggatcatgtttagccaacaattttggaggcacccaacagtgattggatgtcatgtgctttcagaaggcacactacacatcttcggttcctccaagctctaggaaagggttgtggaattgggttgggtgacaacaggtcggtaagaagagggctgggctgagtgtaaagaaattccttggctgggcatggtggctcacgcctgtaatccagcactttgggaggctgaggcagataaatcacctgaggttaggagttcaagaccagcctggctaacacggataaacctcgtctctactgaaaacacaaaaattagcttggcttcstggtgcatgcctgtaatcccagctactgcagaggctgaggcaggagaatcgcttgaacccaggaggcggaggttgcagtgagccgagatcgtaccattgcactccagcctgggcaacagggagagattccatctcaaaaaacaaacaaacaaacaaacaaaaaccccagatattccttattatggaagaagaagcaggaaatatgtttttgaataatctgggtcagagaattgtgcatttattattgctaggatgcatatacacattgaactcagtcaacttactctctctaaattatctcaccggtggagacattgcctcaggagtygagccctgtggtgtgcctcctgctgtcaccacatttgaccacctaactgaccccactgtggtcacctttgccacctgccctgctttggtcccttctctgcattcgccccatgccatgtagcactgctgagtttgaaaataattgcatctcctgaaaactccatttcttagagagtgagctccagcaccatcagcctgaagttgaagaaatgggactcaggaaggctggagtcttcaggcgttcttacaatgctgatgcgactcagacggctgcctgcactgtcctctgtgcttctaagtgaaattacccgtcggggggctcctgagagttaaatcaagcagcctctcttgaagcacagtaaatgctgacgtgatttgtgaagatggctctgctaatagggttggcagcgtcctttggcttggacctttggaccccggctggctgcggaagggagggaaggcagccttggaaaactgatttccgttgccctctgaccatgagaagatccctgtttaggagctagaattcagagttccacgtgtagagggggattccacagtgtgtggtgtgcagagagcactcgtctttcaggcatggggcgccgtttcatttctcctagtgctggaaggggacttggtgaaattgatttggcaaaaaggttaatgtgttgttatggctgccagttggccgattgaagcgctagtaattggggcaagggaagcattcaatttgacacaccaaatgcaggtccaccctggtggatatcttggttgcagcactctgtgtgtgtacgtgtgtgcatgagcgtgtcttagagatgcttttgctcctcttataactcctatgataaaaagagttgccattatcatcctttgtctactcaccagcccccaccagaaaccctcacagaaaaaataagagtttattttttcactatgtcacattgttggagaactgtgcaaatacaagcccttctcttacaggccatgggtctcctaagtgggatacaccacgatgatccactggggcagtggccagcaaagtccctgtccagccagccactcgtttttatcaataaatttttactgaaacacagtcatgcctgttaggttaggaactgcctagcgccacttcacactgcagtaggagagtgagtagttgtgacagagaccatttatcccacaaagcctagaatctttattataatcctgtaacagaaagcatttactgactccttagcattgccatgtttagcaaataaaattgcaggatgctggtcaggcgcggtggctcacgcctgtaatcccagcattttgggaggccaaggtgggcagattacttgaggtcaggagatcgagatcagccgggccaacctggtgagatcccatctctactaataatacaaaaaatagctggcgtggtggcgcatgtctgtaattacagttactcgggaggctgaggcaggagaatcacttgaacctgggaggcagaggttgaagtgacccaagatcaccactgcaccccagcctgggcgacagagtgagactgtgtctcaaaaacaaaatatctggctgggcacagtggctcatgcctgtaatcccagcactttgggaggctgaggtgggtggatcacttgaggtcaggagttcaagaccaggctggccaacatggcaaaaccctgtctatactaaaaatacagaaatcagtggggcatggggcgggtgctctgtagtctcagctactcaggaggctgaggcaggagaattgcttgaatccaggagacggaggttgcagtgagttgagactgtgccactacactccagcctgggcggcagagtgagacgctgtctcaaataaatacatacatacaacataaagtaagatgttaaagtaaattttaattttagataaacaatggataattttttagcaaaaggatgttccacatttaactggacattatctctgtctctctccctccttmcctgcctcctatcctctcttcccaccccctacgatgtctatgtatagtttcaacctggcaaccctgtgacctcagcactaggatatggatagaaaacatagtagcccctatttacctttatcttttatctcaacccatttaaatgtctwttccttgcaatgttttgtaatattacatgtagattgtacatcgtttgtcgataaatcagtgtacaaatactagggrtgagtgtgctcaaaacttatttttactgataatagtccatgatcaaggcrgtttggagaccactcaggacagggaaaacgcagactcatgtgacccatcagggcttcagggtgtcctctggtgaagggcagcagcaggacagagccccacttctagctctggctcaggttaagtgtttcagcgccctggcttctgtgtcttcatgtgcaaatggagataatagtcagcacctatgcaggttactgtgaaaacaggttggaagtatttatctacagcgtggaccagagcctctggtatgtactaggtgccctagaaatgttctttcctctgactcaaatgacaaatcagtttctagggaaaggaacgcacagcgatccccagcgcatcacgagaaatctctctccagctttgccctggctgcgctggtgactcactcggggctaaaactgtttatgtctgcggagtcagagcgttctgccctgcggtttcagttcacatggggttgggcgacacagttttgttttcactttggtttatcgtgtgagtttccatccatcaactcttttgtatctgatgttcttgggaaactttgcgggaattcacttgaaattgtccagtgaacagccattgcgagtctcatggtcagagccgggggcttcccagtgtagggtctggtcaaggaaagggccacttcctgggcctcccaaaaagaggaaggagaaggccctggcttgtggaagagtaagaggggcctcgttaatgtctmccaagcacagtaccccaactccccacatacagtcccaacccttactgcagccgggaggttaggtgtctgccgtgctcatgaacaggaagtgaacccgatcagcccccgaaggaaacatccgtctctctccttggaggagacacttgagtgtctttctctgtgtgctgcagccgttattgatatcagttcccaggcaaggttcatgctggcagaggaggccactctttctgcactggagagcaaaagccatcttatctctctgagtgcaaggtgacagtgaggagattggccctgtgtatccctcagagaccagtattccctcatttgccaatctagaaagaagactgtgtttgctgtcatttgtttcttaactcattgattctcaaacagaatcttcccagggatctgcttcatgctgtattttgtactgtgtcctgagatgatgaggattcggtgtctaccctcaagaagcatcatttagagaagaaattagaaaagtaagtgaggcagaacaggatctggaggcagggaatctaaggctgattcacgttgactttgtataattaaatcaaaaggaaaacaccaactttccacaactaagttataaaaggaccagaggctactccctctgcaacccctccccacttttctgagttgcagatggaaaattgaaagtacccctgattggttgctttccacgaccattcagccgtttgcataggagctgtaactttgtaacttcgcttcaccctctgattggttgcttttcacaaccwatcagacatttgcataggagtgtaacttctttccacaaccaatctgactgattgtgggccattacttcatttccatgaggtgtacaccaagtggccaatgggagacctctatagggtatttaaaccccagaaaattctttaaccaggctcttgagcctctatgcttgggctgctcccaccgtttggagtgtactttccttttcagtaaatctctacttttgttgtttcattctttccttgctttgtttatgcgttttgtccaattctttattcaaaacgccaagaacctggacgccctcctccagtaacataatgaatgtctggatgtggtatgaagagtattggggtacaccacagcagcgtgtgctctgagaacacagtaaacaggcatttgatacagatcagaaggtccgtaaaggtggtatttgaactaagttttgagagctgggtaagagtttgtgaaaagacagggcttaaggaaggatatagtaagctgaaggcacaggactttagaaacacataggctataactgcaaggtgtgtctcagaaggtacatgtgacgtttcatttttatttgtttgcttttttatagtgactgcatgatcattatatgcagaagacgcttgaaggggccagattaggaagggcccatggtccacactgctttttttttttttttttttttttttttgaaacggagtatctgtctctcacccaggctggagtgcagtggcacagtcttggctcattgcaacatctgcctcctgggttcaagcaattttcttgcctcagcctcccgagtagctgggattacaggcacctgccaccacacctggctaatttttgtatttttagtagagatgaggtttcaccatgttggccaggctagtcttgaattcttgaccttaagtgatccacctgcctcggcctcccaaagtgctgggattacaggcgtgagccactgtgtatttctattaccagcctgcactgcatttctattacccgaaaacagtgtggaaaatattaattacaagggagattaaaaagtaaaactggttggttggcctgaagacccacatggtgacttcactaaagtcattgggtaagcaaagaagagcaacactctagttttcctccaagcttcaacgttttctgtttcctcctatgtcaggtcttaatttccctacctgattcaggctgcgctaagctgacttcatcatgactcctggcttccccagtccctgcttcccagcacataccatttattcagtgttggccagtgacgcctgccactgcattttattgatgaagaaatggagatctcaagaggtaaaaaaaactgactataggagccaagactagtttagagtggagtttgaatatgaacatgcctctgtctgtgaaagccagtgtcccttcagccaggatctttcctggaagaactcagtattaaggcacttgattagttcttcctgttggtggactgattgattacatttgaatctttcagcaagcttttggctgagctgggcatcttccccgccttcctccacctctgccttcaaaagcctgaatttccaaggctttctgccatgagtacttagctttgaaaaacatgagcatatttttcattcttcttgccggcctctccctgtgtcatgcctgttattcttttctccctcaacattgacctaggtcagaaggaccctattttaatgtttagcgtttgggggtcactccatagagaggggtttgtggaaatcctttttttttttttttttttttttgcttctttctgtggatctgtttggaaatgtaacattttaaagcccytcttggctggaggattttttatggtaaacataaaacgttcattgaaacattaaacattttacagctgtttttcagcacataaattttcatagacatccaccccctcactgccacaccccctcatagatttcytcttttcctcctccttctcctcctccctcttcctcctctttttcccccmccttcaaatagttccaagaccagagttgagggtgggtgggtagagggctagtttacagataaaatggttggtgtagatcatctagtttggaaaaagcacattgtattttaatactaggaacgtgtgcatgccagaaacctgccaaggaaaacactcccgctgctccttccagccctgactccagctgctatgaactggaaccctgcaccacgtctcagaaggctactgggaagggccataatctgtatccatccacaaggagaggtggaggggggctactctaagaagccaaaatgctcaggaaagccagagctaagatggtgcaaaccagcatgtgatttgtccaaggacatcgttttgatatgatgaaccatgggtggtttgggcatttgtcaaagcagggtcagcagaaagctgacgtagttgggtctaaagtacaacaggactgagcatggtggctcacacctgtaattctagtgcattgggaggccaaggcaggaggattgcttgaggccaggtgttcaagaccagccttggcaatatagcaagacattgcctgtacaaaaaatttaaaaattagctgggaatgatggtgcatgcctgtagtctcagctacttgggaggctgaggcaggaggatcaactgagcccaggagtttaaggctgcagtgagccatgatcatgccactacactccagtacactccaggactttaggcctgctaaagtgcattgtagtaatactagatatcagcacccttgccatggcctcatgagcagtgaaatgaactttcttgctcctggatttttggctcttggccttgtaatttttttttttcatgggatattagtcaacatgatgtgagcagagtcttgagatgtgcttgcatgattggctttgtactcctgcatttttcccatagccaatgccttttcttcagcttgggctgcagaatgagatagatgaaacagacctgaatctgacttataccctggagccattttcagcaaacccagtcaatatcaggccaacctcaaccaattcttagactagtgagtgaggaaaataaatatttgatcttgtgaacccttgaaattttgaggttgtttgttatgcggcagtattttggcagtagctgatgaatacaccactccccatccctagtggcttcctataccatttagaataaaaatacacgctcttttccagggtctacatgtcctgaagacctgaactcctgcctgcctctcagtttatttcctacctcaagtagctgtgcccaatgtcctcccaatatcctgcaaccactctagtcttctttcttttcctgggacccacagagcctatatctgcttcaaggcttttgtacatgttgtttcttttgcctgggaagagtggtggggggcactttcttgcccattttttttttttttttttgagatggagtctcgctcttgtcatgcaggctggagtgcagtagcacgatctcggctcattgcaacctctgcctcccgggttcaagcaattctctagcctcagcctcccaaattgctgagagtacaggcatctgcgaccacacctgtctaatttcttatctttctaacacagtttaaatatcactttctcagaggcctaccctgaccatcctacttaagtaacaataataaaataaaaatacccatcatttatgaagtgctcattatgtgccagcgttcttagcatctcccaacaaccctaggagacaggcattacaatgagccttcgtaatgttcagatgaggaaactgaggctaagagagccttggcaagctgagttacttagctagcaaatggtggagtcgaattcaaaccctgcctctcctcacccactctgtttcttttcttttgagcacttaccactttctgaatatgtatacaattgtttcctcgattactgtctgcctcttcttccctagagcgtcagcccatgagcttatccagcctacagaggagatgctgcagcttggcagagcatggattgctcaacataccagagtttagtcctacctctgtctccaagctgctccatgatcaaggataaactataatctttctctctgcctcagtttttccacctgtcagtggaggggcatgctcttggatgcctgagtttttcttagactcagcatcctgcagccgmaataaccatgcttcttagtggtcctcttgcgtagcagcctaagaaactccaagtccatctgcgccgaagagtattgaacttggccagagcacttgggatctgcagaagtgtcccctgtctgttagttttttcacagactctgctctttctctcccagaccggaccctccactcctctatctcgcatttatccattgcaccccgtgtcattgccgaattcctgagctacaaaggtgaacaggcaccaaagctagggcagtgtccactcaatacatatctgatgaatgaatgaatgaaccttgtctaccacagatagctcaccacaaataaacattttaatctactataaaatagctcaaaagactctatgcaaataattactgttacccagtggtggaagtgcttcactttttatggaaagtctttcactcatttctatctgcagtatttactgggcatttttccacgccaagccctggggatacagagttaaataaaatagaagcttaatccaggcatgctggctgtaaagttcacctttcggctcctttctgccattcttattagggtcttgccccatcttggcagcaagcctgctttaccattggagacctcagctctgattacaatacgtccgtgatcaacatgccctaactggttagcagatggcagctgcatgaagtcactgggcccagataggaatcaacaagggagattaggtaaagtgcttatttgaggtgctgtcagggcccgtggcaaagggttccctcattccctctgcagttatttttcatgcacactcggattacactgctcggtgatattacatctgcatgcgtcttgccctctgacacggcaaacacagatgctgcccraatccttgtaaagccatatatcttaagtaggaaggagcatctttgcaggggaggtgaattgatttgcaaagcagcctgacacatggtctcttatttctccttgcaatcaaataattcatctttatgcccgtagggccgtggtgaaatttgaacctgaccaaatcaacgactgcaaggtttatttgtagcagtgggatcagagaaattagccaagtgtattctaaaattatcaattgctgatcacatggtctggatgtgttttagtgcttaggggttggtggaccgaggctatggtggcatagtcctccatgaccaagggctgtctgcatgggtacgcagataaaacatgcactgccatggggtgacctgtgtgccatgcatcacacacagactactgtttaaccacctacatcataggtagatcctgcattttacaaatgaggaaacagagctcgagagaagttcaatcctcttccctacagagaggaaaggggaaaaaaatggactttcaagacagctgaaattcaaaacaaaacaatgttttaaaattgaatacagccttttgcattaaaattaccattttaataatagtttaaaagagagaaagagagagacccaaaatagtcaaactgaggttttgggttctggtgatagaatattaaatcataatgaagcatttaatgttttgttgttgttacaattgttgttttaccctagggctatgcaaagtagtttaaggatgtatttatttcagtggggaaaaaaagtggaggatatacatttggaggataaggaagcatgaattagggtggaggaagtgttttctggtctagctaaggaggaaaaattatagacctcaaaataggtgtcatttaatatatatctgtgaaaatgggccaaatagattgcctccgttaaagccgtattggatgttcaaatctcgagttacctgaaatgcaactgtacttcctatatttaaccaggctttttataaactgttcctcttaacacctcaagctgacaaccacatcctgggtggttatttaataccaagtttgactttcttcactttgagggtcctcaaaatagaaggtcagagagtagacttttaaaagtcttgcactgtttacaagtcagatgctttttggcagagtgactctcagctcccyccaacaatcccttcttgtcgttcagtagtagatagactctatcagggaaaaataggagaaataaaataagacagcatatggaaggcattgctgaaagtctttttcacaccttaaaaacaaggaagaagagaaatgaaaataaaatagtgagcaacacctcggtgaaagtagaggtgtttgtacagttcagctgctgccttattcaaaaacaggaagaaaaacccactgcccaggtcagctggtgggtgatctccactgaactcctattcagaggctcagtttctctgcaggacagaaatgagaggcacaaaatttcatagctgtcttgcccctyctgtggtctgtaagaatgggaccaggactcctagttgtgaacccgaaaggatttccattaggatcaggaagtgtgagttggcttagaaaaagtaaagaaagaacagtgctgtttcatttatttatcatgtgtaagtaaactgggatttattttattttattttttattttttgtttcagtttcggggggtacatgtgtaggtctgttacatggatatcttgcaagatactgagatttgggcttcaattgaacccatcacccaaattagtaaacatagtactcaataggtagtttttcaatccttttctccttccctccctagtccccccttttgaagtccccagagtctattgttcctgtcttcatgcccatgtgtacgcagtgttgagcttcgacttgtaagtaagaacatgcggtatttggttttctgtttctgcatttattcgctcaggataatggcttcaagctgtatccacgttgctgcaaagaacatgattttcttcttttttatggctgtgtagtatttcgtggtgtatacgtaccacattttctttaactaatccaccattgatgggcacttaggatgattccatgtctttgctgttgtgggtagtgctgccaagaacgtgagtgcaggtgtctttttagtagagtgatttattttcctttgaatgtatacccactaataagattgctaggtcaaatggtaattctatttttagacctttgagaaatctccaatttatttttcatagggacaaggttgcagagaaaagagaagagtgctgtttcaaacagttgaaaccattcctacttccaaaaagaatttgactcaaaagggaatagtacactacatataaaagacagatgtatttaatttgtgtttcgaactacatatcagaaattagttagaagaagatatgagataaatatacctggaaactttatgaattatttctgacatctagcattaaatttagctgggtttcctgggagtcaaaagcaaagagttttcaaccaaaaaaaagaaacagaggtgtatagtaacacacctctgtcctgcaacataactgtaagaatttatcagattatatatatatatatttatcagattatatatatatttatcagattttatatatatatatatatatatatatatgcatatgtttgtatataaatatacatgtaaagacccaaaactcatataaaaagacaaggtgatacagcattttaaaacagtttactaaaaataacaaaacattcttccatcagtcatgcatgccttatatttatgtagatacaaaaatagagtttgatattaaacaatactccaagaaagccatttctgcagagttaaaaaatacgtaggttcagttccttaccaacacgtagacatgttgtgatgaaagaaggaaaggaaggaaggaaggaggaagggaagaaggagggagggagggaaagagagagagagaaaaggaagagaaaggattttctagaaaaagaaaggaaggagggagggaaggtaagaaagaaattaattcccattttagagtaagactggaggcagagtggtcacccagatgaaaatgaataacccaactgtgtctttcttctggtgcctccacgtggaagtgggctgccacaatacttctaaagagaattggcatttttctttaaataaggaggaggatgaggagagagacgacacaaaattcactcacagaagtgaacataaattctaacattggtaaaactttgtctttgttttaaataatcagtcagttgtctcaatccataaaagagtatctcttgtacaatgtctgcttttgagtgattcacttcgatgcgtactgaaaatatacctttaagtagttgagtgacttgaaatattggtaaatgttctttaatattttgtctgtcagtgttagagactatcaggttaaaacaaagatattctttctttcctttttgtttttgacggagtctcacactctgttgcccaggctagagtacagtgatgcgatctcagcttactgcaacctctgcctcctgggttcaagcgattcttctgcctcagccttctgagtagctgggattacaggcacacaccaccacacctggctaatttttgtatttttagtagacacgggatttcgccctgttggccaggctagtttctaactcctgacctcaggcttcccaaagtgctgagattacaggtgtgagccaccatgcctggccaagaatattctttctaatatgatttagctaacaggttcagcagatttttaaactcactttcaaatcatgataaaattctttaagataaacatttgtcttctgttttcccctgagagtggtttagcatttatggagccctgctttgtgctaatgagtttatatgccctgtcttctttaatcttcaccacaactttatgtaataagtagtgtccaataaatttaatcacataattacttaaatggcctggcgagccgccttacctagctggccaggaattccaggagtcaggcttcctgatctaaatctgtcctggtcccrtcttggctgggtgccaccagcagcaacggcacactccagcttaaatatcagtggggataattctaggccgtttgtctgcctggttcttccaggatagaggcagtgatttcagtaatctcttagggctgggcacggtagctcacgcctataatcccagcactttgggaggccgaggcgggtggatcacctgaggtcaggagatggagaccatcctggctaacatggtgaaaccccgtctctactaataatacaaaaacaaaattagccgggcgtgggggcaggcgcctgtaatcccagctactctggaggctgagacaggataatggtgtgaatccgggaggcggagcttgcagtgagccgagattacaccactaccctccagcctgggcgacagactccagcctgagcgacagagtgagactccgtctcaaaaaaaaagaaaaaagaaagaaagaacctcttaggcaactctcatttcattatccaggtacaaagacaatgagtaagaagagtattggggttgggaggaccagtcacccctgtgtcttaagatacttctcagttttctttgttgcagcaaatattactgcagagttttagtgcattatagccttcttaaataaaacttgcccaggtgcagtggctcatgcctgtaatcccatcacattgggaggccaaggcaggtagtttgcttgagcccaggagtttgcgaccagcctggctaacatcatgaaatcccatctctacaaaacataaacagaaattagctgggcattgtggtatgtacctgtagtcccagctactcaggaggctgaggtgggaggattgcttgagcctgggaagtcaaggctgcagtgagcaaagatcacaccactgcagtcaagcctgggtgacagggcaagaccctatatcaaaaaaaaaaaaaaaaaaaaaaaaatatatatatatatatatatatatatatatgtatatgtatatgtatatataaatttaaggaagcatagaattgaagaggctattccaaggtcacatgacttttaagtggcagaaacagggggaattctgtctaacacaatccaatttatccatctcaagaaaagagatatgccaaagagaatgattattaaattatcattaatgtgaactcttgtaattactctcataattttctttaggcttatcccattgggcattgctaagtattattagattgtgattataaatggattccgccaggcatttctcttttgctctgtggcagctctttctctagagaacttggtccctggggatgccatcttctctgtcttcactcggtgaggatggactttaggatgcctcacttctcttcctgagattcttgcttccttcttccttaagggccactgatgagcaatcagtgagtttcaggaagaaggcattcaggctgatttcagacagcctaaggtcagtgtgcaagttagtatgtacctgtgtcttattattgaactggtgaatgaatgaatgactaggtcattatgaatttgtagatcagggttttgaagagtttggcaccggatttgaaagccaatgttctcttagtacctaccgctttcttttcctcaccttcctggatttcctgctcttaaggttttttgtttttgtttttctctccaaataaatggtatttattaaataaaaattcattttctcatttatcaaccagttgcagtctttggatgttttaattatataaaaaaagcatggaaactgggcattttaattagcaagtacagccttgacacaaataaaggcatggctttggttatgcagtgcatttatttgrttttcttgaaataagaaaaaaagatwtcttctccatcaccagagttgctgagtttgacagtgtgaatgagatgacctctaaggcctctacttatagatctgcacggttgggcctgggagctgtactacctcagctggtgggtgataacttactcacagtctgtgctgtgtcctgcactgtccattatctgcaggggtggtactgctgtccccagggaagagaatgctgtccacaaagagccagccatttatactmttaaaagaatacacaggagttgaacaatgagaacacgtggacaacgggaggggggaacatcacacaccggggcctgtctgggggtagggggaaaggggagggagagcattaggacacatatctaatgcatgcggggcttaaaacctagatgacgggttgataggtgcagcaaaccaccatggcacatgtacacctatgtaacaaggctgcatgttctgcacatgtatcccagaacttaaagtgaaaggaaaaaaaaaagtttcatcaaaaaaaaaaaagaaaaagaaaacaccggaaaaaagagactctcttccttgaaggatttaattccaggaattggagaatgtcttgtacatttcgagaaggcaatatagaaaatgcagtgggtagcccaggactcctggtccaggtaaagcaggccttgttgctattcccctggaccatgatattacatgytgggatgatggggtcttgtgatactgattaatttaaggctgcatgatgatgagggaggaacaaagatgttcttgagtcagtacctgccagagtggctgtatcctggtgttgtaatatcaaataattctacattatttagtaaatagccctgcccgaagcctctcagtgccacacacccactgggattcctgtgtgatttgtcacctggaggaacatcacctgccttggttggggagaggaagcctcaggaccctgcaccagggccatgtgacaaatacccattttgatagttcagtacccgctattaaatatgccgaatattattcctgaaaaggggcatggggataattacaaaaacatacctggttccactctcactttcgccatttaatagctttgggtctacaagtaaccaccccagatttttctcctcctctatgcaccagtcatatcaagaattactgtaacttcatwggatttttgtcaggacgctatgatgagaagaacatatgccaaggagacagttttctggcaaatcagaggcctgtaagaaatgatggctttttgcttgtatgaccaagtctcttggagacaaggcctcatgtatgaactctgaggcatgagaaggctcagaattcaccccatcttcagtcttttatttgaaaaagggaagaatgatggaaaggggaggagagagtatataaaacacgaacggggatcctagagacttgaatttctagtatgtactgcctctggctaatagggatctttgacacatacgctttttctccctttccagctggccctgttgcttaaagtggcagaagtagatgtcatgttggcagacagttttgttcactgtcaaaactgggtttatctaatgtgtatttgaaacaaacaaaaaaaaatcaataaaatgagcagctttgggagccagggtgaaggcggttgagataggacagaactccagaggactcttaaacattattcaggaagctctgaagctccctcagtctgggattccagaaaaagattgattaggcaatagtttaccttagaccatgaggagatggactttagccagaacacactgaaaaacacgagaaaagttggaagaaggaattatttttagtgttctgagaatgctttattgatattcctatgagagtttcattggttactgacgctgtgtactgattgggtaaattctagcatttttacactcctttgtttcaccctgtttgttcattcattcttccgttaaactacaattaagcaactaccatatctaattttaaggtggtggacaaagaatcaaacctaagttggggaatgtggcctctggtgattctcagttcttggtagccatgtctcagcatagtcttctcggacacctaatactactgacctgtataatcgatagggtattgcagacatcagagtatgtgacttacgaggctagaccataaaaatattgaggcttctgccttactgatgtggatcattcactctaggaaaagccagctgccatgttgggaggatactcaagcatacccgtgtagaagaactgagcctcctgccaacagccatgtgagtgaaccacgttcgaagttgattctgcagccctagttaagccttgaggtgattgcagcctttgctgcaatcttgactggaactttatttgagcccctatctagaaccaccgagctaagctgctcacaagtttctgcaccacagaaattcttgtgcgagataataaaagttaattattgtttcagcccacttagttttgggataatttgttatacaacagtggataactgcccattcaaagagtctaaaccattaactgttcagcattaggtaagaaaaccagttaattgttactttcttaccacctaccccagcaccccagcaccccagcatgaccaccatttagagggagctgcgcttttgcaaaggtacataggacactgtctgttgcttctgtacctcttgcctcatcagttagtggtgtgatgtgtttgcctgacaaataccatctaggaccctggctgcatgagcttgttgagacagctaaattttacaggtagttggggtttcaccatttaacccagttaactcttctataagtgccgtattaaagcaggtggtgtattttgaaagacgtatgtaaaaacatttgtatttatttatatgaatgaatacattttatttatttatataaatacattatatttattcacataaacacattttatttatataaataaatccatttttatttatttatataagtaaataaattttcctataaataatctttctgattgacagatagcgaccttcctgctatgtccttacatgacagaggaagagatcatctttcttcagcctcttctgacaagtccaccagtctcattcatgagggttccactctcatgactkaagtacctcctaaaggctccccctcctaataatatcaccttggagattagggtttccaaatatgagtttggggggacacattgattccacaacactgaccttctatcagatcagccaggatgctctttttcaaacttctgtcaatctttccccaccttcacaatgtgcccctattattattaatatttaaaatattgaagatctaattaatgttgaaatttttctttaaatcaattcatagattcattaactttgttttaaaaggaaatgttctatttccatcgtaaagggaagatcaatatgatttgccacatatagatgaagataaacctatatacaaagaaaatagaactatagtaattccatgtagctattattaccagagaatactctaagcccaatgcttgtgttctctttgggcaaatggaagatgagccacttgtagagaggtattaaaaaccaaagcaagatcttttgcaagtagattaattgggcaagacaaagggaataataactatgtcaccaaaattatttaatgcagggtccaggagccaccttaatcatccataaattggttaggcatgtttattaccacagattggaagcaggcttcccccaagtgtgtttccctttgtaatgccagtgtcgtaacgccactatctatacttttcaacacaattccaagtgctacctctgcatggcagaaactgtcaaccgtggatggtttctttttagcttgtccttcccgttctacagcatggaggttaagagctctggctttggttccaatcgtgtcccctttcctccctgtgtgttattgattgacctctctgagcccattgataaatggagttaaaaatttatactcactggggtggtgagaaggttaagggcaatgatgtatacaagacattagcatttgctataaggaggatgtatctcagttgccatatttgtatcactaaccatttgaagattttgtgttcaagatttggaagagaatcttcttcccaagccagcattttatattttgcattaaaaaaaaccacaaaagacaaaaaaaaaaaaaacaaaaaaccttcacagacaaaacccagggcatattttaggtgtgtttaattcgaagctcctgatgtctagcaggaacctggaacttccctttctatttttgtgggtcaatatattcccacttttgatttaaggtagtacaagttgtatatgggtgccagttagggattcctggctgatctgtgcaattttttcagtgaagttatatgtggtgcttagtggtgactatgggaagattacacggagaagtgttagaacagggtaatcaactgggaacccatttcaggtgaatgccaagatgttttgaaggtgggcatggcagggaaataacaggatgccatgcttggtgagaaatgaattcgtaagtgtgcactgtctgccataaagagccaggcaaggcacagaaaatattcttctgtttctttttctattstaccctctctctgctttttcttctctcactgctgctgaagcagtgagagcctgttgagttaaaataagccagtgaggattttggtggtgtttgcccttgaagcctcttgacatacagtgtcatcaaggagcagtgggtgagcctgcccatatctcgggcacaaacctaggtactcattgaatcctttaaactaaccctctaaagaattctcaatctgtggatgagaaatggcaacacagggatgttaaactgcatgcctacaatcatccatttggaagaagcagggctggaatttgaacatgagactgtatgctccctgttgtagtttcctatggctgctgtaaaaagttagcacaaatgcagaggcttaagacagcacaaatgtcttatcttacagttctgaaggtttcgctccagagtgagttttatggagtgaaaatcaaaatgttggcaggccttaggggagagtccattcctttcatcttccagtctctagaggctgctggcatttttcagctcacggccacagcactctaatctctgctttcactatcccttcttttttctgtgactctgaccttcttgcttccctcttacaatgacccttttaattgcattaggcccaccaggctcatccaggatgtatttgtctgtgttcacactagtgataaagacatacccaaaactgggtaatttatcaacaaaaagagatttgatggactcacagttccatgtggctagggtgggtgcacagtcatggcggaaggcaaaaggcacatctcacacggcagcagacgagagagagtgacagccaggtgaaggagtttcccgttataaaaacattagatctcatgagacttattcactaccatgagaacaatatgggagaaatcgatcctgtgattcaattatctcccaccagggtccctcccacaacatgtgggaattatgggagctacaattcaatatgagatttggatggggacacagccaaaccatatcacaggatagttccccatatsaaggtccttaacttaatcacacttgcatttgattttatcatgcaaggtagcatactcacaggtgggattaggacttagacaccttcagcaagaaacattactcaggccaacacactcctcaaacctaagcttattcccaatcacacagtcaggagaggatgcccacaatgcacttggggttttgtgtctgtgtctcccctccaagaacaggtacttgcccttgtctttggagctcacagccaagtcctacagtcagcatcagacggcttgtctcaagctgctgatttccgggagcaaagctgctgtgggacatgagactctttgaggcagaatacctctcatgcctggagagcattacaggctgcattastctgttttcactctgctgataaagacatacccaagactgtgcaatttacaaaagaaagaggtttaatgaactcacatttccccatgtctggggaggcctcacaatcataatggaaggggaaaggcgcatctcacgtggtggcagagaacagaagagagcttgtgcagggaaactccgctttataataccatcagatctcatgagacttattcactatcatgagcatagcacaggaaagaccctcccccatgattcagttatctcctaccaggcccctcctacaacacgtaagaattatgggagctacaattcaagatgcgatttgggtggggacagagccaaaccatattacaggctaatgactgagcgggggctgtttcttgttgtgttcttataagaactattgcattttctttttcttccaaatatagttaatggcctcatcttttctggactaggtttgtagtagaccataagcaaaagagttcagaaagcacggcctccaagaagtcggatctgcttgtctttatcaatctgtttggattttcctggcccatttactcacaaatttaaaagacatgatgagttttcagggagaactctttagcatttacattttaatttagttttgtttacctgtttagtgccctctcggttcccagaccatcaaactcaccattgtcaccggggagaaatttgtgttggctgaaatctgtagtggttggtctgctgcttttctttctctgctcatctaccctgatagtttccctgtggtttgtggtgggctcacagctcttgacctcaggactctcgctggtctagaggagattggtttgtgggggcgtctgacatgtttgggttctttgtgacatctgggccacccggttgagtctgacaagaaacacttaatacctccttggctttgaagctctcctttgtggcactacaaggtcctctttgaaatcccacattcttttttggatttaggtattaaccccttgctgtgaggagaaagataattgtcaacacacttaggagagaaatcatgcagtaaagctgacccgacatagactaacttaaaactaactagttcattagtgctaacttagttcattagtgctttatctccttgtgtgtgtgagtgtgtgaggggatcaattatatacataagacaaagaccacctaggaaatgtttgagaaactgtgcagtgaggatgaatcaacaagtaaatatcatgagaatttcttagattgaagaaatattactcctatttggtgtcaactctgtgctggccttttcactsaagttctctgatgtaactgcccacagtaatcctgtaaggtatggctaatcatttccattttatagattaggaaaccaaggtcmaaagtggtgaattgatttgaccaaaatcacagacccaggaatttcctcagccaagagcctacagcagctgtgtcttaagactgtgccctttcatccaccctcttggtactcaaagcttggtccatgaaccagcagcttcagcatctgctgagagcttgctggagatacagaatctcaggcctgactgacccgaggcctgctgagtctgaattttaaccagagtctcttggtgactcgtgtgtactttagaaggggaactgctcaccgcccccacttcccactgagtcgaatagacattaagtgagccttccttatgtgctcagcctgtggtgaggctgcaaagacaatacgacccagcccctgtaatgcaaaattcagagcatagggcagcacactgctgccatgagtcgaggtgacacagtactaacagtgggcacagggggctcggggcacagaggaggggtgcttcccagggagactgcccgttggagcttactcctaagctaattgggaggcaggaatccactgtggctgagaacagcagctctgaatttgcactgtctggtttcaagtccaaattctactacatcccagctgtgtattgtggggcaagttacttaacctctctggcctcagtatctgtatctgtaatatggggaatcataaaagcacctacttgttaaggcatattaaatgcaacgctactttgaaggactcatagtagttaacacccagtttggtaagtgttattattgaaggctgagaacagaacgacaaacaacaatcacaacaaaaggctggggaagattttcctggtggggggaccagatgagcaatagatctccatatgcagaggggtaactgagtacgactctgggacttacactagaacattcatattgcaataaagcagatttttcctgagcacctactctgtgccaaagcactattgtaggctgtggagatagggagctgaagtactgaaagcgttacagtcaagggccagaaaaccattgttcaagcaattggcgtatggcttgatctgtgtttattacaaagcgatacttttccttctaagtactgctttacctgcatcctgcaaattttggtatgttgtattttcattctcattaattcaaaatatgttccaatttcccatgtgatttcttcttcgaccctcacatgtttattacagcatttacttgtttctgttcatccagaactcattgaatacctgctatctaccaggcagtggcctggtcacatcttctgacctcaagtagtttatagtccaaaaagacattggctctttgggatagaggcactttttgggggagagaaacatgaatgcaaytttttacatagagtatgaaactctgttccaaatctctcaaactcaggttctttgattcttaaggtatttttcactgccgagttgctgtcattgaaacaaaatctgtcctggtcaccactgtatgcccagcacstagtacagtgccctgaacatattaggtactcattaaatacttgttccacgaagttgttatttggtattcacgagttttgtctcaattccttttgattcttcttttcacccatctcatgttgacttaatttctccagcattcagttaagacctagccgaagcataattgtcagcatagtagagctggctctcctctttctaattgcccwgcagagtttttggggagtctgtatgcaattgtgtacaccccaatgccccaaaaccctcttctatttcctttagcactcttgagctgaagaagccccactctccctctgccccacatctattgtgggctgggatacatgttgggcctctgcccagatcatgcttggagtggcaccagctgggtaggacatgtgaaatatttgctcagagagatccagaagtgttgatctgagtaggatcagctggtgctccaggataaaaatcgtgtcaccacttttgccgaaaagtcactgtgtttctcctgtactcagcaggttacagggtgccatattgttttcagtcttccggctctaccctgttttgaagtgcggccgggtgttgttaaacggctccgccttcctgccagaatttctccgtggggaggagctgccacccagtccagtgagtatggccttttggtcagcattgcagaacctggcaagtcctaattccctgtgagcttgacacaggaggccgcctcctcctccaggcttacttggaagcattctgtcctcttgttggaagggaaattggtatggtagggaggtgcttcttctgggagtgggtttgtaaaatcaagactgttttcatccaaaccagttacctgtttgtctagaacctgtgttctctgctttctgcctcttgtgttgacatttctcctttggccttcatctgttactcgctcacatgtgccgtgccccgggtgggtttggaagccatgctgctatggtttgattcctggctttccaacattacctttgataaccaagacaagtggcagtctaagcctcagtttcctcatctgcaaaatgggtgcaattctagtacctccttcctaaggctgtgaggattcaatgaggtactgcttgcaaagtttctagcacagtgtcttgaacacggtaaacaacttacctaggtctgatctcatttgatattgttgctcatagcaaaggtttgttgagtttactacggatataacacttgttcttttttaaaataacttttaaaaacgcaagtgttgaattatctgcattgtgcctttagggcatacacatctgcttacaatattttttgagctttcagaaaacttaagatatggttgagggatgcaggaaggaacaggacaagaacccagatccctgcccaacaggacagtggaagggaagtctcagcatctcgaaatgagtgcctggagaggatgggtggcggctgtgcggggatgtggtagggtgatggtccttgaaggatgctgcagatcacagtggccccacagtgtggggattggggtgggatatgtgacaacaaaggcatccctggcagaggatccagcacgagcaaaggcagaaagtccaggaagtgtcaggaatgagaagagcccagtagaggatgggcttagggacagtgatgagaccttctggtagaggcgttgaacactagggtgagggctttgctctgacttcaggaagcaggtgagaggccctgaaatttccacgtaagattcggggccgggcacggtggctcatacttataatcccagcactttgggaggctgaggcgggtggaccacctgaggtcaggagttcgagaccagcctggccaacatggtgaaaccccatctctactaaaagtacaaaaattagccaggtgtgatagcgggcgcctgtaaccctggctactcgggaggctgaggtgggagaattgcttgaacccgggaggcagacgttgcagtgagccgagattgtgccactgcactgcagcttgggaaacagagtgagactctgtctaaaaaaaaagaagagttggatcacagcaaaggtgagctttaatgagttcactctggcagttgtgccgaggagggactggcatggagagaaaacagaggcaaaaatcacaacctctgtcagagaactcatcgcactatttctgtcctgccctgggatggtggagcctaagggaacagagaggacagagtgggtggcacaggcattgcggaggcagaaatttacgtggcttccatgcccattggtgtgaggagtgaggggtgatcagggatcccagtggcttgaaagtataacaaaagtatgactagatccaggaaatacagctggagagacccaagtctgcacagaaaaggtttacagagcccaggcacacagatgacatgagcagttccaaaggagtgggacggggtgaatgatttgtggtcagaggtgtggtcacacataccgtcccctgatagtcggtgggaactgggtcaggttccatttgccaggggcaggacatactgcgtgccttggccttttctgggctactcaaaaaaggattccaccaggtaaacttgaatcacctagcgctggtagaaagccttgctcttcgtcatctctcctgtgtatcgctagccttattaaaatgtgcagaggagaccgggcatggtagcacacttgtaatctcagcacttggagaggctgaggtgggagaattgcttgaggctatggcttcaaaaccagcctgggcaacacagcaagaccccacgtcttaaaaaaatttagccggctgtcgtgtctcctccgtgtagtcccagctattcaggcagctgaggcaggagggctgcttgagctcaggaggtggaggctgaagtgagctgtgattgtgctgttgcactccagcctgggcgacagagggacagcttgtctccttgtctctaaaaaagaaaaacatgctcagaggccttgtgagttagctctctccaaagtttttaagacaaggaattcagttaatcaagtttgttagacttgtttgaaaaaagggcctgaacaggctcagagcaagggcagatcaagctcttccacagattttaatgttcaggttttgtgacctttactttttttattttggcaaaatgtacacaacttagtatttatcattttaatttataagtgtaaaattcatagtcattaaatatattcacaatgttgtgtaaccatcagcattacctatacctaaaatattttcatcacatcttttaaaaaataactgccccttcctcacwtccccaagcttgtggtctctggtaacccctactttactttctgcatctatgaaattgttttcaaggtcaatccatattgtagcatatatcaaaatttctttctttcttcctctccttccctccctccctccctccctccttctctctctcctttcctcccttccttccttccttctttccttccttccttccatttttgacagggtctcactctgttgcccaggctggggtgcagtggcacaatcaaagctcactgcagccttgacttcctgggcttcagtgatcctcccacctcagcctcccaaggagctagaggtgcatgccaccatgcctggctttttaaatttatttttattattatttttttatttttagtagagacagattttgccgtgttgccctggctgatcttgaactcctgtgctccggtcatccacccgcctgggcttcccaaagcgctgagatgactgcgccaccacacctgccacaaaatttctttgttatggctgaataatgtttctgtgtgagtgtgtgtgtgtctgtgtgtgtgtgtgtgtgtgtgtgtgtktttgaataatactcctatgaacattgtaccaatatctattcagatctctgctttcgattcttctgcatrtatacctaggagtgaaattgctgcgtcgtttcgtatctgtgtgcttaaccttttgagaaactgccaaactgtcttcaacagcagccgcatcattttacattcccaccagcagtgcatcaggattctagttgctccacatctacccaatacttattttacttaaaaaaatagaatagccatctgagtgaagtgttacctccctgcagtgttgattcccatttccctaatgatgttaagcgtactttcacgtgcctactggccgtttgtgtatcttctttggagaaagtaacatccatttttgatactcacatggctttttggttctatttttgctttcttttggctaatgataaccttccagcaccacgagtttggactgtgctaatgtcttctagtactgtttagaagttgaggtaaaaagaaaacggtaattgaaagagacagttgttgtttacattggggaggttggtattccaccccctgtgctttttcattagctgtattgtattcttattatgtgttttaccgggtaattgtaattcttggctttggattttgtcccttttttaggctgcggggcggggggtcggttattttataagcaaagaagtacagccagtatgattttgaagcaactaggccccagtagaaaaaagttggagagtgaaatctcaagcaagccaaaaagtgatagatgagttaaaaaaaaaaaaaaaaaaaaaaaaaaaaaagttgcctggcttggtgcagtggctcatgcctgtactcccagcactttgggaggctgaggtgggcggatcatctgaggtgaggagtttgagaccacactggccaacatgttgaaacccgctctctactaaaaatacaacaattagccaggtgtggtggcgcacgcctgtaatcccagctactcaccaggctgagagtggaaaatcacttgaacttgggaggcaaaggttgcagtgagcggagactgcgccgctgcactccagcctgggtgacacagtgagacttcatctcgaggaaaaaaaaaaaaaaaggctttggagcttcctaatttctaaatagatttcctttataattttcagaggttgtgaaattaactctgtagattggggagtgtagtttgtcactctaattgcccagcgttttaattatcggcgtgttttatgcttttgtgaaatgctcatttcacagcttgctggtgggtctttttgtggaacgagaaagtgaatattcacaccagaaatgaggtactgaccctgaagggctttccagtcaaagagaaaggagagcatgacccgccaatgccgttgtttgtaagcaggaagctgacgctgcgccatggtgtaggggaggaggacggtttccattctgttttgagcatcagaataaaaccaagcaccagaaggtgtggttcaaagatgctttcctttttcagtctctggtcaatttgttgttatttttcttcaagagagttgttggggttgggtaggcgcaggggccacaaggccatctttataaggctctggcatttgatagtgaggtattttggtattccaaataattggtggaaggatggaaaggttaaatggaaattatgtaagggctgcaaagagattcatatatgactatttcatgagtgcttactatayaccaggcgctgttacagcccgtgtaatgccacctgggagttggggggagtcaccatcgtccatccgtctgtscatccatccatccatcctgcctccctccatcctttctctttttcacaatgtctcttgctccgccccctctcttcccctccttccttcctatccagtgcttgtaacctgtcaagcacatgttgtagccattggggacatcgtggtaaacaaagcaaagtccttgcttgcattctgtgacagatggagataaaatgggtaattaacaaatgtaatccctcccacccaccccccacattatttatttatttatttatttatttatttatttatttatttttaccatrtctgttactccatcagtcaggatccagttaggagacagaaactatatcataattttaacagggaagatttaatattaagaattattagctacaacagggttttggctactaaagggtaaagagaatcaggccgagcacagtgactcatgcctgtctgtaatcccagcactttggaaggccaaggtggaaggatcgcctgagtccaggagttcgagatcagtgtggacaacatagggaggtcctgtctctacaaaaaataaaaaataaaataaaaaaataaaaataaaaataaataaaaagtagttgggcgtgtgtkgtggagcatgtgggggtcccagctacttggcaggctgaascaggaggatcgcttgagctcaagaggttgaggctgctgtgagctatgatctcacctctgtactacagcctgggtgacagagtgagaccgtgtctttaagtaaaataaaataaaaaagagtaggtcgggcatggtgggtcatgcatgtaatcccagcactttgggaatacgaggtgggccaatcactgaggtcaggagttcgagaccagcctggccaacatggtgaaacccygtctctactaaaaatacaaaagtkagtcggggttggtggtgtgctcctgtagttccagctacttgggaggctgaggcaggagaatcacttgaatccgggagccagcggttgcagtgagcttagattgcaccactgtactccagcctgggccatagagtgagactctgtctcaaacaaaaaaaaaatttaactctaaagaatccaagaatacagatttgggagcagccagtaccaatgggggatggggcagtacacccaggaaagagcaaatctggggtccccacgggccaggactgggatctggactgggccatggcccattggatggcagaaaggttctcactgaagcccccataaaggtgggactcactgggaaaccgctctctgtggtgccagggaaggacgtctgtgggaggtgcctaccaaggaagtctctggaaatcagcctgcaggggtggagtgccgggaaactcccgccccctccccccctccccgaagtgaaccgcccacagggagatgcccctatgggagcttcgcaccagaacccgtctgcgccagtgtccctgcagcgccctctactggcgaagctggacatggcgtccgctggcaaaggggaaactcttctttcctcccaagccgagcaatgctaaatgtgcctggtactgagacgtcatctgtggacggttggcaccgatgctaatcagtgctatgggaaaataggcagagcgaggagcgtaagaattattatgtgtgctgtttgatagagactgtacaaggaagacctctctaaaaaggtgacatttggagcagagacatgaaggaagggattgctggaggcagaacattctaggcagaaggaaccgcacgtgcaaaggccctcaggtcagccggcatggcatgcaagtaagccacctgcaacacagcaggtgtggatgaagggaagagaattagcatttggccagagcacgcattttaagggatggagatccatttggatagtcttgaacacagaactgaccggaactgacttactctttgaaaagatcgctctggctgctgtgttgagtggattggtaagggacaggtggtgaagactgaaacagggtatccagttaggaagctaccacagtgatccaacccccagcttctgttgaggttgaagaacmtgcatgcccaacctaaatatatgttcaaaggtggttattactgtttgaggtgatgaaagagttttggagatagaagtgatggttgttcaacatcatgagtgtaattaatgccacggaattgtatccttaaaaatgcttaaaatgcgctgggtgcggtggctcacgcctgtaatcccagcactttgggaggctgagatgggcggatcacttgaggtcaggagttcgagaccagcctggccagcatggtgaaaccccgtttctactagaaatacaaaaattgggcgggcattgtggtgggtgtctgtaatcccagctatttggaaggctgaagcaggagaattgcttgagcctaggaggtggaggttgcagtgagccaagattgtgccactgcacttcagcttgggcaacagagtaagactctgtctcacaataaataaataaataaataaataaataaataaataaataagagttggatcacagcaaaggtgagctttaacgagttcagtctagctctctcacaaaaaaaaagttaaaatgacaaattttgtgttacatacattgtactacaataaaaaccatttttttgaaaagaatagtacaaaaatgatacttccctctcagtgtattttaccaagggattattagtgtatatgtgtgttcttactggaaatgttaattggacttgtaattctttttttaacttgtattttgggttcaggggtacatgtgcaggtttgttatataggtaacttcatgtcacaaaggtttgttgaacagattatttcatcacgcaggtaataagccttgtatccaatagttatttttctgatcctctccttcctctctccctctaccctcaggcaggccccagtgtctgttgttctttctttgtgtccttgagttttcatcatttagcttccacttgtaagtgaggccatgcagtatttgattttctcttcctgcattagtttgctgaggataatggcttctagccccgtccgtgttctcgcagaagacatgatcgcattcttttatatggctgcatagtattccatggtgtatattcactactttttttttaatccaatctgtcatttgtggacatttaggttgattccagtagacgtgtaattcttcttggaaatgttaatcttgatcatttggttaatgtgatgacttctgggttctgcagtgtgaagttattatcttcccttttgtaggtaacaaatactttggaagagattaaacaaacaaataaaaaagtggtgattgttattaccagcatggctactactagctaattccaggcttcaagccactggggcataggcatatgtttagctcattccacaggaggggaacagaggctcaaagaacctaggtaagttggccaggcgcggtggctcacacctgtaatctcagcgctttgtggggcttaggcaggaggattgcttgagctcagaagtttgagaccagcctggacaacatagcgtgaacttgtatctacttaaagtaaaaatcaaaaaaataatggggtgcagtggtacatggctgtagtcccaattactcaggaggtggaggtgggaggattgcttgggcccaggaggctgaggctgcagaaagctgtcatcatgccgctgtgctccagcctgggcatcaaggtctgttttgcagaccttgtctccaaagcaaaacaaacaaacaaaagaaacaaacaaacaaacaaaaagaaattaggtaacttgctcagtggctagtgagtggctagattgtaagcttcatgagggcaggggactttgacgattttgtcggtatcctaagcccctagaacagtgcctaaacatttgttgggcagttaatatatatttgttctattaataagtagagcccgagtttgtgttctccgattccacaccccatgttccttctactacaacttctggctctggcttctggactgtcagtcattagcactccctatccctaagatttcaggaatgttcagctgttgcctagcttggaatggaccatcctctggtcccacccatgggtaagtcattggctgcagagcgcagacatttggctcccttcgggacattcctccctcatttaaaacaatgaggcgggcagcagggtactttgtcccttgtgttagctgaagttggaggatgctgtgttgatgggaaaacgctgttactattcttagactagtggggctctcacttattcatagctccgcactcgtgggtggaatgagaagttataatagagtgcaggtgcctctcattgttttccgctactcactggatagtgtttattaaaaacgaaatcacagtggtgtgtctggagttgaagtctgaacaaataacccaaaatgaggagtccctggaaggtgggcaggaggcgacaaacaaagagaagcaaaaacaagtttgagctaattgggatcaggcagtactttgcatgtgagttctgaacagggagcttggctgcaaaacgattattgtatttaacttctgttggcatcattcgcatacttgtatgggagatccagaattggaatttaacacagttttcccaggcccttcatggaatttgaaaacatgactctgaaagcatgtggctgaaatgagactctttcacactgtttaaagatgcatgtgcatatgttggtgtccacacatcaacttaattttttcatgttccttgaaggaagcccttctaggtccttctgaaagaagggctggagatttttattaaacattacttctaggctgggtgcagtgactcatccctgcaatcccagtactttgggaggccaaggcaggcagatcatgaggtcaggagatggagaccatcctggccaacatggtgaaaccctgtctctactcaaaatacaaaaattagctgggcgtggtagcaggcgcctgtaatcccagctactcaggaggctgaaaaaggagaatcgcttgaatcagggagtcggagttttcagtgagccgagatcgcgccactgcactccagtctggtgacagagcgagacaatgtctcaaaaaaaaagaaagagttctgaatgatgataggtgttggaatccacgttggtgtgtctcatgtcattttttcgggcagtttcttgacagacccattttgtgtgtgtgtgtgtgtgtgtgtgtgtgtgtgtgtgcgcgtgcgcacacgcatgagcctgtacgtgtccccctccccccccacacatatgcacataagatagcataaggtagttccctggcacatggcgttgttcttaaccatgaggtgctcccaggctccgggcagttccttgaaagactcattgtctgtgtggggggaggggaggctgtacatgtccccacccaacacacacacatacacacacatgggcacatatgatagcataaggcaattcctggcacatggcattgttctgaactgtgaggtgctcccaggagatcttgtgcttcctatcacatgcccattctgcaagtccatccccttattgagcagatgtttaccgcagagcactaagacagatggaacgtcaccgttgcccatagcactcatggacagcatggggtcccctgtagcagatatttgtggtgtatgctcgaagaggggctgcaggtagaactagaaaggtaggtaagttgggcagatggcgagagacatcacagccctcactcctgagggtggggagccatctcaggctcaggagaagaagagtgacagagtcaccaactcactccatcaaatgtggctgtatttttagaagtgtctggttcctgaaatacctcaattccttttgcctgcctrgctcctctcctctcttctgcctgttcattgaactgaaagattatcaggactgtattcagcccggccaataatatcacaaaacaaaaatatcttgtgggtttgaaatttatgagtgttttgactgttcacagcaatgcctttgagaatcacagtgtgtcatcccctccccacccccacgaacatgtagtttttgggcaacttttcgatgagtaaaacagggcctgacttttaccccaaagtgatgttcttttgtggcttgtctactccaagaactgagatacccagactcatttctcatctcttgttgaaacagagaagtcactgtagcgccctccggggggtggggtatcaagggagagtatgggctttgaaactgctcatcccgtctacaaccttggagggcatggtgtttcactcccccacctctccccacaacttcaccctgctccaatgaggatgaaaatgtctttcttatagatgggacaggagccttagtaatatggtgcgagcaatggttcacataggggacaggtgttcattcartggtgggtattattataataatcattagcatcattgctagtgactttatttttcctttagccaatggagcagtggcttttggcccactactttcgactgaatctatgagtgaatgtgatcctccgttttaaccctgtcttattggatgttggtaaacagtatatcatgagcccctgtaagagcttgaatccttcaaagacaaggtcagtcagtggccatcactactctaaacgtaagaccctgtgatgactgacacttactaggtttctcatttatttatttttctctgcaggacacagctgtgtgttccaaagatggtcttaaacctataggagtataacaccatggctagttcagaaaaccttattccaacttccaaacttagaagatactgggaagtaaaagggagagaagggaatgcatggcttgggctaaaaaaatgattctgcattcatctcagaaggatgttttccagtctttctctagaaacaacttttgtgtctaaggattgtgggtgaacaacagcagcacaggctacattggcttggctcggtggttgggatggtttggctcttactgggcagtaagcacagtggctgggataggaccttggcatctcgtgcgaagcccctctgcctkgagtcctgcctctgtgacacttgcttactgtgtgacctgggtcractcatacctactgttcgtcagttttctcatctgtaaaatggggattccagtggttattatgagaattaaatatgacgatacataaatagcacctggaaaagtgtttaggaaaccttgacatgatgacctgtttagcagcagcagtgtgtgccatacttacctttatggaatgaacagatttggagtgaggatggatgtttagctcactttattagtctggtctcacactgctataaaaaactgcccgagattgggaaatttataaagaaaagaggtttaattgactcacaattctgcatggtcggggaagcctcagaaaacttacgatcatggtggaaaggaagctagtgcaccttacatggcggcaggcaagaggggcagggagggagagagaaagagggagggaggaaaccaccacatataaaaccatcagatcgcgtaagaactcgctatgtcaagaatagaatgggggaaccacccccatcatccagtcacctcctaccaggtctctcccctaacatgtggggattacagcttgtattacaattcgagatgagatttgggtggggacacagccaaaccataccactcatggcatctcgtttttacagagtatatgtgttttcagattttgcatgacattttaggataaatgtgatgaaaatgaggaaaattrggaatgaagtttaggtcagaaaagtttcagtgattattttttcagaatcattgtttcttggtttctagggtccaacatgccattgttcaatggctgtatttcagaggctgtattttttttcccatctcttccttcctacttagaagacagtgacatttcctctgtgcctctcaggtgtcaatgccatccaacaggaatttgtacaaagaaagggaggactttctgatgatgttgtccaggacagtggccccatgtagctactgagcacttgaaacgtgactagtatgaccaggggctggacttttagtttaattttttgtaatttaaataatttaagtagctgatgtgtctagtggctgtcgtattggaaagcacagagtagacattgcaaatacagacgtagaaagacaccgtgcctgctgctaagaggcccctggtcctactgagtggtcagctgtttacactgacagtcccagcgtggtataataagcattaacacagagacatgtacagggtgctgagaaagctaatttttgcaatagtcaaaaaagacctcagggcagactccccagcacagagttccaagcctttacctaaaaaggtaatcattttataagtacctattatgtgccagatactaggataggcactttgcatagaaactcacatttcgactgggcctggtggctcacgyctgtaatcccagcactttgggaggccggggcaggcagatcatgaggtcaagagatcaagagcatcccggccagcatggtgaaaccctgyctgtacaaaaaatataaaaatgagctgggtgtggtggcacatacctgtagttccaactgctcagaatgctaaggtaggagaatcgcttgaacccaggaggyggaagttgtagtgagccaagatcgcatcactgcactccagcctgggtgacagagtgagactccakctgaaaaaaaaaaaaaaaaaaagacatttacattttatctttactgtagctatggctgcctatcccaaggatgggaagtctgaagttcaaactggtgatgatccccaccccaagtcacacagttagctttatagttaaatcagggtgtgcctgatttcctagccataccaggcagcctatttcttgaataacctcccatcccctgtgtctcctttgtggagctcttggcaatactctggtgattggtaaccactgatacgccgccagcagtccacgcttgggtggaaggcaggtttcacgtaactgatttaccacttggtaaaggaacgaggtgacagcaagaccacaaactaataaatatgccggtattgacataatgtcggacctcagtatgattgatgcatgtgttgttgactgggatgtcacatgttcaggctgtaatcctggtctcagtatgactgtgaggacggggccaagtcatttcacaatttgggtgagtgttccaagcttctcagaagagcgacgcaatagaaattcaaggtatgaaattcaaggtgtggtctcagagtcattttatcttacagcttctctgctgtgttttctcagtatgtgaaatgggaacatsacttaccatctactcacctcctgtttgagttcaagggaaggtttgcagattggcctgaaggaagacttctcttgaaaaactcawaccaaagagcacaccgccgtccccaaccctgagccatttctgtccttttcatggaaagggaactgtgttcgccagctcgtaaagccccggcgtctcctcctagaagaaacacccacattgacccagcagtgttcattttcccataaggtggtgctggatagggataggatgtcgccccttgttcaccccttggcaataatctgtttgattcactccaaatgctgcttctgatctccatctatttcaggggatgaccagtctgaataaaaccaatgagcttaatctacttgtggaatgttatagccggaagggattcatagagatcactctatcrcctaaaattctctcttctacatatctcastgttggaaaacataaatgtgactccaacttgtcttttttgttgtttgtttttgagacagggtctttgtttcccaggctggagtgcagtggcatgatcttggctcagtacaacatctgcctccctggctcaagggatcctcccatctcagcctcctgagtagctgggactrcaggtgcatgccaccacacctggctaacttttatttatttttagtagagaggcagttttgctgtgttgcccagactggtcttgractcttgagctcaagaaatccttccacctcagcttgacattacaggtaagagccaccgtgtccggcccccctttcttcttttttaaagtggggtattaaggctcagaaaagagtgtttctgccactgcagaggattgctgacattattagttgctcactctgtccaaggcattgtgctcagctctttgtacagattgtttaaccctcacaagtctatgaatagagtatattacccacttcattttaagtaggaaattgaagctcagggaatcgtagcagagggccccagttcacactgctgatcartgatgcgactgggatcaccacagcccatctggttcagaagcttgttctcctaaccaggatgtgagagacattcttgtcctaggcagcacgttggtggcagaggtgggatctagactgaggctctcattctgtaccctctctggccccarggaaggaaaggggaaggagaagggcctttgggactgggtggatgtaacactttctgccacctctactcttcctgctatagattaaaacagaagctctgaattgcagccacwaatcaataatgaaaagctaccagaccaagccctttcttgtttagtgttgtgtcttctgtgtcaacatctctggaacatagtcaatggcagtacccagtagaagccatatggatactttttctcaagtsttgaaataaattaatggtgtggccatggttctcgtacttcaggtccctgtgagcccctggggtcctacacaacttggggtaatgctatggtcacctgcatcccctcctctccagycctcacctggttttctcttctccttccaagaaaaaacaccyataccattcttaacatctctggaagctgggggtcaggagagggrgatccataaagttcttgtcttccccgaytcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtgatkcgggggaagaagacaataggcaagtaagcaagtaaatatacaagataaatagaaactgtgatgagggarttaaagaaattaaactggtccttgtggaagcaacttcgggggaggaggaaagacagggaagaccattttaaggaggtgatgtttgaacttaagaatcaaaaacagtgcaagygctgcatgggggagaacagtctaggcaaggtgaacggaagtgcagggtccctgaggcagaaargagctcagcctctttgttagctagaacaagaaaggggcccgtatggctagcataggatgggataggggatcgtggtggataccagctaggatttcactgtaaaagaagaaaggaagccactgaagggcattaagcagggcagtgatgttttttaaagatctgtctggctgccttggggagcatgggttcagagagcagcagcagaagtgtgcaggatgacttggactgtcaccttggggccagcctgcagactggtgtggccgaaggagtgccgtgactcctctgccacctctccacatttggaagattgttttgcagctgcaacctcaaaacagaagcctcctaattacsaggtagctttctagagccaaacaaatgctgttgtttctgacaggtaaatcaagacagggaaatgatgacacattcaccacaactgaagtgttgatggggtgtgttgtgacccctggcttgttccaaagcctatgtgggtgggaattctttaatgtctgcctggaactgggcactcagctataaatagagctattttggaaattctgcacctcaatttctaaaaagttggaaggacaggaaaggggagctgtgtttgagatctcagaaatctgcaccccaccttgctrtccaccactggtattccgtcagtcttactaccccctcccacctctagcccaccctctaccatcctcaccaggaaggaggctgcattcatttcaagaactgcttttcttttatcagctggcattactaggtatagacattatgaccctttaatgggcgatgggttaatacctgttgcttttgtgtgcttcctatttaaaacatgtttatctatcccccacccccactttatccaaaagttattcagtgttttacaaagacatgmatattgggccgggcttggtggctcatgcctctaatcctacctgaagcaagagaatcgcctgaacttgggaggtagaggatgcagtgagctgagatggcrcccctgcactccagtctgggcaacagagcgaggctccatctcaaataaaattagtcagtcaaagacatgaatattttcttctaagtagaagtaatgatgacgatgatggtagcagttatgagcaggtaacatgcattgaacacttatttgctccatgyaatgttcacaggtctttacatgtaaaaacaaccctgtaaaataaataacattattctcttcattctccaagtaagctgaggcagaggattccagcrcaagcaatttggttccaaaacctgcccttttaacctctaccagattttggtgaactctctgtctttggaagggtaggtggcggctgcggggagaaatagatgaagctgttacatttggcagcaaatgtaaatcaccaccttcactggctttaatttccccctccagccttctcgccttgccatcaccttcaccctgtccttcctcttcaggccacctatcccttccgattgaccccactggacttctctgctcctggcttctgtcttccctctagtgaccgctgtctttaccttcagctgcacgagctttttcaagaaccttcttgctccctctccatcctctctgttttcctacttttctttggccactgtttttgccacagcttctaggatttctctttcccacaatctaggagaaaggtagagctctcttatgctgggrcaacgctaccaacattggtattccacagcattccaacgattctaaatactctcccagagtagggmggaaaaatcatccaaactacttggtaattgaattcaagagtgatggaccaaaaattattaatgcattcccttccstccaccagccaaagaggattccatctttattctcctcccaaatgcaggctccattaaccttttacctttctttctttccggtctttcttttctatatctttttttttttttttttgcatttttccaattgtgatcatactatatatgcaatttgaggtatttcagacaacattattacatcattacagaagtctcatatgctgtattttataaatatgtgatgcaatcaatcattgataagatgtactgttattttatgtttcactaagagtgcgaagaacattgttaattatacaatgatccaaaaatgtcttctctctcagaatgtattgttttatatctattagaaaggctcttttgacttaggcatagatttctcatacatcaggccatttctatgcctgcctgtgaacacagggattttgaattacaatactgaatcctagtgtgatctttctgaagtcattttaattatcacttaaactcaatatggaaagcatcagcaatgcacctatatgcacaaaaatgagcagctatgatcaagttatcaggaaaaaccaaaacaaaacaaaagcacatctccatcatttataatggcccatcatttataatggctgcctgataattggagatacatgcaccagacttgacttaactgttctcttagtcatcagacatttagatttcaacatgctcctgttaagctctccttacagtgtgtgtggcactgtgcagttgaatgaaacatgccatggccagtggaaacaggcttgggctgatggagagggcctacagggccaggccttgaaggggagggaaattgttagctacacgaccaagagacagaagagaggaaggagtttgtacccacaactcagctttattttatgtaagctctttctgyaaagggaaagtagctctttgtaccaaagcaagggcctctgaatgagagctgggagaggccagaatgggcctgtaagaggttgatgtgtatgagacctgaagccctatgcctttgggaaggagaggaaggactaatatttgtgtggtacaaaggatgtgcctggcataccccatatcttttacaaagacataaatgtcttstgaataaaagtatgatgatgatgatcatggtgatgaagatgagggtgatgatgttgatgatgatgatggtgatggtgatgatggtagtatgataatgctgatggtggtgatggtgataggagggtgatggtgatgatgatggtgataagatgctgatggtggtgatgatgatggtgatatgacgctgatgatggtgatgacgatgataatggtgatgatgatggtgatgacaatggtgataatgatgtcgataatgatggtgatgctggtgctgttggtgatggtgatgctggtgatgatgataatgatagtggtgataatgttggtgatggtgggatgatgttgatgttgatgataatgatgatgatagtgatgatgatatcaacagataccatgtactgagcacttactttgtaccatgcaatgcttatggttttttaaatgcatttacaccaaattcttataacaaccctataagtcagtgccattgcttttcccatgtaacgtgcacatcattcaatcactcaacccttgtcataggtagatactattatcctccttttatagatgaggaaaccttggcttagaagggataagctcaagttcacaggcagaaaagagacagccagtcaagccctgactccttttgtgaccctgatgagattacaggtcctcagtctcctcattgtatctgaagactaaagaatcagaaatttgtgactccacttagtttttctccacccmggagccctcaggccgctggtgagtgaagttcttacccattagggattattaatatactagataagagtacagtctctggagctaggcttgtgactttgaacaaattattttatctctctgagctcagtcycctcatctacaaagggggaattgataataggaattgtcgcaaagagctgttttaaagattaaatgagataatagatataaagcacttagaagagagtttggcatttgctaggctcacagtcagtgtcagtggttcccaatgttactgttttagctgcccccagtcaggtggttgatgagttggggagcctggtgggcagtctggaagagagcacagtgactgcaaggtcagctcctgaycttcataataaggactcacatgtgtcggtcccaaggatccccaagggatactcatggttgaaggtgtctatgtgttctccttggtgtccagcgaatgcctcttgacaatctgtggtcatactcacaacctatgaccacatacgaggaagcgaggtgtcccttttgcagttgttcagaaggtcccgtgggcaggagcagccagaggaacatgaaaccagctcgtaggtggtacttgtggcaacagcagttacagccaaggagaagttaaattctaaagacttgggcagtctccagggaatatactaactgagaaataacatccataaaaataattcaatactagtatgtaaaactaaaaacaataaccaagtgtgactggctgtctaagaattaagcaaagtaagatgaagtgtcttttgctagcaggcgctctcagcaaaggagataaggctgcagtaattctcttcccaccttcgatgggcaggtgcaacctttggctgcagaaattctcacttcccagcagcagctttgagcaccctgctcttaatgtttcttgggcagcagcagctagggaagaaactcagttaaggctgtttgaggacccaaggtggtctcactctgcaacacacatcggcagccagtggtgtgctggtaaatgattaacaactggctctctgaaaaacaaacaaacacattgtgcacctatacatgtacacacacagcttattatttattatttctctgaaatatgggtagcatataatttacaaataagaagaagaatagtatacacagtactgtttcttataaattcgagatagtcagtttttaccaaatgcttctgatttttgctgcgctattatatccattacaaaaccattgttgcagtataaaattgcagtatgtagctgtgacatgaatattggttgatattttcatttttattaagaagtaaggcaaaaacaaaataagacatatgtcagaacttcacttatccttctttgctgaattgkataatggttttaaaatacyaaaaaatatttcttcaatttttttctgctactcataatgtagcatctgtagagcgacacacttttgaatttgagttaatatttcytttttattttattttattttttgagatggagtctcattctgtcgcccaggctggagtgcagtggcgcgatctctgctcaccgcaacctccgcctcctgggttcaagcgattctcatggcttagcctcctgagtagctgggaatacaggcacccaccaccacgcctggctaattgtttttgaatttttagtagaggcgagattttcccgtgttggccaggctggttttgaactcctgacctccggtgatctgcctgtctccgcctcccaaagtgctgggattacaggcgtgagccaccgcgcctggcctgaattaatattttctaccccactttcttaagtcgagacaatcaataaagcaataaatgacacctggatttgtagcgaatgtctatttccatggtgtaaatagtggtaccctgagcaattttaagttataaatatgagatcactgaaagtggagttggggaacacgttattatatagtattttcaccacacacaggatacagtmaatgacttcaagagcataggtaacagtaaaatgtagtaaaasaatttagaagtcatgagttttgagtacttagtactttttagtatgatttatttaatagtaaccttatataatgtttttcttttaattgttttattgagatgtatttcatacactttmcaataagcccatttgaagtgtaacattcaactttttttagtatattcgcatggttatgtaattttcatcaaaatctaattttagagtatctttttgtccccctaaaagtaactctgtgcccatagttggcagtttgtcatatcactcaatcactgtttcctttaaagagcttatcattaaagacagcaggcagttacacaacatcttctacatgccaagaatgtttctaatacatgctttatggatttttaaattgtggtaagatttacataatgtaaaatttaccactttggggctgggcgtggtgactcacgcctgtaatcccaacactttgggaggctgaggtgggtggatcacttggggtgaagagttagagatgagcctgggcaacatgatgaaaccctgtctctactaaaaatacacaaattagccaggtgtggtgctgggtgcctgtaatcccaggtattcaggaggctgaggcaggagaatcgcttgaacctgggaggcggaggttgcagtgagccaagattgcaccactggactccagcctgggcgacagagtgagactgtgtctcaaaaacaaaaataaaacaaacaaaacaaaaaaagttcaccactttgaccattttaaagtgtaaaattcagtgacttttaatacgttcacaatatcgtgccacaatcagcagccatttcagaacatttttaccatcccccgctaaagaaacaccatatccattaagtggtcattccccatttcctccttcccccagcccctcataaccacatctactttgtgtctctatasatttgactattctggatatctcatataaatggaatcacacaatatgtggccttttgtgtctggcttcttgsttttagcatgctttcaaggttcatccatgttgtagaatgtatcagtacttcattctttttatggttgagtgatattctgttacatggatataccactttttgtttatccatttgccagtgggtggtcattgtgtttctacttgttggctgttacgaattatgctgctatgatcatacatgtactgtttttatgttttctgcaaactcctgttttccattcttgggcatattttggggagtggcattgctgggtaatatggcaattttatatttaactttcagaggagccaccaaattgttttccacggaggctgcaccattttatatttccacttgcagtatatgaaggttccaatttctccacatccttgmcaacactttattttctgttttctttgaaggtatgaaattgtatcgtggttttgatttgcatttccctcatgattaatgatgttgagtatttttatgtggttattggttatttgtatcttttttaaaatagaaatgttgattcaagtcctttgcccagtttttaactgggtcatctggcttttgttgttgagttgtaaaagttgtttatatattttggatactagacccttatcgtataaatcctttgcaaacattttctctcaatctatgggtaggcttttttactctttttatagtgtcttttgatgaacaaagattttaaatcttgatgaagtccmctttatctattttggatgttgttgcttctgtttttggtgttgtatctaagaatccattgccaaatccaaggacataaacatttactcctgtggtgttatgatatatatagggttcctggctcataactctcatagcccttgttgcagtctattgttacaatattgcstgtgttaggcatcaggaaacagaatctctttgtctcctgtccttctttcacctgccccaaggcaggactctaatcttycccacctttttgattgtgagtcttcagaccctccccagagagtcagtcctgccttatgccctggggaaaggaatgctgacctcatgaagctcycataaaaacccaagagggctgggtttgggagcttccagatagctgaagacaaggaggttcctggagcgtggctgcctaggaagggctggaaagctccatgcccctaccccatacctcgccctatgtgtcttttcatctctgtccttagtactgtcctttataataaagcagtaagtggtagcaagtgttttcctgagttctgtcatctgctccagcaaattaatcaaacccaaagagggggttatgggaacttccacctgaagcccctcagccagacattctgaagtctctgacttgctattggtgtctgggggtatggggggcagtcttggggactgagcctccaacctccaactaactccacgtagacagtgtcaggattgaattggaggactcccagctgctgtcccctgcttagtatgtggggaaagttgagttgtaaaagttgtttatatattttggaaactagacccttatcatataaatgatttgcaaacattttctctcattctgtgggtagtctttttattcttttgatatcatctcgtgatgcacaaaagttttaacaacaaaagtttgggtgttgtatctaagaatccattgtcaaatccaaggtcatgaacgtttacctctgtggtgtcacccctcctctcgcatttggtgagaggagtcttctgtgttgattgtcatggtggtgtgagagcagaagggaaacatggtttcagaaaagagtttttccctgaaaccacycctctattttcttctcagacttttatagttttagcacttatgttaagacttttgatccattttacgtcaatttttctatatagtttaaggtaggcattcaactttgttcttttgaatgtgaatatccatttgtcccagaagcattgattaaaaaagataattctttctctattaaatggtctttgcacccttatcagagatcaattggccataaatgtaagtatttctttctggactctgaattatatcccattgatctgtatgcctrtccttatgccattgccacaytgttttggttactgtactctgtgtaagttttgaaatttggaattgtgaattctccaactttgttcttcattttcaagattgttttgggtattctgggtcccttgtatttccatttgaattttaagatcaatataatttaaattttaatcatggcagtgttcaataactggcttgcatattttttgaacagtcatcagctcttgtgagccacggttggccagctcccaaacaccatgacatacaacttgcaggaaaagctcattttccagtttttccccctccagctgtaggggatatattttygttaattcctgtgaccatatggcagcatggttaggatcttgggcttcyaaatcagacagttgtaaacttaaactccaattctgccacttattgtgtcactttggacaagttacttcacctctccaagcctcagtttccctgactataaaatgctaacaatagttgttctttccttattggacactcaagaggattaaatattattcatgtaaggctcttagtataacaccttgcacataggaagcatttaatacctaaaatcgagtactgttattgtttcaggattattattttttttaaatttattttatttttttgggacagggtcttgctctgttgcccgggctggagtgcagtggtgcgatctcagctcactgcaacctgcttcctgggttcaggtgattgtcctgcctcagcctccctagtagctgggattacaggcgcacgccagcacgcctgactgatttctgtattttcagtagagatggggtttcatcatgttggccaggctgctctcaaactcctgacatcaagtgatttgcccgccccagcctcccaaagtgctgggattacaggtgtgagccaccgtgcccagctcagcattattatttttagtctacacacagtgaacttaaatctcctctagaaaagtcagaaggtctacstacaactttaagagttcagccaaaagagaccagtatctactaccgtggacaaccctatttaacatggaggagataagcagaaactgaaaagaggagcctgttttctctctggcagattaattttctttctttcttcacccatgccttggacatgaaacacaagtacaaaggttcagagaaaatcaaaacaagactgtggtttacaaataagtagtactagtaacatctcactgttggctgggcacagtgactcatgcctgtaaccctagcactttgggaggcagaagtgggaggatcacttaagcctagggttgaagaccagcctgggcaacatggtgaaacctcatttctacaaaaaatacaaaaattagccgggcgttttggtgcttgcttgtggtcccagctactcaggaggctgaggtgggaggatcacctgagcccaggagatggaggttgcagtgagccaagattacaccattgcactccaccctgggtgacagatccagaccctgtctcaaaaaaaaaaaaaaaaaaaaaaagtgaaaaaaaggaaaatcttcgttgttcttcatcagaagcctccacacagggcccctgaaggaagggcagggaagaagggggttggaggtcagtgggaggaataactctgtgactcagtgctttcctgactaccatctggatgtgggctgtatctgcgtaaggtgccgggacagggcggcctcatgaactcatgggaagcaaacacacaccctccctccgatccaccaggcactcgggtttcctgtgtgtctggtgatgtgctgggtgttgtggatctggactsaacggcagtctcaggtttatgtattaggaagcattcagcaggcaggagcagccgatctgagactggcatgggcagtggagacatcattcatctcctgaaacrtaatttggaggagactgttccagggctggctgagtgactccttgatgtcagcactttgccctgtcgtggtcttggcctttctcttgtgttccccagatgggtttcactgctctaaggatcataccttcgcaggccatctgaagttagtgaatctgaggcatacagaagggctgggtgcggtggctcatacctgtaatcccagcactttgggataatgagatgggtggatcacctgaggtcagaagttcgagaccagcctggccaacatgatgaaaccccgtctctactaaaaatgcaaaaaattagctgggatttggtggcgcctgcctataattgcagctacttggaaggctgaggcgggagaatcacttgaaccrgagaggcagaggttgcagtgagccgagatcgcgccactgcactgcagcctgggcgacagtgaaacttttgtctcaaaaacaacaacaacaacaacaacaaacaaacaagaaacaaaaaatacataraagaggccttctcttcacaagtttttcttattgttttttgtttttttaagggaggaaatttctttcagaagtcagtactggacattcccttatttcaccttgagctacacatcccatagtcagcttagccctgtccctggtgcgggggagcaggackgttgcctgtatcccttagtcattgccgcaggcttgctgcatcacaaaccaccattagacctcagtggcccgcagcaataaacattcgattctcgccatctctgggtttgaggtgaccttggctaagctcccctgcattgctctgctcatctttctcacgagtctggcaatggggctgggaatgggctgatctaggctggacttggctggagtaacccagccccaccttggatctctctcctctacttcccacatgtatccttttcatggttaaaggtagaaacagaaaaaaacaggcagaaacataaaaagctcggagatggcttcctattgcttcttcattctgggccagagcaaatcatatggtcgtrctccagggtgaggaagtatgtcccacttacagactgaaaaggtgctgcaagtctgcacggcagagggcatggataaggggttcgtaaaaacttagggccatttaatacaaatttgtcacatcacactggcttggattgattttgattcattgctctgtcgcccaaacagaattataattattttagtaaggaaagaggaaggatacctttggggcagacaatggatagagcttactatacaagtctatagaggcatctcacctgtagaaatcttaagatgagggttagccaaagcaaagagtggttcagggtgggaaagccaaggaaggccaggatcctcaccaagattgccagcagggagctctgattgtccacagctctgctctctgctcaccccggggatttagcagtaacagaatccacactagaaggacagagtgctgtacagacagaaggaaagacgcasacccaaaccttgataaccatggcaatgcaataggaaatctctttatttcgttggtgctcaagtgataccattaagtcccttaagatgcggaatttccttgcccccgctgccccctttctttctttyatcttatctatatatctgtatctatatctaatctattttttgagaaaggctctcactctgttgctcaggctggagtgaagtgatgcaatctcaggtcactgcaactgctgyctcatgggatcaagtgatcttcacacctcagcctcccaagtaactgggaccacaatgcccagctaatttttatatttttttgtagagacggtgttttgccatgttgcactggctggtctggaactcctgggctcaggagatctgcctgcctcagcctcccagagtgctgggattccaggcgtgagtcaccatgccaggcccctgcctctgtttaaatgctcaaacttggtatggaactgcacagactatacggctgcyctccactcaagaatacaaattgaacattgactttcctcattttttatccarttttgctttccagagacccagatatggcttcattttttaaatgaaattttgcaggtcattagctcataatgattaaatgattctggttattagcataaaacacagctgtagtacataagaggtaacctttattgtttaaatattattcaatgtgcctacatagcacmcagcaaaaaaaactttttttcagactattcagccattatggaaataacttataattacattcagaaatgttgcaaatgcaactcatccttgcagtgggataaacattgcctagaagggtttgaagaggaatccaggttagaaacaatgaaaatttttggctgggcaaggtggctcacgtctgtaatcccagcacgttgggaggccgaggcaggagaatcatttgagggcaggagttcaagacctcctcatctctacaaaaaataaaatatttgaaaaaaaaaagtgaaatttttgatatagaagaggatgtagggcaggtagggctcagaargacccatgccatatagcaaagttcttagtaacacaggctttgggttacagcaggctagattcaaatcytgctgtggtcagaatgtctgtgtcaccccagcattcatttgttaggagatggggtcttttgggagatgatttggacatgaagacagagcctgcataattgcatgagtgcccttataaaagtgaccccagaagctgccttgcttcttccaccatgtgagaaaacagcaagaagaatatccatgaatctatgaggaggcgggactctggccagacattgaatttgctgcttccttgatcttggacttcccagcttccagaaccatgagmaataaatttctttttttcaaagctccccaggagtctctctcggtctgttctggctcaggaagctkccttatttgtaacaaacaaataaacaaaaaacaaaataaataaaagctacccagcttagattattttgtcataaaagccccaaaagactatgacaaatccttcyatctatgtgtccttaggcaaaatacccaaactctctgaataccaattttctcatccaaaaaaatgggtgaataatatctaagaggtaataaccctaatacctcttagtgttgctgtgagaattaactaaagtaccatcttcatgtggtcagcacaatggctgacacatagcaagaycttggtaagttatagctgttgctgtcattcctgcagctgttatctttgtcattacgcttactgttattattagctctgctatcagagtgatgctgtggctggagaagatggagacccatgtgttcaggctgtgagcataggcagatcctttctaatgcagaaggtgyagacacagggcacagaactgccaactgtggctgctgacacctgtctgactttgactgggttagtgacaaagaaatgacttkccttttgtatgttagccctgtgcctggcatactgcaaatatctatggttgataaattaatgttatcatcatcacgtaagcatcttgggaagtctgtaagtaatgggagttggaggcttaacastgatctttgagctggcgatttttccagccaactcattttggacgttggtgcttaagcatatcctgttttcgagggtggtgttggtggtggaggaggtgatggtgatgatattgataatgacagcaagaatgtcttacatttatagagtgttcaaaaggtgccagatattgtgctaagtgctttgcgggcattatgttattcacacttcacagatattctctttctacatgtaaggaaaaaaaggcataaatactttatataatttactcaggattttaagtagagggtagattttaagtccaggcagtccaaccccctgaaagctgactctttaacaccatatgcttctgtcttcctggctgttttgtgaatgagtaggatggaaaggagatccttgaattgggaaggctacccatggactacaactagtacttgtcttcaacctccatctagatggagtgctcacaagatcctctacatcaaacctggcttcttagtccactgctgagtcttcccaattctgaaaaaaaggattcagggtataatttctcacacagatttctgggacagtgctttcttggagcaccacgcctcactaatggaacactcatgtataattctggcttttgaatttttatttttttattaacatacacagtcagcattgggtgtggctctggggattcattctagtgggcaagtctcatatttctcaacctcaggtttttcatctgtaaatggggacaatactgacatctasctaatgtccttgaggatggaatgagatattgagtataaagtatctagtagagtggctagcgtatagtgagtacccaataaatgcaatagatgttggcttttattactgtcaagtggaaacaaaagtataaggtttaagtaagcgaacgaaatggaagataattgaggaagaaaatcagatgatgtctaagataaggcaaagaacattttgtgaatgtttaaatatcctaagacccactaaggaagtttgtggcaatatttgctcaaagacagtatatataataaatactttagactggytaagagaatggctctgaatgtctacctagctatcacatttagaaacgccccttgccttccttccaggactttcttccttaatcaggattgacttaactgttaactcctagaactgtcgttgattgcttgstgaagtaacaattagtatagacattcagcaactggcctcccatactgtgattcactgacccagactttgacatcttgggctcagccataccctggagcctccaaatcctctgctggatcctttaagtccagacatctgacaggggaagaaaaagtacaagtttccaaggagttattataggtcaagcctggaagcagtgaggtcacttccacctgcttcccattggccagaattcagtcacatgatcacaaccaactgcaagggattctgggaaatgtagtctggtgatgcctcgaggaggcaagagaartgttttcagtgaacacattgccttctcaggcttgctttctattgtagattgcttacaatattgcttttaaattgcatggtcttgtacaaatgatacgagttttattttgccttttggaaggagttattgtccatatttgttagagatatatctgtttatcagcatcattgcaaagtattagaaagggccctgcctgggctaggagccagaagcattcttcagttcccaacggccatccagccactcattgctgtgtgagctstggctggtcagtaagaacctttgatcccatgtttctttatcttcttctttttttttttttttttagccatagtctcactctgtcacctaggctggagtgcagtggtgcgatctcggctcactgcaaattctgcctgctaagatcaactgattctcctgcctcagccttccaagtagctgggattataggcatgagccaccatgcctggctaatttttgtatttttagtagtgccggggtttcaccatgttggccagtctggtctggaacacctgatctcaagtgatccacccacctcagcctcctaaagtgttggggttgcaggcgtgagccactgtgctgggccccaactttctttatcaatagaagtggggaaatcgtacctgccctgtctgcctcattggatgtggaagaaatgacataatccatgagagtggcttctgaatgaagagaacctgctaaagggaagacatgatctcaagtcagccacctctgacccaaataagaacacataattacaagactgtattgtataatcatgcaggacacaaggtatgcaattttaagggtcaaagtggtaaaaaaaaaaaaaaaaaaaggaaaatcaaatataaaaaggcagccccgacaggtacgagcttgtagtcatttccccaaatgcctaaagtagacccattcccattgctctaatttgtagagatgttctcgaggcagcctggagtcaagacaagagtgccagccaggattgaggcactgttccaactccagtctggctgctttttcaacctggggctttagtcatgtcaatattcctgagcttccatgtgcttatttgaaaaataggaagattygtccagtctcaaggaactatgataagtagcaaacaatatcccagaaaaatctccagtcaaaaatccactggaggccaggtgcgttagctcatgcctgtaatcccarcactttgggaggtcgaggcaggaggatctcttgaggctaggagctcgagaacagtctgggcaacatagcaagtctctgtctctacaaaaaatacaaaaattagctgcgcgtggtggcgcgtgcctgtagtcctagctactcaagaggctgacatgggaggattgattgagcccaagaggtcaagacggtagtgaktcrtggtcacaccactgccctcaaccctgggtgacagggtgagaccctgtctctaaaaacaaaagcaaagtctactaaaaattcactggagctatgagaaatcttagcccatggaatccagtcttctccttttgtttctggggaagctgaggttcagagagatggggtagcttgctcatgttatatagggagcaaaggacagagcttggaccagagcgcagaggtcatgataccaaagccacggcacctttgccacaacgtgagcaagaaaggatagccttgttatttttaatccaaactgaagttatgctttgggcttccagaatctgggtcaaaaagagtagaagtcaggctcagattgacgcttttcaagagagagaaaaaaaaagaaaaaaatcttgcctttccctagctagaggtcagatgtcaaaaaagctaataacacaacccaaggatgtcatcgacaaatgaaaaaactggtgcgatgcgggaacaaaagctattttatcattaatatgccgcttttttgttatgtactcatgccccagaaattattgtacagcctgtacttgagtccttagacagaaagcatcttatcattcacaagcttagctatgcaatatattcctccctccccccaaggtagttgttgttgggtttgtttttttttttttaagagatttacagtgatctttccatataggtttttctcgaaacatatatatttttaatttctcaccatctcaggggtaaataaatatattaaaataagctatgggatgtacagcagagtataacaatgataaatgatgttgtgtgtaatttttctactattaacataaagtaatataaactgaaggacactggtctattgagagacttagaagctaatgttccatatcagatgcggccaatgtcaggactgaatacagattaggcagtgtccttttctccccaggggaattaaagtttgagacaccacttgctgccagtggttttatggcattttgttggggccggtggtgcctttcttggtctattaattcaggagccgtaaacaacaatgtgagcaaaatgcttttccggtgggatgcatttcatttatatgtgcttgtatcgtctataccttgtcaatccattttgtcacaataagtgtttttaaattgtgtagattacctccacttcattatggttcctggcatttgtgtcttatgcaaggctattatgtgaagttaggaaatatttaaaactctgcctttctaaagaaacagggacacggtgcagaaaagttcatctggagttaggcttgtgtcttgcygtctctttaacggagagttcatgggcwgggtacagtctgtgagaaggaatgaaaaccccagggtagatgctaacaaaaatcacttttaaaaaatgtatggtgtccatctgggttagcaaacacatgctcacacgtctgtgcttgctggatttttaagaacttaccagcatttaagrttttcttatgaaactgattttwctcaccagggatagagtctcaaagttggaggtattttatgttgttttaaataatatcgtcatcacatgtcattttagaccccaaaagtccactccgaatctctgcktatggaattgaggaggggtgaggctgtcagaagccgagggacttggccaaggtcacatggctttggacggcccccctgaaccttggagctcatgttctgtggcactttgcatactgacctttctgctcttttatgctgcctgctctctaatattgtccaaaaaccttctctaaagaaagtacacaaatggagagagggggaattggrcatgccattgggagaacaaatttatttagatatctttggctgtgttgacagaagctgcccaattawacccaatatacaaattttaaatgcatattagtcaaagttccagttatgtagctttagaaaaatttctatgtgaatgactacttttccctgaaatacgtcctccatctcaggcactagttaggaacttcccccgcgtctggcattgcaggtctgaggttccgatgaactcttttttctctccttccccattaaaatgggcagaagggaaggaacacttgggtttcatcaagcacattgttatccttcgggttggctctgagatgatacgtttgtcacggttcataaattttatctttgcactaaaaacagggttagaatatcttcaatgcaattataaaaatgtattaaaactgagaaggagaaaaaatatggcggtagatgcgattttaatgattgtgtaaatgttcattgttccatggcaaaaaaaaaaagtcgagcttttcagccacagtatttcagacaaatgccagggcctgtttttctgtaaatgtgtaccgtgtgcttttaacacaaagacaaatatgttgctttaaaattccgcttggaatagagtgaccagctgtcgttatataatatctgcaggctatgattgtgtaggtgcctgtagtcactggctatgaaaatggccccaaataaagtggtatccacacttcttctttctcctacgaatttggaggtctaggaacgggggtaagcctatatggtcakaattagcctgcaaacgtgaattaatatgcagaatctgtccccactgtgatagaatttgccattcgcttcctttgctaaatggcttgcagtggcagctgacggccaaaggggaagctgagaacagcaaagattcaactgaaaacattttagggggttcctgacttcaggcctcttttcagaatgagggaattrtctaaaatcccaaatgcattcttagctaaggtcagtgtgtctgggtctgtgtcaggcatgtagcagccacagcaaacttctcttgagatagcatctcctccccagcactcacttgacagattgtggtcagtcaacactcagtctgatagtttagaaagcttttgcaaggcattccccaatataaccattaagcatcaaactctcaaatggaagtttcgaaaaacagaaaaaagtgagcataaatgcaaactatcaccccatgtaatagtttatttatttcatgctccacttttctgggcagttttgttgtcattctctctctacctctttttttttttttaaagacagagtctcactctgttgcccaggctggagtgcagtggtgcaatcttggctcactgcagcctccacctctgcctcccaggttcaagtgatactcatctcaagtggtttctacctcattaaaacaaacaaacaaacascactcaccatttttgtggtgggcatggtggctcatgcctgtaatcccagctctttgggaggccaacgcaggtagatcccctgaggttgggagtttgagaccaccctggccaacatggtgaaatcccatctctactaaaaatacaaaaattagctgggtgtggtggcatgtgctataatcccagctactcaggaggctgaggcaggaaggtcacttgaacccaggaggtagaggttgcagtaagctgatatcatgtcaccgcactccaacctgggtgacaaggctagaccctatctcaaaaataaacaaacccttgctattttagcttccgatgaggatatttatccttctagcatttgaatgcagccaaagtccttactgggcaaatttttgagctctcaccccacattaacaatttctctccttaactttgtttctgaatgaagttatccacagagttttaaagtgagtggtgagttgtggatacctcttccgagcaggtgcacccccatcctgccattgtccctctccttagtgtatatggattgatgacatttcagtttcagacaaagggacatttcattttttttaggagattaaagctgtgtaagatatacaatttaaactgaatgttgatattttatagattgttgagtccgattgtcctgatctaaaattaactggttttgtgatttggtgtaaatcgcttaacctctttcaatgttttttcagcaaaatggggtaagaacagaatctgccttgcagagaattaaccgagatgatgtgtggaaagggcctatcccagaggctggtgtaccatggtggcttctyctggctctgctggttattattattagcattattgtcattgtgaaagtgacaaggaatgtgcctgtgcgtgaatctcactcttagatcagacgtgcttttgaaatatccagatatatacaacacaaagagcgaagtttgttttatattttgtttgtttaggttttttttttttttttttttggctggtgtttactgaatgcgtgcaaggctttctgtcacaggctctgtgttaagatatttaacgggtgtttcattttcccagcaatgctataggacacagaaaggaacataaattgttacagagagaaagagggtaggtctgtgaatrgaattgaacaggtaggttgaacaagataaatgccgaggaagcaagtgtatttaaataaacagtagtttatggaaggctttggaaatccactatattaatctggaattttatgaaattttaccagaacttaaattattaatagttgaggacaaagaccaaccattttccccaaaacttagtcactagttttgtccttaacaactaattaataaatatttgtgaatatagtgagtgactaaagtaatgcattaatggttgaatggctggccaccgtgcctcatgcctgtaatcccagcactttgagaggccaaggcaggcagattacttgaggtcaggagttcaagatcagcctgggcaatatggtgaagccccgtctctactaaaaatagagaagttagccaggtgtggtggtgggcgcctgtaatcccagctacatgggaggccgaagcaggagaattgcttgaacccaggagggagaggttgcagtgagacaagatgatgccattgcactccagcctgggtcacagagcaagacttcatctgaaaaaaaaaaaaaaaaaaaaaaaaaaaaaaaaaacagaaaaatgaacgagtgagtggcaagaaagatgaaatgattttcatcaccaggcctgccatggaattcatggtgccttgtactgtggccagtaggtgcaagagtatctagtaggtgctttatttttaaaaaatgtcttggaatcagtcatagtttaatatcaattatatataaattagtcttgcaggatccaacagttctgatttattccactcacacaacaagtcagttcttaacacaaaccacataggttcttccttaaataaaaagctgtggctatgaagaagtgagagtttttttttttttcctctccaaaccaccacgtgctcttgtgtgttattgtagtggcttcgcagagtatttatttggccagaaagtctatagtcaaattgctcttcattctcaagtgtagtatttatttctccagctcatgcagaattctgttttatatggaggttttaaatttgtgcagaaaagtattacgtgggtttcaaaggtactcttttttcttttttgagacagggtctcgctgtgttgcccatgctggagtgcagtggtgcgatcacagctttctgcagcattgaccttgtgggctcaagcaatcctcctgcctcagcctcccaagtagcttagaaccacaggcatataccaccatacctggacatgtttttaactttaatttttatttttgtagagatgaggtctccctatgttgcccaggttgctctcaaactcctaggctcaagcagtcttcccaccctggcctcccaaagtgcaggcattttaggcatgacccatcgtgtccagcctaaatggcattcttggaagtaaaaccacaggggatctgttggaagtggcatgatggaggaattttaaaagaattgaacaaataaaatrgtcagagctcaaaaattgagtactgcttygtttctcccaaataaccatcaccagacaaacaggtgtgtgtgtgggtgggggaggtggcctggtggtacttcatgatcttggaagaaggaaggcgcccctccttcttagctgattgatgatgagatagaaagatagaaacagccccatcactatgagatggaaacmcttctttccttcakctgacttccctctccttcattcccaaccaagtttgaccccgccgcagtggagattgtggcagatgggtcagatagcatgtgtcctgtcgctgtcacaastttttaataagggctgggggtcctcttgaagagcccaggaactgcagtccctcctctatgccttcccctgaacacagtgcrccctcactaataaattctgagggctgacactgcctgagccggctggtctttgccctcaatttcattgagatgggccattgaaaactcattacaagctgtttagactctgactttgacttttgctcggcagcgaacaaaattaacagctcttggaggtaggaaaaaaggcgctcagccaaattaaaaaaaaaaaaaagaaagaaagaattgaaatgatgagaaaagacttttaatattaactccattagtcatgcaaacaagcgcacatgcgaagcgcatatgttctgcgtgtggctctcatttggagcctgatgagaactgtggtttctcccactggagggaaattcatacccaggtcttacacgtagctcaaaatgttttacatgtcaagcaatgagcctttgagtgtagcagaattgcttcataaatttaactatcactttcaaatttctgttttttttctaatttagtgcttgatagttttttatgtgataattttaaaatgctgtttgtagcaaaagttaccttgatagttcaggtgtgcagagaaaattcacagccatcaatagaaaagaaaaaaaaatcctgtttataccttaggcattctgtgatccttasgatgtagccatgacagtattacgggttttaaaagccacccaagtaatctaaatttcctccaaactaacaattcctgaaagattgaaatattgctaccaatgtgtacggatggtttccattgatatttgggaagtttccatttgtatttgggaagctttgcatgagcaaaatgcccctttctcctgatatttgcaacccatcttaaaaataaaagtacttttctgcatgtggtcttgtacatgaaattaagaatatcactaccaaaatatcaaaatttaaggactagattgtgaaatgtttaaggtaggcaaagaatatttaaccaagaaaggaaaagtgtatttgagagagacctgatgagttcaccactgcctctggagaatcaaatccaaaacagcatatatatgtatattttttagagacggagtctcaccctgtcgcccaggctcgagtgcagtggcgccatctcaggatctcggctcactgcaagctccgcctcccgggttcatgccattctcctgtctcagcctccggagtagctgggactacaggcacccgccacctcgcctggctaatttttttttttgtattgtttgtatttttcatgtttttcgtagagtcagggtttcacagtgttatgcaggatggtctcgatctcctgacatcgtgatccgcccgcctcagcctcccaaagtgctgggattacaggcgtgagctgacgctcccggcctacagcatagatttgaggcatcttgaaggtagatgcagaagagtgggatctactttggatttttagattaatcactgttaagacttaaacagcttcttatttgggtgaaacatgggagtgtcaaaaataagtcactgtcactctttgccaacttcctttaactctttatacggctatatctccatagatatccagtttttgttttgtttttgtttctgttttcagttcctctccaaactgtcaaggacagtgccaagatctgcgaatatagaaagattaagagtttttttctgccttgttgggtcttctttctagcatgccagsaacatttttctcatcttttgaacattagggamtaacacccaatgccaccctataatctcgagacagaagtggaggatcctcttaagacaagaaatctttcaaagccaaataatgaattaatccaaagccacttgaggctctagatagatcttagcagtcaaagcaataaatatataatcccataaatctaaactttgtggtatattcattaggctgtctgttttcttttctttcaaatgtttcacttaattccctgatataataaggcttccaaattcttggtgtttttctacaaccaagaccttgaacttttkcctctcaggatttctttcatgagaacccattttctggccatttggatatcattgatgagggaattgaagcatttccctattctttagagtttcattaaagtttgactatattccagtaacaattgttgcataacaaaccacccccaaatttagtggcttaaaacaacaacatttattttgttcaggaatctgtagtttcagcagggctctsaggaacagcttgtctctgctccagcatcagctgaagcagcttgaaagccagggtctgagatcatctgaaggttgttcactcatgagtctgaggawtgatgctgactggtgggtgggacccttgctggagggtctattggctggaacacctacacattgtctccatgtaccctgagcttcctcacaatatggcggctgggttccaagggtgagcgtcccaagagaaagaaccaagcagatgctgcattgccttttatggccttccatagaagttacatagccctaggttttcctgcattctattttttaggctgtcagacccaccccaaccaggtttgcagtgagaggaaatagaccccacctcttctggaagagaatgtgggactggacatactgccatggccacttttgaaagatacagtctgccacataagcaaacagttcgtgtcctgcagtgggatattgggaaaagaatggtatttggcaaggggtcaggaaacctgcttttgaatcctacctctgcctcttactagccacatgactgggtcttagcatgctcatctatgaaatgggggacactaatgctgaccccacatttgtgctgaggattatgcaaataaaatctgtaatttgtgcaagcatccaccaagtgcctggtgcagactggatgctcaataagtctttggtgggtccatgtattgaattggaatctgcacattatggccattatttaggtttmttgtgtcctaatctatgtcactgagtacatccttgctgtttttcatgaattttccactgagtcgcaacatgccactggccagtgaaggtcaggcaggaaacagattaacaacatstcataccacaatgtcaaaatacttaaaagtgtttacagatgccagtgacacccagtgaatctaaaacaagaggaccagagcagaagtaaaactattcttgttcttctaagcttgaacacaggccttgatgttttatgattgttttaaggtccattaatcgctgaatcatgaggccatgtaaaaaaatgacagctataacatcaagggcccgggtttattttaaatgtttttgcttctacatggattctaattaacgacagtggctaaaacctgattcaaatgtggcaaatgtggagtgccatgggatgaagccagtcaatttcatctaggagcattttatggcttatggaaagaaatattctcttagattgaagggcgccagcctgtaatgggcatcagctgattctcagaaaraagaaacaacgtactgttacataattggggcttctccaaagtggcctgaccaaactgtagagctgcttgtttgtctgatacggtagccattagccacatgtggctatttaaactgaaatgaattaaagttgtataacatttgtaaaaatcacttcttcggtttcattaactagcctcatttcaagtgctcagtagctacatgtacctaacacattggacagcacggttacagaacgttttcatttcatcggacagtttaactgctttggagactggttctcctttttctttttccatgttcactccagaattaaagtcaaccagttcaaatgtcccatctttccccacagacatttgtgctcaaaggcatccccttccccatttggagactctcctagggcctaggcccaagcaaccaggactccctgtagtcaaccccactcctcaatttttggcacccatgttattccacctcaagatcatgtcctcttttaaccyctctgaatatgctcctcctgtgatacccatagggaccctgaacctctagtcctcaagagcagtcattcacccctttggactatggatccctttgcaacccaggaacaactactgtatggccacttcaaacctgtatatgctgcaagtattttatactaggtagggtaaataataggtcttagatataggtgcaaataattttcaaatatgggtaaatgctattgggatgtgtaaagtagaaatccattttaaagcgttattgaatccatactaacctgatcattacatatttactaattgatgattactaaaaatgtggacctttgtgaatttccgatgtcayagaagggtgttcttaactggaaaagtcagtagccaacattctgggaagtagaggcctcttcctcactgcttcattggtttaaaataaactccaacagaaaaacatgccatcatctttaatttcctgcatcagctaagcatttatttcatgtagtcctcacactagattgagtggttccatattaatatcctacgtcaaagatgagtaaattgagatgcgkaggttctaatttgcccagtgtcgtggtgtgtgatcttgaccactagcctaaactgctattttatgtccacccatcaacctctacggctgcccctcatttgaacacacaaaatatagttgtgyggcttggtggagccatctaaattccgttaggccatttgccaatgctgctattaggggcgaaatgtcatgcgcttgatctaaatgtacttaggagaattctcaggacctgatgaattattattcggaattttatggcctcacaggttgcaggcttcataccaactgcagctaatgagctatgggccccgagaaacactgaggacacacggcgttctgcacacagagtgggctgtttctgtctgttctccccctgcacccttctcagatgcaatctcaagtcataggagaacttgtgcaaatgtttctcctggatggtttcctttagagcatgtgtcctataacttgaaatggttgtctgagcagaatgtttttagaagttagatttttttaggggggaaacaggaaccaaagcaaagccaatagagatcttgaaaaaaaaaaaaaaaagaaaaaaccaccgtggtattctaggaagaaaaaagcatttttcgaatgaaaactttttatkatatttgatatattctgcttcccttccctagtatgtattaatgagatgaaatcacttcttaattttcaggttaatattaaagttgaagcccatccctctaccctgaggactctgccagcctctggcagtattcctttccaacttccacttgccccaaataggtagaagttagcctttatttttggtgtcatgtcttctttccctcctcctatcagtttttcagaaactscagaaatttaacctagtacacaggggccccccacccctgtttccagatgccttctagaaagaggactgggagtgtgaatgaggccatgtgggctttgtttgaccctgtggttgtcatgacaatttctcaaagcttagctgggacaggaagaaggaaggggaggatagcggtgtgttcagtgtgtgagctcctaaaagctcttgggtcactgttcccaggggatgatgaccctctatggcagatcagttgcatgtgcatatgagctttccctcctcccgtgggttagcatgttccacactcaccttctcaaagcaaagtctcccttaggggacccttggtatcctgttcatctggcaaatctcagcaccaatagaaacaccaagaacatggattcatcaaaggaaaaatgttgaagtttccatttttatgcttcctggtaatccttcagcccttgatggaaatttccaracctaaaccagtgaattaagagtatggggaagaggagccctcatacagttctgttaaatggtcctttaatattcttcttcagagtgacgggtaccccttgcctatacattttcaaaactacactgaaaatttcaaaacatttctatcagaacacagtcttattctcagctgatctgcaatttccacctggatctgttaaatggcagcttagctatgaaatatcatgttctgcccaatcacctaccctgcctcatatgatcagccggtatatttatgtggacacrtgcagccacacttgtttttaacatttgagaatgacagcgtattggcagttcatataagctatcaaatattacatgtcaactcagaaaacatccctaggaagtattatgggaaccccctgtatcacttgagattcttggatccatatttgctgttaacaaaataaattaatagtcaacaactgattaaagcatttccctgctaccatgattgccttgacaaattctgcagtgctggagtattttacctcccattatttcttccgctgaacaggacgtttggttctaattgttaagcctgcctaatgctgattgaagcgggccatagtatcaagggtggaagaaggtgggaatataaactagatttgctcccttctgtaggaataactctatgaagactttctttttggagacaaatcatcttatgcaggggggaaaaaaaactccctaaaaaagacaaatgacagcgcaagatccaaaaagacaagtgctcagtcattttgtcataatgccagaagagacagtaatgctgtgtggactatgcattcagacatttagaaaatattgcaggcagagctggggattccgtggccagagcatatttggtgaaccgaggacgcatcaaagagcttctctggtgttcagtaacttgcactgtatttcagaggtttataaagggaagggacaggaaagcagtgtgccagtaagacaactcctcttctcgtctggattttagaggaatgcagtgaacaaatgatgaaaaagtctgaagggactttggtaattcagtatccgaaaaacaatcagtgttttgtgacattcttagttgtgatctaccttatgttgtatacacatggtcactcacatacataggtrtattattctgcaattgctgagtaattgatgatcsttcattctctctgtgattcataggctctctgggttggataaatcacttcggggaattatatctactagtatatttatgtcactagaattcctttgagaagctatcactgtgtacatttactgtatctattaactttcttcatctccctcttcctccctttcttcctttcctttccctttcctttctcctctcctgtcctttctctctccctccctctttcttttctttctttttcctttttctctctctctttccccctttttgtatttctaggagaaacggggtttcaccatgttggccaggctggtctcaagctcctgacctcaggtgatccacctgcctcagtctcccaaagtgctgggattacaggcatgagccatcatgcccagcccccttgtcctcttcttataaggctactaatcccctcatgaggggacccatcctcaagacttcatctaaacctaacaacctctccagggtcccacacccagataccatcccactgatggtcagggctttgacatatgaatgaggggtagagggacacaaacattcagtccctaacacttggtcaagttacttaagcttggtaagcctctctcttcttactgagtcatgagsataataagatatacctgttagggttcttttgaggaataaatggaatttttaaagaattgtgccagacatgtaataattacttgataaactatagctattataacaccatcaaagctgtggttcttaccctcatcattgtttaccctctcacacagtaagatctttctgaaaaggatcaagtctcattctcttttgaaccccaaagtccccagccaccacagagaccaaatacagtaggtaccaatgcatggcaatgcataggaactaggtgtcctaacttggcactgtatctgccaattttttaaaagacaagatgacatcccaaagattggggcatatttaggataatgccccattctgtgagggtggacattatagaggacatcagcagccagccacaggccatctcttggtgccattgggttttgagaccctcagggtgacaccgatttaacatgacaggtcttatgttcttgggtaatgtcaaacaacttcttgaaaatatttgttaaaaaaaacccaaaaacagaaacatatctgactgggcatggtggctcctgcctgtaatcctgacactttgggaggccgaggtggacggatcacctgaggtcaggagttcgagaccagcctggccaacatggcgaaactccttctctactaaaaataaaaaaaaaaaattgccaggcctaggcgcaggcacctgtaatcccagctgctcgggaggctgacgcgcgagaatcacttgaacccaggaggcgaaggttgcagtgagccaagatagtgccactgcactgcagcctgggtgacagaatgagactccatcctcccaccccctaaaaaaaaaatctatccaaaggccttgactaatgcagaatcagcactaatttacaagccccataaactaaagaccccatgtttgtgttataagttttcaaactttttaaatattttcccctgtcttattttctatcatttcacatcttcttaaacacatatatttttaaaagaggttttgactcactggtgaatttgtcttaaaatggaaaaataaaatcaaatataagaattttgttatgaatctttggggaaacacaattagggaatctaccttaataggtaaacccatgtaatttcttatttccgtctagttataggaaaatactgagatacttgtgagatgttttctttttttttttttccaacttgtatacacgttgttctataagtggttgattgtttttyaggaaaaaaaaattcagcatctcaaatgtacctttaatattgcttctgatttttgttgttttgctatcatagcgttacctacctcacagagatgttttaggtcataagtrtttttcatttaattttttttccccttmatttcctttttttccctcctaagctataaatatacagccttaaaaaaaacactcagaaatttaagtccaagaagcctgcttttcttgatacctttcaagtgctagattaataacatttttgtcaggtggttaccagaatggaggatacttgagctgagttttgctagagtccaagatcatctattctaatttctggggacacatattttgtcctggttagagagatatataatgatgcctatctgattctgtggtggtctggctttgatgtatgtatatgtgggcrggaatgtgtgtgcgtgtgtgtgtgcatgtgtgagctyctgtgtgtgtgttcatcacgtatccattgtgtctccaaggtcttatcaacagcaacaaaaggcctcctttgagatcaatcacattcattcgatgtttgttttctactacctgatacttactgctttctctttgtcgccgttaattttgtttgtcatatgtcagaccaggatgagtggggcacatacagattcagctcattttattttttttctcccttccttcgtcaccacctttgctaatttcaggcggtcagcacatttagcaagcatgtagctgcttgcctgagcaagccattaatctatattagaaaatgtagaggccccagtgttaaccttcctgaagcttgtctccccacccccaattctataggttctattatatctccgctggtttaaggcaactgctgtttcttttaggagttttcttttctttccttgctgaatatctgcacttagcaatactgcccaggcacatgggctgtggctcaagttttcagtgcaggacagtgtgtcattgcaggagaagacagaacccggccagatcctcccgctgccggcaagcggagtcagttactgggaagccataataattctktcttctagagaattttggcaaaaatgtgcctccatcttacatcaacaatttttcatctttctggaatttttatttccccttcccctcttgttcctttttatcctcctggtgaagtatctccttttccctaaaaaactggaaaaaatgcacttttctatattaattcaaatcatattcaaaaaatactatatgttaaaaaatacgatgtttctgtaatccttacatcccctaataaaaccactgtgtgatgaaactaccaagaagcctctcttgaaaaaaaaaaaattaagtgaacctctactttagaatgttggcttttcatatatgtacaaaacaaaagaggttgcagtgatggcgtggataaaggcacctgtgtacttttccaacctatccaatttcaagatgtatcctttgtggattacattggttcttttctatggaatcatgcaccttagacctgggagaaaccagcgtgacatccagggtcaaggttttccaatcaggtattttgggggaaaaagttctgccttcatgtaacaactaatgtgacatggcagtgtataagacattacagccaaggccttctggttgaagttggggaactgtgggcgttgtccccactagtcctgtcatctgcccttgcaaaaccacccttgggctctctcgcgtgcggtctgtgcaccagctacctttgtgctccccacattcttccacctggcctggaagctgaccatagttggctctcttgccctttcttcttctggttggatttagcaatttaattttcaggcttgctccctgcagggtgtcacttcaccaccttcctctgtagaaggtttcgtccaggccgggcacagtggctcacgcctgtaatcccaacacttcgggaggccgaggtgggcagattgtctgaggtcaggagtttgaaaccagcctggccaacatagtgaaaacccatctctactaaaaatacaaaaattaaccaggcatggtggcacacacctgtaatcccagctacttgggaggttgagacaggagatttccttaagcctcggagatggaggttgcagtgagccaagattgtgccactgcactccagcctggctgagagaatgaaactctgtctcgagaaaaaaaaaaaaaaagaaggtttcatacattttagctgacaagggcaggagctgttcctgctgttactaactggagtacattgcatgaaaccttgctgtttccttaaaccctgcaccgacctttacaaacagtgcctttactaaacactttttacgttacccgttttgagtgtaccatctgcctcttgccaggaccctgaccaagaatttgaaatctcagaccatgatgacctccttgcccaatgcgtaagctgtcctccaaaacacacatttatgggggcagagggagtctctctggaaggaaacttcgtctgagccatggctccttttgcttcccctgggttttaatccttccttcccttcctgttcttttaaggaaatctgaaaaggagcaaaagagctttagaactgcaatgcatctgtctgaggccaaggacagttgtacgcagacctctctgccagtgtttcagtgaccctcctcttgctgcttggctgcctatgagtccatgctgacatctggctctgtctgcccaaatataaacttgagagtgacttccaagatatatacagggctcagaggttctctccccaacccattcactggccctgctctctctcgatgttcccaagtctcctgggtgaccttgtgtgtccttcctgggatattgctcaatcaccctagaactgtaaggccaagtggtcatagccagaacatggcagaaacattcctgcttctattctgcttttctagcatggaatcccctctgccttaatgtgaataaatactccccaaaatgaaggcagaatccagtatctgttgtttaaactaaatccctaactggaccccctctgataaaccctctgataaagaattgatgtaaaatttgggacgctggataggaccaggaagccagagaaagagggcacccttttcttttctagcatttgagttcccaaagaagtaaaactctgtgaatgttcacttcattttttcctgatatatcgaggactccagatgtaacctcattgatagtcttggtgtgttcttcagtatttgtgcttttaatagatattgcaagtgtgtttaatgtgaaaatagaaatggagggcttttaaaagagcttactcaaaatcctgccaattactgaaatctaccagacaagaaggagccactcyttttttttttttttttttttttttttttgatacaatgaggggaaatgtttcttccacaaaagcctggccgtttgtctttaaaaattttcatcttttgggtactgagttgtaatagtaaatacagatgtagctgtgtcacattaaaagcacaaccaaattgtagtacaatgttcaggacacttttatgtcactttaaaatgtagagtatcatctaaaaatgagcaattgctgtgaagaaactggggttggctctgattttgtggctcagttttttttggtttcttgagaagatcatctttaagtcaaaagttatgcaatgccaagtactcatctgtgtaatctatttcagtttccaaaatttttcatcacctggttacaaacatctgaaggcaagaaatagccaagattccattgcaagtcccagagtaagttattattagacagaaacaaacaagtaaataccttgggcctgagctattgcccaaaccagtcctgacttggcttgggttctgaccaactgtttttgatcccacagtctgaagtacgtttgtggaaatacaaaggtcaaaccttcccctaaccctctgtaatccctggtggagctaaggaatgaaaagttgcttaaacattttcctgttgccagtttttcttaaacattagtgctattcttttttttttttttttttttttttttttttccttcttcaaccctgactctgattcacaaagaatagggaagcttagccaactgcagtttcaaagtattgcttcttaagcctgggccaagtgtgtagacttgatagaattctgattaatgcatcttattacattaattttagaagaaaccagaaggcatttctcctattcctagtgcaggccagcctgccagaagcatttgcctccttaaagagctaatatcttcagctaccaacaatcataaaactgaaagatctatcggaagagttggcttctctggatgtgcataaggcacactgcaaaatagatgtacagcttggctgaactttgcttcaaatttgccaatcaaaattcacgaacccatgccaagttggctacaaaacctctcgcttggagccagcactaattatgtcaacaagtagttcaagtttagcccctgttaagtcctgtactcctgggtattggggatgagtctttgtgtggtggcaaacgggccctgtcttcgcttggcttcctcctaaaattcccaggacctcttcgggtcccagccctttctsttcccctgagattgcgcctcctcaccctctgtcttggatggaaagagttccaaggcagtccagtcaccccagtgaaaagttttctgatgaggtcaagccttcttattgtcataggtcattttctttagaaatgagaaaccatctcattgggctttccaggaaggagactctgagtgcaagtttgttgtgaagaacacgtgccttggaattaacacctatggaagggaagaaaacgaagatggagtgggcagagggagaagctgactgagatgsagtccagcaagggtctcagtcaaccttatgaagctaaaagggcccatcagagctaatccctattgggctaatgtggccaggcttttataaacctgccttgactcgtgattgggtgggctgccccaggaaggatgtgcccttgcagaaggtagtctctgtgttcaggtactccctggaaaggctaatggctgaaggctacaggttaccctggaagggagacctgggctgcacatcagagcccatctactttccagtgtggacaagttccagctcctgccccagccctgccacaccatcaccctctccagcacacacagcccttctctgttgattagggttggttgagctgttctaccaccttcattgactcaggccttgaagtgcagtagaaagccctaggacaaggcaggcccagttttgaggctgggtgcagaggctcatgcctgtaatcccagcacttcgggaggccacggcaagaggatcacttgaagccaggagtttgagatcagtctggccaacacagcgagacccaatctctccaaaaagtttaaaaatcggctgggcatggtggtacatgcctgtagtcctagctactcaggagactgaggcaggaggatcacttgagcctggtaggtcgaggctgcagtgaactaagatgccacaggactatagcctgggcagttttgagtgctgcctctaccatgtaactagcttgccagtcaagtcattaactattcggggcmttagtttcgtctttyctgaattggagccagtatacgtaattccaaaggttgcttttaagcgtaagtgagaatattggcagaaattcgttagcactgagagagggaatgtaaagtggaggttaagtgtacggcttaagagcagagtcaggaaacctagacttgcaccctgatttctgagttgaatgttccagggtaagccacttaatctctctaatcctcattgtgcttagctctagaatggaggcttgttgagaaaattaaatggaaacgataacggcgaagcacttagcacatgagcaggcccatagtactcaggtgttcattccacagaaaagcgttcactcttctgcactctttctcagtcagttggccactgctgttcagttcacttcttttggatcttctcagccccatcaggttcccaggtgaaatgagccccggctcagcaggccagttgtcttcagtgacccccagtgaggcagcaggtgggacttgattctggaggcaagactcaactccatagacagggcttacacaccggaccaaattgaggactagctaaaacagggatagggtgggtgcacctttccatgagctgtgtccgccagtgtgtcatgtcagtttacaatttccatggcaacacctagaagttactgcccctttccatgacaatgacccaacaacctggaagttaccaccctttttctagaaatttctgcataatccaccacttaatttgcatataattaaaaatgggtgtaaatgtgatggcagaactgcctcggaattgccactgtgggtactctgcatgtggggtagccctgttttgcaaggagcagcacctctgctcctgttgtacactgtcccttcaataaaagttgctaacaccaccaccttgcccttgaattctttcctgggcaaagccaagaaccctgttggcctaagccgcarttctggggttcgcctgccctgcatcaccagcacagtggaaggccacaagctcacagcattttcatccgtaaacaaagcttggcaatatctctgatggttaagagcttacgtgtttgcgccagtgagacttgcactcagtcttctttgagtgagacttgaactcgattctgagtctcctccttcctagatggactcattatttacttatttatgtattcactcatctattcattaatttatactcttagtttgatatcaacatctgtaaaatggggatggtaatgtggtgatatggaggaaaataaaataactctggcattgttcttactatttacctctgtactgtcatcgttatcattcctttgataaccgtgagcacctgtcatgggcctggcactctagtaggctctcaggatgcacaatgaccctgtccctgcttgctggagacataagagaagcccccagccactgacatctgggtgttgtaagaaagcaagaacagtcatggacactgctaagttttgatgccaaagagccaaatttgcagtaccagaatgtcctttccatgtgtgacccaaagttttggctactgaagacgttgcatgccctccaacagtggaagtggtgccctgaatacgccagaaataatcgtggagtcaacgaagatctgggagtattgtttggagacatctcagtattcctaattcattttcccatccttaaataaaaatctttcttactgatgatctgagaacttcttgtaagccccatttccatgagtagagttggccattgcccactaagaaaatttaggtggtttttattgggattagtggatgaacttaggattagtgtggcccttccttgagatataatgacaaccttsstgaaagcaagaccacagggcctatcttcagggaagtgccttgcattttaataccaaccatgccacgtgtatgtgtttcctgggcctgccataacaaattatcgcaaactgggtagattgagaatcattcattgtttcatggttttggtggccggaagtccaaaatcaaggcgtttgtggggttcgttccttctggaagctatgagggagaaaccatgccatgcctgtctcctggtttctggtgactgctggcaattcttgatgtcccttggcttggaaacaccacattctaatctctacttcctcccttacatcaccttctcctctggctttgtgtcctttctgtctcttacaaggacaccagtcrttggacttaggacccacctaattgagtatgatctcatctcattccttatcttaattacatttgcaaagaccctgtttccaaataaagtcacattcgttggttctgagtgaacatgtttctagggggacactattgaacccactgcactgcatcaaacgtatgggtgtgctttctcttggcctttctcctatttgccttctctgtgttgggaattgtggcttcacacccatctacttatccctgcatgttgagcatcgtctgttacctgaagagcagaaggatgataaaagtgaggaaactgaggcacaggcttgccccaggttacacagctagttatgatggagggtgggtcggaagccaagcgccccccagcccccaccccacaacaggtgtatgtggcctctggtttatccttctttccccctgctcaccacatggcttctcattttgaaaacccrgtggctaataaagtagatgagtttcaggattgcaaaatattgtgatcctggcctttgtccattgtgtaatcttcacagtgaccagagtgtttgcagttcctasgaagttcacccattcccaacagtgtcccagggtcaagctcagatgacctgtggtatttttatacccatatatgtgtcaatgtttataacttttaaagttgttttcaggaagcactgaggcatgtggtcrttcacaggtgacaaagacagaggctcagggaactcagttggttgctgagctttaaacccaagtctatttctgaggctggactgagtctttgagaaaatgcaaagtaacctagcatagtgtcagacacaaaatagtcagcaaataccatcgtagattcaggcttctgagtccaaagctaacaattctcatctccaattcccatcttcaaatattaaaataaactttttttttaagagacagaatctcactgtgttgctcaggctagagtgctgtggcatcttagctcacagcagcctcgacctaccaggctcaagcgatccttctgcctcagtctcctgagtaggtaggactataggcatgcaccaccatgcccagctatttttaaaatttcctgtagagatggggtctcagtgcattggccagactgacctaaactcctggctacaagtgatcctcttgccttggcctcccaaagtgctgggattacaggtgtgagccaccatgcccagccttaaataaactctttagtgtcaaaaaatctacgtgaggccaggtgtggtggcttacccctgtaatcacagcactttaggaggccaaggtgggtgggtcatctgaggtcaggagttcaagcccagcctggctgacatgacgaaacgccatctctactaaaaacacaaaaattagccaggtgtggtggcatgtgcctgtaatcttagctactcaagaggctgaggcaggagaatggcttgaacccaggaggcaggggttgcagtcagctgagactgcgccagtgtactccagcctgagagacagagcgagactctgtctcaaagaaaaacaaaaacaaaaacaaacaaaaatctacttgaaccaataaaaattcccatccccacctagaattctaaatattttataaataaagtcttcagagcctagatattcactagaacccagtggtcacgtgttcctaatgggtggaatattattttgaatctttccatgatgagagttacattgatgggtgaaagctttttatgcaacatcatcattgttgaataaacagacgcttagcatatttaggttggaatgcaagggaactaaaggtaggggagattcttaaggaagtctactttctcttcaagaatgctatcaaattgaaaggtaattcctaaasaagagtcatttgtaaattagggaggaagagctaaaaaagattcctagcaagaaacatcataaaggggcttgataaagccaaaaaactaaaagaaaaaaaaaaaggaattagaaacagagaaaagaggcttcgtgttgtttgtaaatttgtgaataaatctgttaaagaaatattggattcatattcaacttggaaaacagggaaaggccttttattgcatgctttgaagtttgaatacactttcagtagctcttcgttatctcaaattaaatcttaaattgagcttgtggttctgtgaattaatactccrgcctttcagccctgctgctgaggtcattcaaatctaatggtggaaacggtcacagggtcaggccttggatggtgctgtatagaaatgccttaatgatgctggcagatgtttgcattctgcagctggggcggctggcgggttgggggctgcaggaagagaggagttgatgatcacattattgtgtcagccgcctgtgtgaataaggaaggacagactcccaccccatcccatcattccaggttcaataagaggyaggtgcttcctaaagcagaaaaatgtaagggaagtcatcatcgcttatcatcacctgaatgttcaccatggtgacccacatctcaggatgctgcaaaacgagagaggtcacctgtctgtgtaatcgcatatagcattctaaagatgttccattcattcagcaaatgtttaataaaggcttcatctgaagtttaatggacattgtttgataaaacagacccagtcactggtgtcagggagtttatataaaagtatacacgtatctgtgcaaatgtgtgcatttaaggcccgccgagcctgagctgatatgcatgtcttaactttgctgtttctctaaggggatggaaggattggctaccctgagctttctagacttgttattttttttttttttaagacagaatcttgttctgtctccgagctagagtacaatggtatgatcatagctcactacaacctccaatgcctgggtttaagtgatcctgccacctcagcctcccaagtagctaggactrcaggcgagagccaccatactgggctaatttttgttttttattgagatggggtcttcctatgttgcccagcctggtctcaaacttctggcctcaaagcaatcctcctgccttgatagacgtgttcattgtaggtttctagcctctgaatccaaattttatttttctagtactttattttattttactttttattgattgaaaccttgaaataaagtttttaaaaatctatttgattttaaacgatctttagaaatatatgaaggttaaaaataactctcattttgctttttataaacagtccactcctacatgtagacacatttagatgcttcattttgcctgtagaaagtttttctaacaataaactgaccaatgatgatgaaatttttattgactcaaatgtgtgattggttgatttactgtattcagtccaagctcctcccaaaggttagctcattgactctacaactctgttttcctcattcattcattcctctaatcaatatgtattgctcacttggtacatgtcagatactttcctaggtgctggggagaaacaagcaaagtacttcagggcctgtattagtttgtttttcacgctgctgataaagacacacccgagactgggaagaaaaagaggtttaattggacttacagttcygcacggctggggaggcctcagaatcatggcaggaggtgaaaggcacttcttacacggcagcggcaagagaaaatgaggaagaagcgaacgtgagaacccctggtaaacccatcagatcttgtgacacttattcactatcacgaggatagcgcaggaaagaccggcccacrtgattgagttacctcgccctgggtccctcccacaacatgtgggaattctgggagatayaattcaagttgagatttgggtggagacacacccaaagcatatcagggtcctaggcaactttgtgtgagaacagaacagagaggaagcgacacacctttcctttgggagcaatttttgggttgcttttgtttttatttgttgttttcattcctggtagtaatagtaacagtagaaaatggcagcgttatagcyataaacaaagtgctctgtggtttctctctcaccatcccctaaaccctacaaggctaggggaaaatggtaatactcatgaacaactccacttcataaatgaggatgccggcactcggggaggtcaagtgagtttcataaggtcatagagcaaccaagtggcagggctgactcccacccaggtgtgttccatgggcagcgtcttcttactgcactgtcctgacttgctctagtgagatmtaagagaggcacaatctgctttccttttgatggtgtgcagcagcatgatggccgcgcgaatttccaagaagaggatgttggtcgctgatggcatcttcaaagcygaacggaatcagtttcttactccggagctggctaaagacgcttctctgaagctcaggttcaagttacacccatcacgacagtaacaaatatcttagccaacagaacaaaaaatgttcctggtgagaacagccagggattctggaattgactgctgtagttcagaagagatttggcttcccacagggcattgtagagctttatgctgaaaaggtggccccagaggtctgtgtgccattgcccaggtcgagtctgcagtacaaactcctaggagggcttactgtgcggagggcctgcgatggtgggctgtggttcatcatgaataggggggccataggctgccaagctgtggtttctrggagactctgaggacagagggtcaaatccatgagtttgtggatggcctgatgatccccagcggagaccaygttaactagtacattgatgctgttgtgtgccatgtgctgctcagatagggttttctgggcatcaaggtgaaggtcatgctgccctgggaccccgctggtaagactggccctaagaagcctctgcctgaccacgtgagcatcatggaacccaaagatgaggtagtgcccaccactcccatctcagaacagaagggtgggaagccagagccacctgctatgccccagccagtccccatagcataacgggctgtccttggcagttgtattcggagtctggatgttgctttgtaaagacatttaataaaatattgtacaaagacaaccgggaatgcctgtaatcccagcactgtgggagtcaagacaggccgatcacttgaggtcaagagttcaagaccagtctggccaacatggtgaaaccctgtctctactaaaaatacaaagattagcctggcgtgccctgtaatcacagctacttgggaggctgaggcaggtgaatcgcttgaacccgggaggtggaggttgcagtgagccaagatcgtgccattgcactccagcctgggcaaaaagagtaaaactcagtctcaaaacaacagcaacagaaatgtattctctcacagttctggaggccagacattcagaatcaaggcagggctatacttactttggaggctctagctaagaatctgttccttgcatctttcgtttctggtggctgctcgtgattgtgggctgtgaccatatcactccaatccctgcctctgcagccacatggccttctcctcttctcctgtgttcctttcctgtctgcctcaaatctccctctacctttctgctatgaagacacttgtttttggatttagggtcttcctggctgatctcatgtcaagatccgtaacttaattacatctgcaaagacctgattcccaataagcttgccttcacaagttgcagggatttggatatggaactgcctttttggaggccaccattcaacccacaataagagcacagtggtgaggtttgaggggtggtatgaggtcacagtcacagccacccctctcaccagctgtgtgacaattctggatttccttagctgtcctctgcctccatctccctttcyctgtaagtggaagtggtattcattgatcacacactacatgccggacaccaagctattacattttttgaatatgtttcttcyttgcctcttgaggactaaccagccgggtttagattatttcctccccgtgtcgctttcctgcccccacatgttawagatggtgcaagggaaccagagagctttgatccctggtttctctggtcacaaacctgctctcctctccagaactccaggctgcctttctgtgggggctaaatcaaatttagctgttcccccaactgcaaagtacataggcatcaagtgaaagggtaaatgcatgaaaacctgaatggctgatcctctaagacagtgagagcagatgttaattgctcactgtccaagtgctgggctctgtgataagagcttcacgcagatgacatcaaagcaccatgtgtgggggaagcacgatgatcttgaccattttacagatgaggaaggtaaggctcggtgtcatcaactcacagaggaagtggagctggagtctctgtggctccagggtcaggtgtgtagtctcgaaggctgttttctgttctgcaagtttctccttaacacatttccarccccattttctggcagggagaccccaggactgaaaggagctggaagagtgaggtctaagagaaaaaggggctgggtgtggtagctcatgcctgtaatcccagcactttgggaggccaaggtgggtgggtcacctgaggtcaggacttcgagaccagcctggccaacatggtgaaaccscatctctactaaaaataaaaawaaaaaaaaaattagccaggcatggtggtgcatgtctgttatcccagctacttgggaggctaaggcaggagaatcacttgaayctgggaggcagcggttgcagtgagccgagatggcgccactgcactctagcctgggcggcaagcaagacaccatttcagagaaaaacaacaacaacaaaacatatggccagcagccagtgttgttatytcaggatgggaaccaggcactgcacctcctcattaggagtcagagtaagggggctaagctggttgacatgactggggacagagttgctgttgaaattgtcaggttatgaagggaaattagctgctgggtgtcaagaggtgcacattgctgcaggcattggcaactgggagccctggtgtgtctattagctcctcaggctgtgaggccttaatgacacccctgccaacattacaggaggcagcaagtgacagtaggaatgagagaggccagctaatctaatctgtacgccccacaggagttgggggctgaggacttcaagacctggcttctgctccctgtcacagtggcaaagacaatgacaataaaagcacagcctccagagagaagagccttcgatggacctgggtgttaaaccaggggccaggcaaaaactgggggatgcagaataggaggttgggctggaggtgagtgagaagaacggatacggttaggaccaacatttaggcaatatgaccgtgtacaggattctaccaccatcgtcaccatcagtgttactgttccctgccatctgcctatggggtgtctaccatctaaagttcagcactgcactgggcatttttaaattatcattagtatataattatatataataataatttaatttataactatatcatttattaaggtcctactatataccaaattctatyggacacatgtcctaataataaacgtgatatmatctatcattatttacaaaacttcacactctgacctttattaattatgtgtgtgccaattatgtgcagggaactgtattaatcgtagttagcaatatcgtctctagtcctccaaccctataaagtgggcacaattattatttctctattgcaattgccatttagcctcagctggattggaaactatgtaatggagactctcaggccactgtcttttgagcagcattttctgcattgcattcttgtatgtaatcctaaaatgtagatgtagttttcccccttttagagataaggtaatcaaaacttatagaggttaaagggacttgccaaagcgacacagccatgaatggcaaagctaggatttaaacccttggacttcttctccttgccattccaccccatcataaattctaaacatcataagcagaaccatcataagtcagggtccatctggaagatggatggatggatggatggatggatggatggatggagagagagagagacagataggcagacagatagctagacagatggacagatagagatttttaggaactggcgaattggctcacacaattatggaagcccagaagtcccaagaagtgtagccagcaatctggagatccagaagggcccatggtagaaacctcatccaaaggcagaagacaagcatcccaggttgaagacagtcaggcaaagagagaaaattatttcttactcagacttttgttttattcgggccttcaacagattagatgagatccacccctacagggcagggcaatcagttttactcagtctactgattcaaaggttagtctcatgtagaatcaccctcacagacacacactcagaaataatggttagtcagatatctgggcactgtgtggcccagtcaagttgacacctacaattttttttttgccttctttttatttttggtgttgtcatcctgtgtccaaggcacatatagtcaatcatcacacctttcccttagcctgtactaggttctgtgccaaggattttagaaagtcatgtctcattcagttcccctaacaggtctaggagtcattatcytccccaacctaaggaaactgagacccagagrttcagagtatcccaagatcctacaggaattgcagattgtagccaaaattggaactcctaattccagagctcctccctcctgctagcatttttctttgagtagttttattaatgagaaaagctgttgagcaccagagcaaccccgcctcttctaaataccatctgacatatacattcagcagaggaaaaatgatgtgaggtctggggcttgctttaaaatactttggggccagacacagtggctcacacctgtaagcccagtgctttgggagtctgaagtggtaggatcactagaggtcaggagttcaagaccagcctgggtaacatagtaacatagggagaccctcatctctataaaaaatttacatgaaaaaaaataaacaaaatacttctgcaacagcagcagcaagagctgccgcaatgaaagaagaaagaaaaggagggacaggatgaaggaaagaagcagtrttaacattctagtaatatttgcatctgaatgatatttatatggggttattgtcctccctttgtgtatgtttaaaattttcataataagcatatttatatatatatacacataaaacatatatgtacatattatcataatgcctacctgctcttgagaaagtagtgccgtatggctgggggtttckctcactggtttctatggctctcccctcccccactttttctaagaagtggtagtacctatctgactattttcttggctgcctgaagaggcctcaaaattagagtaaacaaattacccattaccagggaagcctccttcctcccagcagattcccagcatcttctttcacctctaggagatattttccaaggtcactaaattaagccttcagacaatcgaaaaattgaatctcagtacctctattttcctaacaaaatttctgcagcaccgattggggctgacaggtacggccgtgcagctttctgggctgttcaggtcgatttggccaagcaggacggcatcagcttgtattggagggaacatctgagcagctcagggccccctgggagtcagagcgttccctccctccttgccactgtaaatgactatttctgtcgtttgcagagtgtccttttctttctcctacagccccatccttaccctctatagccatcaggtcaggtgcgtcttcttcatttatttatcaaaagggccatagcaatcattgcaaacatgtttaggaggatttggaaaccatgttcttttaaagggcactaatgatgcagcagtaatcacagtgctagtggaaggggagggcagaatgtgatgttttgggagtgaattctgtaagagaagaagggactgcgttcctagccctccagagcttgcagctatcacagcctggctggtggaggggcttgcagagctgagaaccactcagaatttgggggctgaagaccctggctgtctgagcaccatctctgtgactttcgaggtcatgttttccctccagccctcatttccccctttataagctgtgtcttagctagtgctttcagcaaagaatatctttaggctcctggaggattgatatcccctgaagtagcccctgaccagcctccaagatgtatcctaaaagctcctatggaagtttacatttcactcaaaatatctgtgttcatgtaaatgtaaaaatgatgtcttaagatgcttagcagtgaataaaatgggtgctctagggagatgcagtgagtttatcctgtggctttgagtatacactggtaccctacgtgggagaccccggtgcccatgcccgggtgcacaaagccagcatcagtgacctgcacaccaggaggcaggctgcatgatgattgggtgcaagtccttaggtgggtcactcagtctttcttttcttgagttttttcatctgtgaaagagtgatcataatactatttccattgagaagaagaaataatttatgtaaagcacaaagcataatccctggtattcaataagtactcagtaaatactagtgaaaataatgattataactatgacctccagaagcttttrctgagcatctatctgtagcactgcatgtcaagccaagctagagtacagtctcttaggagacayaggggaggaaaacatccttggcaggttcgcatattggtgatctcgtcgtaattttctcaaatacccttcctctttcctcacttttggtgataactacctgtgttgctcttgtcacttttgcctggatccactaactcaccacctaggtatctgcaacagttatccattgctgcctaacaaattaccccaaaatgtaagcacttagaatctcattgtctttgtgggtcaggaattagggagtggcttagctgggtgattctagctcagggtcttttctgaagttgccagcaagctgttggctggggctgcagtctcagaatccttgactgaaggggaggtttcgtgtccaaggggctcactgatgtggcttttagcaggaggcctcagttcttcaccatgggggcctctctgtacagcttcaggagcagcctcacaatatgtcatctggtctcccacagagtgatgatctcagagagagtgtgaggaagatgtggcatggccttttaagccccattcttagacatcatgcactgtcaagcaccgtaactttagctacattctattgattagaagaatactagtaaagaccatagttaggagaggggaacctggctccaccattgsaagggaggtctatcaaagaacttgtgggcatattctaagaccaccacactctgccactccacacaccctgactctcctaacacctgctcgcttcactggttcggctattggcagtggcatggagtgtgggaaaatgcgtccctctctccttcctggattagaaaagtcatcatcctgctagtgtgaatccatgtcctgtggtggccctctcaggagggattgtgattaaagaatggacaacccaagggaatcatgtgtcatggtggagcatacaggccagcaggtgagttggggaggcgcctttacagaggaaaccttgagcttcttctgtgatattcattacagaacttcccccaaagacagatgacatccatttataattatttcaccagtgacttttgagctcatgcagttctatttatttttctctctgaaagtaagaaactttctttaaaggatttctgccatttggacaatgtgctatgtccccattggtgttaatcagttggtgggatatagaaaagcaaagtggccaggctcagccttttctctcgatctttttttttttttttttcctttcttaagaaagggtcttgctcttttgcccaggctgcagtgcagtggtacaatcagagatcmctgcagcctccaactcctaggctcaagcgatcctccagcctctgcctgccaagtatctgggactacaagcatgcactcctgtgcttggttaattttgactatttttttgtagagatggggcttgcttgcttttttctccagtctggtcttgaactcctggcttcaagcagtcctctcacctcattctctcaaagcactgggatgacaagctctttctttataccagtcctcaacttgcactctttcctgcatacagcttgtttctctaatgtggctgttctcatgtttacttaatggcccagccatctcctcctcctcctcctcctcctyctcctgctttctattctccttcctcatcattgtcctcttctgcgagttcagaaaattgggttacaatacctacaacgtgcagtgaggacactcttttatcataaccccagtaggcttatggtgcttgtatctgatttttcatagtctttcgcttgttaatttactgcacatatgttcctttctcttgtgcattactgatgtgtttaagaatcttgaatatctatatggtgcttagagatttcacagcagttgattgaatgctgttacctcagcatcctctgtgaaactgggtatgactacacccattttgctgatgaggaaactgaggcataagaggatccgataaattacccagagtcacacagctcacaagcaagtgcaggcttccagccaaggtttgctggctcatgcgtttcatgccttctctatggtaccatacaggcactttgtctcccagtggaatataagttctttgaggccaaggactgtgtcttaytctgtgttgcatccctttggcttcagcctcattgtcttgagtttattaagcatttggaacatttcagctgaatgastgaatgagtgaatgagtgaagccatcagtcaaatcagaacactgctcacacatgcatcccaagtccagctgtcgaacgtctggaactgagcagtatggagcctgttaagaccagtgatgctgtggcctgaataacaacaggataggaacattcccttcttctcataaatcttgtaaatttgcattgtttgtgcygaacagggcccgtgtgttctgatagcaaacatggagaggcccaaaaggctgatctgggaccatgtccccattgaacactgctctgtgctgagtctgcagaatatttaaataaggggttaatttataaagtgagctacgggaaagtttccaggattgtcrtgcgtgtgtctcataaatcggcacaaattgaatctaggtttctaggtttctgtgcccctcagctcctaagtaaaccaaaatttattgagaggtgtataggttgccatccaaagaaacatagtaagtgagaaaagtgtatcctcaggaggtctgtaaacaaggtctgaaggctggcagaaaggaccagggtctgcaatgtagaatccccattgccgatgatcagaaagtacagcgtagtttgttgcagatgaagacagggttccaggaattcttgatctttcttgaacattccactgacttcttaacagaataaagattttgtatattgcagagataatttatagatacaggtacaaaggggatacagacaaagagaaaggctaacttcaggatgttgcgtatgtcaaatcattacattagtttacccagaaccaaaaaaattatgcaatatataaatatgaagctttagtttttcatgattgttcgtaatgacattattatgataatgactgtttgtaataatcatgcgtaccaccttagtctgagcaatcatattagcagttcgtaattattgaagggctgtcaggaaccagacactgtgctgagtgttctacaaactgtatttccagtcttcttttttgttcaatttccactcaaatttttaaaggggtttggagggcgttagtgtgcccattttacagaggtggaggaggaagctccaaaaatgaagcccaaggatcttaaggtaatatatgggcttgaatccagtgtatcttgctccgamagccttgcttttgtcattatccaacattagctgtctttattatagtggccttcttaccacctacaaaacaagtgccagcattctagtaaaatttattcaccttccgagattatttactattttagtctgtagcttttatccctttaactacaccattcaaagcgttgtgcaaaatattctagtagtaaatagaggctttaaatccacacgttgataatggtcaaatcctcttaaaggggccagcaacaaaaatgactttaaaggggaaatattccttcaatgttacaagcgcccatgagcatgttagtagagcagttgtgtgttgaagaaagagaaggtggagtgatactgaataccccgtaaaatcacacaatcagcacttaagaatgttcacacagttgttcacaaacatattgatatcagaccttatagcagtcctattggctagatcagttattatgaatgtgttttatagagtaggaaacagagatgcgacgtgacttgcctaagaacacacagcagttctgaaactcaccctgtgctaatctgacctcgtgaagaaattgagcaaactaggctccagggagaaacgaaaacaayaacaacaaaaaatgtattgccaaaaaattgctagcagacatctagaaaaatgtcttcaacttcttttggtaggaaaagaggaaaaattcaaatctgaattyaacatatttatttttttgtttctgactttttacgtaaacagagctctgagttgtatcctcagatatatttgagactaacaacaaggaaatataaaattatgttactacctaagctgccacttcttcaaagcctcgttattcttgttcccttcaatgtatttcaactccaaaatacatagtgacatgaaaattgtgtattcacattgttctattgatttcgttgagaaagtgaccttgtatgcacacatgagaatttagagatctatatatacygcctggcctcttctttgtaagggtataacagcagtggttaacatgcattttttttttttaacagttagatttactcttcctttgcacagactaatagcacactgaggtaggatccagggacggctccttggcaagttgtactgctgtggcctrgggagggacaactggcagggccacacaaggaggtaaaaccttatgctccatttgcaaagcyagtggccccagcagagataggaggccctctctgtgatttcggcagtggtttccctgggattgaggtctcctgaaacttattcccgcaaggacatactactgtggacccacctgaagggtggcatccactcttctagtaggatctcacattggtattttcasacacttctgccccttgccatgtttagtaagtcatctatgttgtttgggaggaaagagaatgagcattcctcagttcctgcactgcaccaggccttgccaatacagtacctcatttaattmttgctaccatccttgaggtggctggcattaggccatttgcggggtgtagaaaatgacatgcagaaatactgtagcagctcacttaatatcaggcagatggtaagtggcagagatgaggctggaccccaggatttctgacctaatttctgatctctttaattattctatacaccaaaagcccctgtggtttggattcctaatcacgggactgagatgaaacagaatctcttagcatagggggccaagcagtagatgggcttttgcgaagaagttttttcttttttcagagtcagaggttggcagcaaaatatgagagatggaaggtcaagtgcagcagaagagagaaacagggagagtggaggttgttctctagaacatagaagccgcttcttcatcccacacaatggaaaccagagcccagattatattaacgagaagttccagaattgcagatggccctttgctgcttagggaggggggagaagaagaaggagaaaaagaagaaaaagaaaaagagcaggtggaaacttaaaaaaatgtttagctgcatgtagatggcttttattataactgctaggctgaaccagaagacttgagctatgtaaaaatgtcacttgctcttatcacggttcatagagattacctttcaacgcgagtttcattttcatttcttccaacacttagagaagtgaacgaggcagtgactcctttattccctaaccctcacccagcaacttgctttttcctctgtgttttgtgtcattctgtgtgatattgcatcaaggcaattcacggcagtggttgaaccaaaagcaatttaagtcaaaaatggacaaatatggatgtcacttataaggcttgttcaaaggcctttgacatcactcaaagcctgaacacttctcaggagtgggatacttttttttattattattttttattttctagcagtgcaagattgaagatttaatacagacctcttaggcgtctgcgtggttcttacctagaaactgtttattggtgaaccaaatattttgtatcttataccaagaaagaggggctgacaaagattgagtgattagaaatycaagtgaatttctatttattattttgacttggtaatttgtaataacaatagccaccatctatctatacttcctagatttgggcatggtgttaggagtcttatatttattattttacttaattttcatagtcatcctgtgtagaaatatcaataaatataaaggtaagtattattgtccccattttacagatgagaaaatggagtcccagggacctacctgctcaagggcasagaaagcttgaatgagtaaatttactttgtgttgttccaaaggtttctccaaaggtctttgcacctcccaaggctattctcattttgagaaagactggcacagttagaggccaggaacccatcttggctgtgtgccttctgctttgtctctggggttgtggggaaggctggtagcttgagagcctcctccttcaactctgtcaggctgcatgcacattggaaggtagcttttcaggttgtggtgggtggtggtgaagcagagggatgcaaagcagggtacgtggagggctgtgccttggtcattcccaggaagcaaagcgagcgtcaaaaaaagacagggtagttgggccatggcgttgcagagtgacagtgaaccaggaaccagaagagctgacttcagaggaggctttaggcgctcctgcatgttgattcttagagaactaaagacacagttgcatcttaaaatgttgagacttacacgtatacacaataagaatattttctttggctgcaaatgtactataaaagagtgaaaaagccaatcccaaaagattacattggtaggattccatttacataatgttcttgaaattagaaaattataaaaatagaaaacagatggctgggcacggtggctcactcctgtaatcccagcactttgggaggccaaggcagatgggtcacctgaggtctggagttccagaccagcctgaccaatatwgtgaaaccccatctctactaaaaatacaaaaagttagccgggcgtggtagcacacacctgtaatcccagcaactcgggaggctgagacaggagaattgcttgaacccgggagtcagaggttgcagtgagcccagatcgtgcccctgtactccagcctgggcaacagagtggtactccatctcaaaagagaagaaaagagaagaaaaggaaagacaacagataagtgattgccagggactggagaggagtggggggtgagtgggaaccagagtggatwtaaaacagcaactggaggatcctgrtatagatggaaatgttctgcatcttgactgtctcaatgtcaatttcctggttgtgaaatcgtactagagttttgtgagatatcacctatgggggaaactggatcaagggtgcatgagattgctgtattatttcttgactgcatgtgaatctacacttatctcaaaaataaaaactttcattaaaatcaaataactgcttaatattttgggggaaaaattcaacaagtaaattcaaatcacccacgagcccaccacccagagagagtcacctgctctattttgatatattttctcttcctcccttccagtctctctcttctgttcctagatataaaatggagaggttttaaaatgtaattacatctaactatcccctggcttggtaatatccaaccttttcatgtcctcagagaggtccaaaggctttgctgaaacttgttggtttggcattgattttgacaaaagacagcaacaagatcccctttctaggaacccatgtggattactatggattcagaatggatgcattttatgtacagggctgtgactttttctttccccttcctcatgctaataggtgttaatactttgcaataaatattacttatgtctatgaaatgaactgcatcccagcctgtcagcacatatttattttctcattttagtttctccaggttctcactgttatggagggtggggagggggtagaataaggttaggctggagggcatatctgatttggaaaatacatccctggtgatgttcctaccaagtcacaggcttggttggtgatgctaaattgggactgaggaatgggttaggagaaggcttgaagaacccacctcctaaaaccgtctcatcatcgtctagagatatttctccaagtgcttttgtttccagtgacctcccaaccccaggaactagcgaagccttcaggcaggtaagcgcacaaatcctgcattttctagttaaccatatattattagctagtgacttgagcaagttgcttcattttcctgatcctccattcccttttctgagccacagtttcttcgtctttgagtagagttaacaaattactgggtgtttgaaagatcaaatgagttagcacatgagaacatgctttgcacaaacaaagttgtatgcaaaataagttatcattatggcatgggagaaactgtttgtggacattgcctcccagttgaccctcagtgtgtacttgtggaataattttttaatataaaataattaccatcactaatcctaactgtgcacattcttgactctgtgacactgagcaaaatcctgaacctctctrtgccttgatttctttcacgtcttgttctagttttgaagagcgattcttgtgtgaattcagggagaggaggcatgaggcatggtaaggccaccgtacgtctgtggttgacaaattcagtaggcccacagtcaatgcaaaagtcctcttgcctctgcagcacagttacaatgaagaggagcgatggcatggcatgatcccactacttagggaggctaattatgtagtgtctacagagccagtggtttattttgcattgtttatgtcagcattaagcagtattcttacacagtttgtaagtcttaaaactcagtatckactctagtagttgctccaaatgtgatgtcstcataaatcaccgagggatcttgttaaatttggaytctgattcagtaggtctaggtggggcccgagcttctttgtttccttttcttatttaatttttgtgggtacctagtaggtgtgtatgtacatatatatgtatatatatatgtggttttttcaaaaaaattgtgggcacttagtaggtatatatttttgtggtctgtgtttcttataaattggtgatcccccaggggatgcctgccttgttggtccaggtaacacacttggagtagcaaacatctagacgtagttctcaatagtaggactattgccagtggagggggcattttggaaatttggaaaggcattttggtggcctttggcacttagcaggtggggtccacgggtccatcctgtgatgccataggcagtccaatataasaaagaactgccctcgtcccggtaacatacacctgtgcccccagacattcatttcggtaaaaaacttgtttccattgatctgaccccagaattccctgtgcttatacagatacacaacgtgcactgggtcttccagaaatgcaggggccttctamatcaagggaagattgtgtggtgttttgttccagtcttttaccaaggtctcaataccatcttgaaacatcatgcagcactgctcataatatttgagtcaccataatgtgatctgtctacatatgtagctgtttgtattcatggtgattaaatagttgggtgctagacatgcccttagcgagcagctcatgagagcagattttgccwgtttcttccaaaatctggattcagtgacatcgtgttggtagcttgaaactgaccgtggtgagaatatttacaccatggaaaktggcaaatgctactaataaggatgattgttttagttttcattttgtaattttcagagttggtttaccaatatgatgtctgtattaaaatatatgtaatgctgctttcaaaatgttaagtattatgagaatacattaacaaaactctggygaattttttgtcttatgtttcttgaatccaaacctataagtaggtgcaaacattagacgatttcattttgggcttctgatacactcctgtccgagaagttacctttgaaaatgtgtactattttattgtcaattatgttttctttaaaaaaaatttatgacakattacttttgctaattatgtgtgtgggtagattatgttattcatgaattttatttcaggaccttggtaaggggttayacaatatttcttttgaaacgagggtctcgattattgggcttgagtatcctgatctaattaatgcactggrcagagctggcagacgtgtgggacacccagctattctctggaagggaagggggatataagagacacactataaaggtgaatggtaatcggcatctccccttcaaggggaccaggaggatctgagctgactgggtgcctttgtggaagtgtgttttgaactgagattagagagatcagcaatgtatctcttaaagtaatccaggaggagttcattttcaaccgattcagcagtggaacacttgaagaggaggaagtcaaaattcaaaatgggttgggtgcagtggctctctcctgtaatctcagcscttttagaagctgaggcaggaggattgcttgaggccaagaatttgagaccagtctgggcaacataggcagaccccatctctaaaaaaaaaaaaaaaaaaattaaattagctgggcttggtggtgcayacctgtaggctgagctgctcgggaggccaagatgggagaattgcttgaggctggatgtgtgtggctatggtgagctaggatcacgctactttacttcaacctgggtgaaaaagtgacaccctgtttcaaaaaagaaaaagaaaacaaaaagttggaaatgagtgggaaaggatctaagatgattggaaacagtgtacatagaatacaagaggagttgggcatgctggctcatgcctgtaatcccagcactttgggaggtcaaggyggatggattgctggagctcaggagtttgagaacatccagggaaacatagtgtgaccccatttctacaagaagtaaaaaaaatcawctcacacctgtagccgcagctactcaggaggctgaggcagtagattcatttgagcccaggaggcggaggttgcagtcaaccaagatyacgccactgcacaccagccgggggtgacagagtgagaccctatctcaaataaaaataaaaatagaatacaaggggggataaagatagacttaaaatacgctctctagaaaaaagtaagaaatatggaaakaaatctaatttagaaaaatgcacgcacccacagrcacgcttcacaggactggcaggtggagaggatgtttgttaacagggctggctattttactttaagtgctgcaaacattgcactaatgtttgggtctttgcttttggcaatcacttctcttgttaatttttttttggcaccatagaaatgtttccataaatagtgcattcaatggagtgtgttactttattactgtcagccactgtcctaggagaggaaaattcaataaacacaaaagcaaagattagaacgttgaaagcttccaattccagatccttcatgagcttgtacctctaaagaatgcgatttttctatttctccacctgcaaaattcttactttttgggctggtaaagccacctaggtcagtgccatgtccaacccaatctggaaaacgattattgtggtgcctgttttgttgacttaacaaagccartcgcccattcctatgctgctaagatgcgaatgcccagctcaggggatgagattactgtcagctttgcctaagctttgggcattagcaccctccatatgcaacaaacccacaaatgaaatgttttgactctttgacacagaatggttggaaatcacttccttggccagagcaggggtccggtgtaaaggaggaaataaaaataaaaaagcataaatgaatgaggaagtgagcaaatcacactcatcgaggagcaaaataattcattccctctccgtggctcagcatggatgcaaataatgtatcattaagtaagtccccaaaacaaagacagccagcataactgttgcatcaaatatttagccagagccaaaagcaatttattatgttttttaaaataagtttgatttactaaccttcagcacaatccctatttttagaggttggctcatatttttaatttgttttctctgaagcgctgcatccttggtagcgtttcagctgtccactcggttcctaatggcagagcaacaccgaaaagcgtaattacatttcctaattatgtgtaattaggcaaaacccagatgatgtattcaacatgctctgagaatagccaggggttaaagactgctggaatttggtaacatttttataaataagctggtgcgttatttaacgtggaggtctaaggtgacgctgggtgccttgtagaccgatactgtggttgaaatctatcgtatttgtttatttagccaagtaaaactgtaagtgattccccacctccataccttcccctcttttggaaaccagagtttagttgtgctattcttagcccaagagaggccctctaaacccagaaccataaagttctgcttactgacagcctaagtgatatttattttttcaaagcttaatccttttgaaacatggagaaataaatacatcctcttatctaccatatgcctgggatgggaaataaattcttattttcctgccgtgtggtaccagtgggttacgatgaataatttgggcagtctcactgaagataatagggaagccttctctattaccagtgataattatgaatctcataatggaaaacatcccgagcccgaacatcaatcagggaagataaacaatgggaaatgataggtgtacaaaagggaaaatggcaacagcacatgtggagggaaagaccgcagaattctggcrgggttataaatcatacagtcaaataatttccgtgcaattaatatcctcaaattaaaacatacgtttttaaagaaagattttgcagacttttaagctgggcaactgtctgccttacaagatgcgtctggaaaccccagygccatcctccttttttagtcttgtatatttatgtatccccggccagagttggctggggcacagtctaacagtgtcaccgtgtaagctgacccagtgaccttgctctagctcaccagggactgagcatacaccaaagtggccagagctagtggttgctgactctcaggatctttggccctgacagaacaacaaagactggcctattgaggcaggaagtcttaacttccttggccagcctgaaaggctgtctccaaccatgcggacacagcgcagtgaagcggttggaaaagctacagacaaatggaaaaccttcattccaaagggtcgttgtctcctcytatttaatagccctgcattcatgcacttttttttatcttgctgtctttttttttttttttaatcaaataccaaagtacttctatggactggtcttaaaaaaaaaaaagaatccattcataactgtgaaaaaatactgcctattagtctgctattgtggctcaaaatgaaacttaagactacatggctaatttatttactgcatcatgggtgaagaccaacaaggtttccagcctttcctcctatctgtctgcatgtagaaattcacagaccacggccattctgacatgaatatcaaatgagaagttttccattccaaaccctttttaggagcggcctggaaactggagtcaactgtcaaatatgtccttatggccacaaagtatgctcatggattctcttttacaggcttagcataatattttataaaacatatttttaaagaaagtgtaattttcccccaaaagcaagggttttccaatgccatataatttactaagtgtggctttgctgcgtaatagtccataatttatagtcagcctccacaaggcaaaaaataactccaagctatgattaagtaagtaatggacaaggtaactaatatttccggaagaatggccttccagacactcattttaagtgacaaaatggttgaaggttgagatatgtactaatcctgtactaatttaatggaatcaagaaatgacattataagctggcttatgtgggcacttaagacatggagctgagagtgaatatgagagtgaatattctgcacgtccattttaatgaccttgtgcctcattttccccatttaaggtagatgggtttatgyctaattgtgccaccagtttttcccataaaataattcatttggaaggggtggcctaatccagtctgaaccaattctaagatggtagcrtggatgcgggaggcactgcacaggatggaaagcatggagtttggaatctggcacaagtggatttgaattcagacttagtcatcaggagctgtgggaccttgggaaaggttggttggttggtttgttccagtttttaaattttgaaataaatgttggcttacagaaaagccataaaaaatactgcaaagatttcccatgtactcttcactcagcttcccctaatactaacatgatacatttttcagcactgagaagttaaccttgttatgatgctattaactacactcagactataactgaccaacagactttatttggatttgacggtgtgtcctcttccttcttttacaaccagataccacctggcatttattatcatatctctccagtcccctctggtctgggacagtttctcatgcattattttttttaatggccttgaaatttttgaagagttccggtcagttattttgtagaatgcccgtaatttgggtttgtctgatgtgttctcttgattagaatgacgtggtgcatttttgggaggaatatacataagtgatgtgccattcttcggccatcaagtcagaggatgtgtaatgtgaaaatatcttattactagtgatgttagccttgacctctcggttaacgtggtatctgccagatttctccactgtaaaggatcatttttttcctttgtaattaataaatatattgggggaggtactttgggactacttctcwaattttcatccattaattttagcatccctctggggatcttgcctgcaatgattaatactgtggtattctcatgactgatattgtctttctgtcatgccttctattttttggtgggaattcttctacatggaaggctgtttcttcttctccatttatattggtatggatacgtgaatatttagtttattctgtaggtcataatacgacagtattgtgatatattttggtgctcaaattgttccggstttggcccataggaggtctttcgggcaggttcctgcacccttttgacatgccccgttcttttttgagcactttcttattttttggcactgtaagaggctttacactgtcatcttggacttccctgcctcagtcttggaattaactcattctccatggaggcttggttcgttttattatagaatcatatttagaactaagatctaggtgctagttgcgctcattactgctggagtgtcattgcttctagaacttctcaacagagtttagaaatatgtgtattatacaaacccatgcacatacacctatctccatttattcctgtatctctgtgtatattataattttagtatatttatatttctttctggacacattccattatttgttcatatatttataacatatcagtatctattataaattatatatatgtacactttaatgtgtgtttgtacctaattccaatccaacacaacaactgggttttttcaaacttgtttctttgtttttttctttttgtggagagcagggtcttgctatgttgcccagctcagtctcaaagtcctgggctcaagcgattctcccgcctcagcttccctaagtgttgggattacagacttgagccactgcatctagccacaactgagttcattattctgagctttctttgggatgttatttaactctcagtttcttcttctataagatggaaataataacaactaaaggctaggatttggggaaggtatggtaaattgtaaaaatggtagcttgtttaaaaaaaaaaagaagaagaaaaaggaaaacagtatttccctcaccgcatcaacacctgtcctgtatgactggcattgcccagtggaatcttagcagcagaggcatgacaagcggtcagatactgggactttctgtttcgttgcttacaaccctgtgaccactgcacgaacaaccctgagctgacctgctggagcatggtggccacataaagggagagtggttgccccagctgatagcctgtcggtgcctggcatatgagtgaggtccctctagagtcatctagctactagccaagctaccacctgaccccagacacaccagagaaagagcacagcccattcgcggactcagaaactaaatataagaaaaatggtcactgttgttactcactgggttttgcaggggtttaatatccagcaaatgccaatgaattagagttgacatacggaaaacaagtaagagtaactttgtacaccgtgggctcccaatcagtgctgcttttcgttgttgatgttgttgttaatgttgaaaaaaatcttcaagtcatrtttgcccccacagaccttcccagacagtctaactaaatgcactgtatttgctaactgttggaacttggcttttggactagaccagcacctcgagaaagaaccactgttaaaatgtaaggctctgagtgtttatcagctcacaccaaggaagagagagctcaggagcgactgggcatgaggtggagtgagcactgtgaatgctggggaatggaaagtcctttatstggtgttgcctaagggtacggggaacctggcctggtgttgggaggaaacagggtgcagagtgggaagggcaggagtatctaagtggccaaatttagcctaattaacagatttgcctagggctgaccctgaagcaraaagcaaagcctagatcagtctgctctcctcctaccaacagggtaatgatgaggttgaaccaccagttctcaatgccatacatgagattcccaaaatagacgggagttacacagagacctttttttttttaacctcctctgagattttttttaacctcctctgagattctgtatttccttaatgasccgaaaaatctatttagcccagtttttatccttgcagataagttagtacgcttctttttctgctggttgtgatcatatttctatttaggggtaaaggtgctgaaaatcatttgctgcgatgactcgcaaagacatagttaccatgagcagcagtaggatgggtggccaccagactgccatgggcatgatcactgttgacaatcttgccacagctccccagggtctacttggtgtcccacggaggacagtctatacagtaactcaacattaactgtgtacccctcctagtttggccactgttctgcccaaacatacaagagtcaatgtaagtctctgggagcactcacctttgggcrtgttgctacagagtcactcattcctagaaattgcgaagtcacgaagttgtcaaaaaacacaacgacaggccgggcgcggtggctcatgcctgtaatcccagcactttgggaggccgaggcgggggggatcacgaggtcgggagatcgagactatcctggctaacacggtgaaaccccatctctattaaaaatacaaaaaaaaattagccaggcctggtggcgggcgcctgtagtcccagctactggggaggctgaggcaggagaatggcgtgaacccgggaggcggagcttgcagtgagcggagatcgtgacactgcactccggcctgggtgacagagcctgaatccctctcaaaaaaaaaaaaaaaaraaagaaaacaacyacaaccacattttgagataggccttccttggcaaactttgatttcgtttctgtatttgaggacaaaacacagtatggttgtttccctccctagactagatttctaatcttgatgcagtgagcaaagggcgaggtttatattgttcttacctgagccaaaggacccataaaaaatagagtgataggctgggctgggcgtggtggctcatgcctgtaatcccagcactttgggaggccgaggtggtcagatcacctaaggttgggagttcgcgaccagcctgaccaacatgcagaaaccctgtctctacttaaaatacaaaattagccgggtgtgatggcacaggcctgtaatcccagctacttgggaggctgaggcaggagaatagcttgaacctgggagatggaggttgtggtgagccgagacaatgccattgcactccagcctgggcaacaagagcgaaattccttcttaaaaaaaaaaaatagagtgatagagtgagaatttggcttttagtctacagaagttttcactaccagtttctgtgtgtgtgagtgtgtgtgagtgtgtgtgtgtaaaataccaaagagaaaacaataaaaaaatagagaaaataataataactagccaatgtgtcatcactccagacaacagccayggtcagtatttggttaacccattcagattttcccctatgaatgagttttttcgcctccataatattagttataatacattgatactacatcccgagtgtttcacttaacattatagcacaagtgtcttcccctgttgtaacatagtgattattaatgtcaaatatcagctagataaaagctgtcaagtgatagaaagtccttatagctcataaactcttcaataactgggaatttataccgtttatagtttttttactgctaagaataatgttgcaatgaaacgtttgtatataatgctgtttagtcccctctcccccattgtttacgattccttggagttccactgctacttcatatttaccatcaccatccttgttcaccattgttgaagctttatgtaatgacgagcctcatccaggacctacttgtgtctctgtgccagtcactgcctgtgaaccaggggtgtgtggactcagggctcaattcaaaaaagaacccaatcttattgggacaaacagatattgatacccctggtctttgagccccactgtcttttcacactaatgagttcttagtgtctatttttggtgattgagtagaacttggtgccatattggctcaacatggaagatttctgtgatcacttattgatcagtcatgaataaggaatcgggatggcagtcgggagtgtgccaacacctctctcagtattctgggtctctctgcatgtagtgtttcttttgcagctcctagagataaattttttaatgtattacatgtgagttatttgaaagagggtaggtgtggacagtgaggccaggtgacttaatttccagaagcttgcctgtggtatttaccttgatgagttcattaacaatatggctttcaccctcaaacttgctcattcagaaattagactttgtgagcccactaagagtaggtctttctgttaggtacagactctacaataaccaaattcacagaaactgatgtgtaaacccagggtcataaacaataattttcaacmggagctataattatcacatagtttgaaatgctcttgttaatctgagtaggaagagaggatgagaattttcttataggtggaactacagaaaaagagtttacttataggcagaagtacgggtactgagccaagtgacattgtaagttatttaattggcaaatgattaaagcaaaggtcattgcctatatgactcaaatgcttggttgcctcagaagataatgagcctgatactttcacagtgaagctgtattgcacgtttgtgtttgtttattttccatctttcccactagacggtgagggactttatctgtctcattcaccactttgtccaacctaggacagtgtccgacacatagagatgctcaataaatcttggctgagtcaatacgtttcaaaatacaaggtgactccaaatataaaacaattttttattttcaaatgaagtggacctcccctaaattttgtgcccagtttataaactttaggggctgtagatgaactgttcaaaagttttattgtaggatttcacttgctaatgcattttcacaagtaatgtatttattttaaaagactggagtttttatatatccttacatttatgaaataatttcatttaaacccttcatgcccatcttcagcatcattgctaaagcctcttggtttctgtacctgtaatcttcattcattcctcagctgtttgaaacacagcacttttgggatccttgtataatactggccccacaatcaagagtgacttgaactgggacatgtttgtatttcttcaagatgacttttcattctctcatctcattcattttgaggtcattttgttgttgaaatgttagagttcaaccttaaatacttaagagcatggcactgtstagagaaagggagatgagcttctgtggtagccagaggtcaagatggcctctagtgaccctcacttcctgggttttacattgcagtatatttctcttctactctgaacaggattgtcctgtgtaacctacagggggaagtgrtagcgcatgacctctgaagctaggtgacaaaatacatttggacttctgctttgcttctcttggatcactccttgtggcagaagctagacaccatgttgcgaggatactcaaacagcaccatggggagatccgcatagcaaggaatcaggcttccaacagtcagaccagattgccagccaacatgagcgagccttgttggaagcagttcctccaaccccctttaaacttttggatgaccacagatgaaatgaccatcttgacttaggagacacccaagtcaaatcagctagctaagctgctcctgaattcttgacccagaaaatctatgtgagggagtaaatatttattaatttttaagatgcttcattttggagtaatttgctacacaccaatattaatacagagcccatatgcgctgcctacaggataaataatgtaatagcttaataacaattaaaatggaagaaaatgtaggagttcctcaatggttccacctgtttcttgaggttaaaaatgtacacatttgtgggcagaaacttttatacagtaataaattctttgttccctctgcatatagcactttctcaaaaagtagtttggtgacaggcttctttcttctcatcattaaatgacatactggagatcagtcagatgaacwgcaatttatatcttgcccccacccagtgttgatttgcccgrggtcatacagataattagtaatgtcttatctcagttttcttatctgcaaaatgagaatacctgatggggttagtgtgggagtttaatgtctgtaaggtgtttaatttgttgcataacaatatgttgtactatacgttataacaatatgttaatatgttgccatgtatagccatggcaaatgcatagtaaatagcaggtataattattattatttttttcttttttgttttttctgagacagtcttgatctgtcatccaggctggagtgcagtggcgtgatctcggctcactgcaacctctgtctcctgggttcaagcaattcttctgcctcagcctgctgggattacaggcgcatgccacgaagcccgactgatttttgtatttttagtagagacagggttttgccacgttaaccaggctggtattgttttcattattgtggttatcattatttatttagttattgatcatcaaaatccagaaatccagtttcagcaaacattccataacccggtgtgctaaaaccccctcactgctctccattactcatgaatcttcttgaccatgaggcagaatctttgtattttcttctcatcaaggattttatctgaaaaacctgtagtacttcgcctttccctgggtggagaagaggggcggataaatacttctaaagtaatgtagtatgcactctcctgcgtggtgggggtgtagtgggcttcctgttatgaaacccagcttgtaagcatgtatctacatcccagggaggttttcactgaaccaagagatgccataagcagtccttgttgtaataatttaatagcgaagccctcagcaatagatcttcaggtaaaatggatgctgactgtctrtctgtcatatgaagattcagacattgatgtaatttaaaatacttgtagtatcatggatacaaacatatgcctttttatttctgaaggaatttccagaatgttcgattaaaaaatgaacagaggaaatgaaaaataaaattgtctgttgtaccaccacctgaagataaccactactatcattttgctatatttctttctatatttttctcagcatttacacgattgtttttacatagtagtgactttgccgaacagttatttcatttcgcatcttgatattttttctcaattaaaataataattgtgaacattgttctttctactctaactactcaggttgcttataatgagcttgtattataataaaacttcattttattttagataaaatgaaaagatgttactatgcaggtaactttatttattatttgcatgcagtttatcaaatagaattccttggttcagcaaaatgamacctttaagtcttttagcaccaaatgtttgaaattatcatgaaacacattctaatttggcagtgagttcaggagatgaagactgtcctttagttaacatcaatagctttctaaaatatgtagccagttaatattttacttttgcctatgcatccctcaaattgtaacacccctggaacataaaaattcctctattgagattaacacctaacgatacctgtatttgctaatttgtttcttttttttctttgaagcagcatgttgctttgtcacccagactggagtgcagtggcgcgatctcagctgactgcaacctccgcctcccgggttcaagtgattctcctgcctcagcctcccaagtagttgggattacaggcacatgccaccactcccggctactttttgtatttttagtaaagatggggtttcaccacttttggccaggctggtgttgaacccccgacctcaggtgatctgccctcctcggcctcccaaagtgctgggattagaggcctgagccaccgygccagctctatttgctgatttttgaacagcagcttttttttttttttttaacaaaactttaaaatgggttatgtgttttattttcttagtgaagtaatggcttctcaaatttacactccattattttatttaaaaaaatcagtatgattcatcataaataagtcaggactatgattgacagtctacctagaaagattaggaaagtggggaccaccccccaattatwacctttgttyttacaagtgtgtttaaatctctttctgttaatttacaatttgaaaggtgggtgaggagaagagtttgaaaaatagattactgtcttcattaatacaggtttgacctacaaagtcttcacgtacttaatgattaaaaaccaaagtactaaataataaattataagaatttataggagtcatcttcttgaaattagcttactgaatgttcttatcataataaatctgagtgggtgtctaatttagtgttagctgactaaaattgtatgttgcggggaggaaaaaaaaacacttttgtttgaagacaaatgcagtgagtttaatcacaggtgatctgaaaggcaccacctatcttttgctatgttcactttgcagaaactttggcgaaactggctgaatgaagatcgattccaatttgtaaatgtggcagacaataaaatttccccaagcactttgatgatgtttgtgttaatacttcctgctcagagctgtagcccatcagattctagagctaaccaaagagggaagacaacctgtcttctcccagtttccagcctgtatagacttaatcattttcaaggtttaaggttgtttttgtttattggttggggtggagagagacgcaccacctctcctaacttctgtgtttgcttccctcatgctgtgtggatcagaaaagatagcctgttcattcatcacttatttcctgacttccaccttgggtctgtcagattctgtgtgaagcccaggggatccagggaaaattgaggcccagtccttactctcatgtaactcgaagtcttttacagaagacagacttgggaacaaatcaatcaaaatgagttttgtacggaaaaagtcggtgcacgcacaaggtacccaagaaggaggtgactaactttatctaactttacttgcagggcaaggcaaataattagggaaagtttccttcagacaggggaagacaaatatgagtatccagggaggatgtttctggcagagggatcagcataggaaaggagttcagggatgaaaagagtcagtctggtccctagaaataatttttttggtgcataaagggccagaacagaatgacagaggaaaatgataaggatttaggcagggactgcgttggaaagggccttgcaacaggcctggacgttgtttgtaggcaagtaggggcaccgaaagctttaaagcagggagtaacaggcttgtagtgacttttatcgaagtagaagttgaatagatctagcctggcacagtggcycacgcctgtaatcgcagcactttggttggctgaggcgggtggatagcttgaggtcaagagttcgagaccagcctggccaacatcacaaaacctcatttctgctaaaaatacaaaaatcagctggttgtggtggtacacycctgtaatagcagctactcaggagtctgaggcaggagaatcycttgarcccaggaggcagagattgcagtgagcccagatcatgccactgcactccagcgtgggtgacagagcaagactctgtctcagaaagaggaaagaaatggaatagatctctttcagtacaatgggaaggggcatataattcagtactttaaaaaaatgtactatcttatgaaatagaaatatacatgtacatagatttaacacacatattcacgaacatacacatttacatatacagtcatcattgcttagagaggaggttgtgttctgagaaatgcttcgttaggccattttgtcattgtgccaccatcatagagtatacctatacaatcctagatggtataacctgccatactcctaggctaggtagagcatattgctccctggcagcaaacatgtacagcatgtttctgtcctgaatactgtaggcaattttaatacaatgctaagtatttgcatwtacaaacatagaaaaggtacagttaaaatatggtattacaatcttctgggatcaccattgcatatgtggttcattgttgatcaaaatgtcattatgcagtgtgtgacagtgcttaaataatttatctcacatatgcaaagagttttggctaagggaaaagaaaaatgtgaacctcctaatagaaaaatgggcaaagataatgaacaagaaattcactgaaaagaattggcaaacatgaaaaaattctcaactttatttttaatcataaaaatggaaattgaacaatgagatactgtttttcaccatgacattggcaaaagttaagaaggcagataacttccatgttggtgagcatgtaagtataaaaaggtataaaaaagaagagttgtcctgaatctggtctggaatagaacctttttttccatgatgcatgatgtaattcacagcctcattcctgataaattgcttaagcaattttctgataaactttaatgcgattaagacttgttctgagaaatcagtcacccatctacccaagctgactgtcggtcaagagtctagtgaccttaaaccaaatgttattttccttttgtatctagcctaacattgactatcttgtcatttcattttcctataaaatgcctccaccaaggctgaatctttgaattgatcactasaggccttttccctagtagtaacattataataaaactttgactcatgctcataactcgattttccaaaaagttttcctttacaggagaaaagaacagctgctgtttataggagcatacattgtttttggttattttgaagaacaagttggcatttttgaccgaaattaaacacatgccttttgatcaagcaattccattctgtaccagaaaatacagaaatatttgaatgaatgtgccaggacacccaattagaagaatgaatgcttttttagcattattttgtgtgcatacatatttatttagttatttgacctattacattctaaattgatattaataaagaggtatttgagttacagtttttccaaagttttaaatactctatagcaaaaaaaggaaaaatgaaagaaattaaaaagatacctctatatacatacattgtgtgtttgtgtgtgtgtgtgtgtgtgtgtgtgtgtgtgtgtgtataaattggctgtgcatgatataagtttttatttcaatcgttttaggggtaaagtggtttttgattacatggagaagttctttagtggcgatttatcagatttcagtgtacccatctgagcagcatatgctgtacccaatatgtagtcatatatatatatgtgtgtgtgtgtgtgtggatgtatatatatgtgtgtgtatgtatatatatgtatgtatctgtatatgtataatggctgkmcatgatataattttgagttggaaaaagcaaattgaagaataatacatgtattatcatgtctttaaaaaaaaactatacacatagctgaatgtttttgtgtgtattttcataaaatgatttggggttgaggtgataaacattaattataaatagtggtagataacttctatcaccagcacggagtgtggcttaggagctgagaaggctttgaggagggaattttctttcttttttctttacctgtcatgtttgaattgtgttccatcaacatgtcctttttatttttttgagatagtgtcttacttcatcacccattctgtagtgcagggcacaatcacagctcactgcagcctcaaacttctaggcttaagtgattctcccatctcagcctcctcagttgctgggaccactggcatgtgtcaccacatctggctaattttttgaacttttttgtagttggggtctcaccatgttgcccaggctggtcttgaactcctgggctcaagttaccctcccacctcagcctcccaaagtgctgggattacaggtgtgagccaccacggctggccaatatctactagttttgaaattaaaaaaaaaaaaaaaaaaaaatatatatatatatatatatatatatatatgaaaaaaaggacaaacgatttcagttgcacaactataatcgatgaagtggctccttgatgttctcggggcaatctgagacactggggagaaccctccacctttgcagagaagcaggatgaaggggcctaaaatgagttcaactgatttcaactttgtttcccagcataaagcttgggctgagctgcctgaaagggaagtggagaaggcaggaatggaattgatttttcccccctgctgaattccccttctccctactcccttcctgcaatttctaataaattagaagagctctgccttccagaaaagagcagaggtaccttgcagtacttttgggaatcttaccaggaagaactgggtctactattgcaaaggaaaagctttttttacagtgttaaaaattaattaaaaatggaatgtgttatagctcgatttttatcattagcacccattccagagggcatgttgctgttagtaaaacttcagatttttcctgtcattatggatttggttttagggaaaataccttcatgttcagcattttatgtgtcagtccctaaaactcatgatcttctgtgattctcttggtttaagagcagggcgagtaatgtactcaaaaatttctccatagccttctgggttagaggatataacagctggcaaacagaacactaatagctattgatggttattttcaaaggatggacatcgatagttaagttttaaggaagaaaatgaagaggaaatttaatgtgatttaacagtgatttttttttaaagacattatttgcatctcctattttcacttacttataaacaggtggtttccaagtagacatattttttgcttgcttgaatgagaaagcataatgaactttgtgatttggtgacatatccagatagctatagcaaatagctataatgccttagataaatagcattttcacgagtaaactttttagttctcaaaagaaaaattgtaacaattttctagccgcatattagcattatgcacaaacacataaacttttggctggaattgtggaatatgaagtagctcccatccttattccatcgcccatatgctaaaatgtagattgtattagttgagaaattttaccaaatatttacttatactgtgctattatttatactatttgtcaattccactatagtagatgcttaataaatatttgtgaatcagtaaatggatggatgaatgaatagtggcctacttctgtgaaggtaattgaagaattcccacacttggccccctttggatataacgtctgttctgagcacctcccattcactatcttgatgcctcacataagacctagtatatagtaggcagtcaatgaagatcacaatgaattggctagactttgatttattcatttatgcaaattgcctgacattcaaagaaaaaagaaggaaaaaatggacctcttatcatgtgccagacattgttctaagagggaaagatactgtgaaaaagaaaagtccctatcctggtggatcttagattatcgtggagaaggtaaggcaacaaacacaaaataaatacttcatataagttcaggtaatgataatgcgtgaaaaagaagtgttcttcctgttagcagtgccaacatccgctttagtgctctgctgcactgcaaaatgtgtggatgttcttgagtatgtctgggaactagctaaaattagggagttaaaatgatccagcttagctcaggctatagggaggatttctctcccaggtgtttgttttgttttgtttttgagawagggtctcactctgtcacccaggctagagtgcagtggcctcaacctcccaggcccaggtgatcctcccacttcagccccctgagtagctgggactacaggcgcatgccgtaactcgcaactaattttttgtatttttttttgtagagatggggttttgccatgtttcctaggcttgtctcgaactcctgggctcaagcaatgtgcttgccttggcctcccaaagtgttgggattataggtgtgagccactgtgcacagcctcagaggtcctgtctgcctgcctgcctttcctccctctctctctttcttcctctctttgcttctttccttttttccttctctgttgaaggcctgaataaaataaaagactgagtaagaaagaattgactccctctgcctgacttcaagctgggacgtaagtcttctcccagtccatgcatccatccatccacctatccacctattaacttattcacactggctttaaaattatttttggctccagcttattattttaaaatgtaaaatgatttacagaagttgacagagagtataattaaatcccatgagtctaccatccagattcagtaattattacatgtggccattgttgttttatctctctccacccacttcccccatgcctgaaaatttaccaaagtaaacgcaagacattatatattgttattcatagacattttgagtaactaaaagtaaggtctctttaaaaaatgataattacagtatcatcatcacacccaaaaacatcacaaattatttaatatcatgaagtgaaggcccatttttccaatcattctctaaatattataaatgtcatctttcattagtttgtttgaattccaggtaaaaacctttaactcatttccttcttttgatttttcaaaagttggttgaatagtttctgtcttaaaaagtccagaaattgttgaaataggtaaagcacaaaagaaattaaatacaccatgtttccaggcctctaatgttttctattcaaggttgtaatatccagtgcaaggctaaaattgctttctggtgataaacatttgagaaagatttggttgttggtgatactgatggttgtagtaggagtctctggagaaattgaactaatactatatgtgtgtgtgtatctatgtatagatatagatacacacatgtatctattatatatatagagagagatatatgcatatctatacacacctacgggtgtgtctgtatctatacacacacctatgggtgtgtctatctatatctatacacacctatgggtgtgtctgtctgtatctatacacaccgatgggtgtgtctgtctgtatctttacacacctatgggtgtgtctgtctgtatctatacacacctatgggtgtgtctgtctgtacctatacacacctatgggtgtgtstttctgtatctatacacacctatgggtgtgtctttctatatctatacattatatgtactaaataatatatataaacactatagtatatagagtatacatatacacactatagtgtatgtactatacactgtgtactaatacagtgtataatgtatatatatagtattcaatatagatctataaacacacaagtgcatacacacacacatttttctgtatatatgtataaagatatatataaagatttttaaataaggaattgactcatgaaattacagagactgagacatcgaaacccaggacaaccaatggtacagttcatgtctgagtctgagcagctgagaagcaggagataaaaaggcatcagttccattccatatccaagtctgagtccaagggcaggagaagctgatgtctcagcttgaagtcaggcatagagaggcarttctttctcactcagccttttattttattcaggccttcaacagattgtatgaagccacccacaytgggaagggcagtctgctttactcatagtactaatcgaaacgttaatgtcctccagaaacgccttcatggacacactagagataatgtttaacataatatctgggtatcctgtggcccagtcaagtggacacatacaattagacatcatggtggttatgccaagttttttttttttttttttgagatggagtcttgctctgttgccagggtggagtgcagtggtgcaaccttggctcaccacaacctctgcctcccaggttcaagcgattctcctgcctcagcctcccaagtaggtgggattacaggcgccaccaccaagcctggctaatttttgtatttttaatagagatggggtttcaccatgttggccagactggtctcaaactcctgacctcaggtgatccacccgccttggcctcccaaagtgctaggattacaggcgtgagccaccactcccagccagccaagtaagttttaacttggaaacaatgagcagacactcgcagtacattctctacttagtatatttctttttcagagtcatctcaaaaatctctaggccaagtgttcttaactatggaccttgatgaatggaccctgagtatcttagaatcttctgaaataatatgcagcattatattccatttgtacctgggaagagggtacttgtctttcatcagagagtcaycaatggaccactggtcyctgctgatttagtgtcacagctcaaaaccatcagtagtcctcgtgatctttcggcattgtggctccctttgtgagaagggcctaagagtgaatctcccaaccataagmtgtattcaggcaggcacgaagtctcttatttactcagtgtttctggagcccagcatagtgcctcgcacacagcaagtgcycagtgggtatctgttgaaccggcaaaacaaacaaatgaataaattaatgggtggtcactgtactagttttctattgcttcataaacaaactatcacaggcatagtgagttggaatgatggctctcaaaaaactatgtccacatcctataaatgctrttgtacaatatatggtcttttgtgattggcctcctccacttagcrtcgtgtttttgaggttcagccacagttgtagcatgtccatctctctttgtgtggctgaatatcattgcattgtatggatataccaaatatttttctcctttcatctgttgatgggcatttgtgttgtttttaccctttgactattgcaaataaagctgctctgaacatttctgtgtaagtttttgttggaacacctatttccagttcttagggatatgtatttatatcaagccaaactacctacctaaccacctacctgggagtggaattacggggtcatacagtaaatctatggttaattcatcaggaattattttataaatttttgatgttggatatctgaagataatacagaatggagcccttttttactttacagattttttttttttttgagacagaatcttgctctgttgcccaggctggagtgcagtggtgcagtcatggttcactgcagcctcgatctcctggggctcaagccatcctcccacctcagcctcctgagtagatgggaccacaggcrcatgccaccacacccagctaagttttgtatttttttgtagaggcaaggtttctccatgttgccaaggctgatcttacactcctgggatcaggagatccgcctgccttggcctcccaaaatgctgggattataggcatgagccactgcacccagccctggatttggctttttgaaacagggctgcacataacctccatgatgtgattctggctgtgtctgttgaggtcccattgggcccagctctgagattccctgttagcacagggtctgacacatcacagatgaacaatggatctttggtaattaaaaacagagctgtgtggctatttttctccaactcctttttttttttttttttttttttttttgagacagtctcactctattgcccaggctggagtgcagtggtgtgaactcggctcactgcaacatccacctcccgggttcaagcgattctcctgcttcagccccccgagtagctgggaccacaggcgtgcaccaccacacctggctaatttttgtatttttagtagagttggggttttaccatgttggccaggctggtcttgaactcctgacctcaagtgatccacccatcttggcctcccaaagtgctgggattacaggcgtgagccaccgcgcctggctttcaaattccattttttaaagttaatgctttaatatgttaaacacccttattaacatattacatatgttaatatgtaaaataaactccgtacattttaaagtgctaaaggttgtatgtttgtgcgatggatatgtttaagagaatgatttaggatgcgatcagttttttttccttgacttactctcttcctttatttttttcccttcttcactttctctgttattccttgccaatctcataaataatgtaagacaacttgcaagacttattaaatgactgatttccttaaaagaagtacgtcaggtgaagggcagatagaggtcaacaccatagataaatctttacactccagtggactttgattcacatcatggctctttctcttccttgctgaggcttttgacaatttcaaatgctccctgaacctcagtttcctttgccacaaaatagcaatacaaatttataattccttagattgctgtgagaatgaattgaggcaaggtaggtaaagtgcaaggaattktgtgtggccggccaggtgcagtgtggctcaagcctgtaatcccagcactttgggaggctgaggtgggtggatcacctgaggtcaggagttcgacaccagcctggccaacatggtgaaaccccatctctactaaaaatacaaaaattagccatgcttggtggcaagtgcctgtaatcccagctactcaggagacggaggcaggagaatcacttgaactcggaaggcagagtttgcagtgagccagattgcaccaccgcactccagcctgggcgatgagtgaaactccgtctcaaaraataaacaagaattgtgtctggcctttgtgatagttactcaacaaatcatatctgtgattgttttgrttttaacaataatggtttttaaaaaccgtaggtgatcacatactacgcagaaagggaagcagttacagyattcacagcatccgtgagtcatagactcactgcattgctccaaggtgcagattctagttggaaatgttaagttttttagagcaatgaaaaaattgatctctttctcttccataacatagatttcccatctagctcctgggctaacttttgtttagtagttgtattatgaaaacaccgaagaatccttctgccagtctccatagcagtgatataaatcagagcccgcagtttcatgaatgcctcgctgtgccaccaggattttcttggagggagccacggtcagatttcaagtggtcatttcactctttctccctctgggggmctgagacatgattaacttgcaataattgtgactccctcattaaaggagagctgtagcaagggaagaaatcattgagactgatcaagacatcccgtgctattttttttttcttgcatatcagctgtgtgggtacctcttgttcctctgtccttcaggttagtaaaacgaagaacagttgctgaagctatgagctatcgataaaagctaatgtaccacacgaaattggaaggggaacaaaatcacttaagtgttcagggccaccaaggcactggtgcatcccctgtgagcctrtttggctcctggcggtgtttttgttgccctggcttgcaacgtagcctgattgttctaagtaaatggcagagcacgcaaatcaaggacattggcaataaaccaggaatgcactgtttccagccacgggctatccagggaattggggacagtctgtaatgtatcttgagctaggaccatatccaaattactggcctttccagtttttcttwaaatagtagggtcagtaggtgaccacactcagaagccaagcctgcagcatcagggctgaggagcaaactctttctttggtctgaagcttcaaatatgaacccttgccaccagctgcataaatatgatagccaaagggtttcaaatttgtgatttgtcataaacgctcctattgcaggctgrgtctagtccttcttgactttgtggaaggagaaggcttgaggaagtattcacaattggagaagggcgccttctgttatgttcttagctcactaaaagtggttaatgatgagaaggggtgggtcaatgacaagaaaagtggagaagatgagacagacaaaactgcaactcatcttcatggcacactggtgagtgggggagtgcaagaagtttaggtgcaaaggaaaatggagtgaacatcttggcttggttaacagaagaaaagaataccaacgccgtctattttcatatccctttctattttatgtacatatttatcaatatactttttgttccagaaataaatgggaacttaggcacaatcttttacacatcttacctcaactggtgactcttcataatctagagctattatagtttccaattgacagatggggaatctgagactcagagaagttaaatgattttgtgtgtgtgtgtgtgtgtgtgtgtatgtgtgtgtgttttgtttttttgtgtgtgtgtttttgtttttttttaagacggagctttgctctttcacccaggctggagtgccttggtgcaatctcagttcactgcaactacaacatcccaggttcaagagagtctcccacctcagcctcacgagtagctgggatttcaggtgcctgccaccatgcctggctaattaagtsagtttcttaaagtcctacaactggtgagctgtgagctgtaaattgyggaactaatttttatactgccaatctgaggccttttctgacctcatcgctgccactgtaaaatgarttctagccccagaccatgacatgcctactagcttagctctaaccaaaaagatttattatcccaagagttgtgaaaatgtggaagaactagaactgtcattcactgctggtgggaatgtaaaatggtacaatgaatttggaaacagttgtccagtgccttaaaaagttaaacacacacatatgtggctcagcagttcccttcctaagaacctactggaaagaaaataaatgcttatacaaagtcttgttcatgaatgttcatagcagcatcatccatgatagccaaacgccggaaatacccaaatgtccattagctggggaatggagaaacaaatgtagtctatcgacacaatggaatactactcagcaatgaaaaggaactaactctggatacctttaataacatagatgaacttcaaaaacattacgctaagtgaaggaagccggtcataaaagaccacatagtatatgatgacatttatatgaaatttctagaaaagatgaaactctatagacagcaaacagaatgatggttgcctggggctgggagtgagtggaggggattacctggaaagggtggggcaattttggggggtcaagaraatgttctaggacaagactgtggtgatggctgcacaactggataaatatactaactawcatcaaactgtatatttacaatggttaaatcatatggtatgtgaatttcacattaataaagtcataaaaaatgaattccaggaccattaaatcaggtgactgagccaatagttacaggaacatagaaagattttcacccattctgtataattagacaaattctgttactatctgtccaacagtttagcaagagtcactctgagattgaagagaggaagggaaygttggaaccaatgctgatgagccattcataggctctggctcactatatatgtctaaaattcacatgcccctaaccctcaaataatgaccattaataatctggcaggagaggaaagacctgcagctcttctagtccttatgctatctcattgtctcatggatttttaatatgtctttgcatcccttagaaatttgcacttttcccccctttttccattaaaacacacctgcgtgcaaacgtccatacacacccatgtacacacagacacacacacacatgcatgcgatctgtaaaaagtcacaaaggccaaagttttaaaggaagaaaataaaaatcacctgtagtcctatcattcagagataaccactgtatgtttatttacattagttttgattacattagtttagaatgaaattttaaatacactagtatatgtaattaaaattgtatatacgttttagtcaaccatcagctgacttattcatgttctgtggactctrtggtgggtggggtccaagcctccctgaagcagatctctatcctgtcaccctgctggaaatgaaacacttaggggttagaaggggatcaaggaaagtccgagagttggttstgattatcttcagtcagaaagtgcctacttttccaagcatccagactgcaacctgtytttcctactcaaaatggtttttatggattctattcttatttggcaattgcctggactacagtcaccaacacaagtttatacgcaagaagtgcacacagccctccctcccagctcatccggtaacaatttagatgaaggatgtaaaataggattcatttcatgacccaagtctggtcaattgaaacagccgattgaagtgctgtgttgaaaaggattttgacactgcgcatgggctcgttgggaaagggtgtcatgatgggttactgattctgcggtatttttgtggacgtggggagtggtggcctacttacagtgcatcgcccactctgatttagatgagcaagagctgctgagttgtagatttctagtttctaaacaacaataagtcttgcycscagatagcctcttagcagagycaaaagccagcagagagaagactcagcatttgctttggagtaagtttgtgtgtgtatgtttatctcccttttactcatgggctcttttttcccaaataactgaggggccagcacatttggagaacatgggatttatcattgacgtcagtgccttgggagtctatgtttatgtgagcttaaaggttttggaagctgaatgacacagatcaaagtctctccactgatctgtcttccagtcctccaggggacttcttccatcaactacaaatcattgatcaaagtattggtctgtcacctgtccatgtgtaaggccaggcctaagtgctctgacagggcatgactcaatcctcaaacaggaagsgggaaattgctttccrtctcctaaccctaagatcctggatggcaggtaatctgcttcctcaagattctgttgatacacattcaggactctggtttctgttttgcttgatgacaatgacccagtttctttgactaaataaatgtatagacacacattacttcttttcattctargaatcataagtttttcaaactttagaatcacaaggtccattaaaggacatctcccctgaccttcccattttgtagatgggaagactaaggtccaagcttgaatgacctgccatcatggggataaccggaattgatacaatgtcttgattcaagattcagagctcattttttctgtgtcagattaaaaaaaaaacaaaaaaccctyactgatcttttaaatatgtaattcttcctcctcttctccccttgtctctcttctcacccctaccaatgtaatcagttctttttttcttttttggagacggaatctcactctgttgcccaggctggagtgcggtggtgcgatcttgcctcacggcaacctctgcctcctgggttcaagcaattctcctgcctcagtctcccaagtagctgggattacaggtgcatgccaccatgcccagctaaatttttgtattttagtagagacgggttttcaccgtgttgcccagggttgtctcgaactcctgagcttaggcagtctgcccacctcagcttcccaaagtgctaggattrtaggcatgagccaccatgcccggcctaatctaatcarttcctttaaatctgaaactgtcygcctgattctggtttaccacaaccaccagagtcttaagtgtcccaatagccagggtctcatagactctgcttatggttaattcttctggggaaattaatttctcgaggtaaaacaagtttttaaattatcccctatagctcatagaagcaattcagtaaatacttgttgaatatcaaatgaatgaacaaatggcattctacattgaatatagtaattcccaactttcgtgaaggttgttttttttttttttttaatgaggcaatcaggggtaaaaacccccgctgctgtcctaagacagaaagaggggggatttttccccccatggcttcgtccttattcttataacctgtatgcactgctgaacctgctgaataaccatgtcacagtggcaggagagggactgggtgaacttgagyctcgatgcctggattaaagccttgtaatgatgtttgcaaagcaccagggtgataactgaatggttggcacaggcttcgatgaagcttgtgtccaccacagtttccagtgcttctgcacctgggtggtcagaaatgagtcctgtgagacacaggtgacaagatctccaaggagccagttcacgcttggatgactctggagctgtggtgacaatctaaatcctaaattgaggcttactaggaaatgcactaggtracaggctctagagaaatggctattaccaggttgctcaggctggagtgcagtagtgcaatctcagctcactgcaacctctgccttctgggttcaagcaattctcctgcctcagccttccaagcagctgggactacaggcaggcaccaccatacccacctaattttttgtatcttttttagtagagaggggtttcaccatattggccaggctggtctcaaactcctggcctcaagtgatccgcccaccttggcctcccaaagcgctgggattacaggtgtgagcccccaggccctaccctgggcccctcctttctggcccctcaacctrttttcttccagccatgccctagggagagcttggctgtggccttgcagaccctctcagatgccactcaacaagggccaactggagagaaatctctagtctagggcacaaaatttctgtcaacccttctaaccagtgtttgaagtacgtaagacgttcatttccacttctaatgaggaattagaggaacggawttataaaggaattctggttataattgcakgtacttttagagacgatgtctaacagtgcaacccatagaaccaggctgcctggattcaaatcccagctctgctattactgagatctctatgagagctcagaaaagtttacttaatttctccaagtctcagttttctcataagaaagatgggcataaggaaataatgtagggaaaacacttgttgcagactgaggactcaacaaagttataattaaagctattactaacgtcattattatgaaaatagccatctttttttaaagaagggagttaaaggaaagaaatgccaggctgagagatgagacagtgaattacagtgggggataaaggggctgtggtgtcacacaggcctggcatctgtggccttgaacaagtgcattaatcactctaagcctcaatttctttgttttaaaaataattaactaaaataccttagggcacatggtaggaattcagtaaatgctcactgtctttctcatccttttgcttacctcacatttgcttgcagccagtgctcaaaaccatagacaggcagtgtccccaaccactccctgcgtttctctttctttgccttccgaagctgccatcttrgtggtttttgaagcatcaacacttacttcacatgcagaggccccttttatttatttatttttaatttttttgagacagggtctcgctctcttgctcaggctggagtgtagtggtgtgatctcagctcagtgcaggcttggcctccagggctcaagcagtcctcccatgttgacctcctttgtatctgggaccacaggtatatttcmccatgcctggctaatctttgtgtttctgtaaagatgaggtcttgctatgctgcccaggctggtctggagctcctggcctcaagcagtcctcctgctttggcctcctgaagtactgagattacgggtgtaagtcaccacacscagcccagaggccttctttaaatgctagtcctttttctcttcctccatctgggtcttggttccatgcgtattcagtttgtgaaaaatttgagtcgtgcacttattatgtatgtgcttttctgcatgtaattatgcttgataaaaaaagtttaaaaatttgttttagatagaggtttgaatgtcactaattaccaacgtgtagctcctaattggaattaagaagggactagctcctattatcagagatctggtcatcacccttcaagttgactatctccttatgctgattttttttttcttttaaatagcagcacaaatatttaccatctagcagatgtggtaagaatgtaagttgttcagccatttacagcttagtctttgggagatatccattcattttaaatacttggagggccaggcacagtggcttataccttgtaatcccagcacttttggaggctgaggtgggaggattaattggggctaggagttggaggctagcctggggaacatactgacacctcatctctataaaatattttttaaaactcagctgggcatgatgttgcatgcctgtcatcccagctacttgggagactgaggaggacgattgcttgaggccggaagttcaaggctgcagagagctgttattgtaccactgtactccagcctgggcaacagagagaccctgcctcaaaaagtaaataaaatagtaaaataaaacgagatatttggaaggctatgtttttttgccaggccatgtgcttagtccctgggagtatagcgaggggcaatcacaggtcaggtcctagtgtctctgaagacttcattctagtggccattgaaaatgtgtaactacccacagtaatcaagttaaagaaaggttctggctgagcacggtggctcatgcctgtaatcccagcactttgggaggccggggtgggcggatcacaaggtcaggagtttgaaaccagcctgaccaaccctgtctctactaaaattatttaaaaaaaaaatagctgggyatggtggcacacgtctgtaatcccagctactcgagtggctgaggcaggagaatcgcttgaacccaggaggtgaaggttgcagtgagctgagatggcgccgctgcactctagcatgggcgacagagcgagactctgtctcaaaaaaaaaaaaaaaagcttccatttgagccgccaggaaaggaggccctgagttggggagttgaatagagagctgcatcctgaacagacatgatcttgggtgagtgagaggctaggagcggagggaaagcagacgcagttgctaaagctgtcaagtcccgctcccttggaatgcagtcctggttctgctacctccaactgggtcgatttcaaaaaattatggacttgtctgagcctgatgtggtgcctggccagggctcactgcagcgcctggtatacaggaagaacttgatgttattcatggcaaaagatgtctggatggtctccactacagattctgatggcaagtgacttaaagacatgttggcaatgggtagtggacaaaaattgaaacaccttcaactgtgtctgtgaccagaagatttttttctttttttttttttttttttttttggctgactgtcatgacttagtaaggccatcacaggttgccagaacatctactcaactgttccaagcataacctcctacacaggcctkctacataggagtatatttggccaagactcaccactagaagtgatttccactggactttcctacagcaagtggtaaatgatccctcagataggcccaagagctccccttcaagcatagagacacaaccctgtgaaaacatgcattggaaccaggaaggcctgcccccatgacttcacgttgcatacatgcctttgaggacttggcctcttaaaggaatctttcaatatcctatgcttctgagaaagttactatttcatttgcagcaggacaactcaacaagctagctcttcctgcccagcagactcggtggattctgaagagggtctcgggctgactctctacttcatgggtttgaattcaggaatgttgcaagattgcatgagattaagccgctgaaacctttctgaggaagagccagctcaaatttcagtgttggatgttcaccgcttctttagggttctaccactcccagtaaatcaagtaataggtttctgttaaaaaccccagtgtgctgatctcagtggcrgccatcttgctttgtaagccttctctagctttatgatgctcccagtatataagacatttccagtgtctagtccaaattagtatttctctaattctcgagtgtctgatctgcctggctagaatgattaaaacaaaaaaayagcaaatcagtttgacagtccacttcattaagtggaggacagtgttttgattgctatttaatctgtttttccttctgtctgttcttggctatatggaattcactttgcctctsttcccgactcttcatatcccttatctcaaggtgagtatcgtcagaatcccggtacatttcaccagccaccttttatagaagcttagaaagatggaggcaaacccataaacaagacttggtttttctaagccacagtggcaatttcctagtcgattacaactgtgtctaccctttcaactggcctgtcagtgtaggctctgcatgtcctggataatcctacaattggtgacacggttattgacttacaggtttctagggcatctcattcgttttttaaaagaatgtttcttccacacttttattgcttagtagaaacttgttctaattctttctcctgataccatttagcctattagtacctgggaataatcaccctcccttatctagtcctacagatttgttttgttttgagttatacccactttaggtctcccaccctctcttatttttataaacaggctccatggtactatatacactgcagatggacagctgccaacctgctctttttgtgctgaggaactctrgatatttcaactagtttacatgactttcttacctaygctaccttataatccttttataaattttgctttacgttttaacaacggaaaacacttaaggtttttttcctttcttttttttttaattcttccgccagctatctttaaaagcagttctaaaacttcttattttaatattgtacccattgtactttagtctaagtgatggctgcttatggccatgccctttcttctgcactttgggtgttttgtctggaattttctctcctttccttttgtgaaaaaggatgaattttccragactctgttatgacagaaactcaccagttctctgttgttaatcaacaaatagattgtgaatgcttgactcttctctttttttttttttaaaggagtttcaagggtaagatctgctgtcttgtgaatgtcaaagaagtttctcattcgcccctttcttctctctcccastgtctttaatttgttaatgctttcgacttaytttgctttggataattttcaaagtactgctttctctagagatctctaaaaggcagaagttctggctattaaagatttgccattctcagaacagcccagttagggtaccctcaggttatttataactggattttatctcagaaaattaactaaaagaagattaaccaaaaatctaaaggaaaatgccttaaacacctcatctattatgctgtgctcaaacagatattttcatcttaacagcttggcaaacccagtggaacgctctttctagtttggggcataaaataagataacactctgaattcctacaggaaatcttgtaactctacttaaaattaaggcataaagyaggaaaatgtgtttcctctgtatagtcttattactttgcctgttaagttaactggttcctatttctgctggttygaagaggtccaggacatttaaatagctcttctagaaacaaattcttttccttacaagccctgccaggtcagtgggttcagtaaggaagaaggttttgtattttgacaattccttcatctgttaatttagtcagacgaggaaggaaacgagaaaagttattcctatttcatccatctaagactttatatcccatttcaggctgattaaaaggcaaaatcktcacagtaggacaccaaaccctctgtatgccctgcctgcctccccccctctgacccgcctgcctccccvctgtgagctttttccacctactggcctcttgttcttcttcagctgttcctcagacatgccaggtgtgttcctgtctcagacgctttgcctttgctgctccttctgcctggagtattcttccaygtagcaccaygagctgttcttctccaaaaggctttgctcaactgacactttctcagtgaagctgtttctcaccactcactataaaatggcagcctgcctctctgagccttgcaccctctcttccttttcctgctttgtattccttgtggcacttattatatcacatagatacagacatagatgtggacatagatagagacatagacatacatgagttttgtgtttattctcctattctctagaagaatgtaagtttgtaagtactgagatttttgtctcttttgctcactattgtacttcagggcctagaggaaggcttagcacgtggaagacaatatttattggaggaatgaatctagaaatatccttggatgtataatgtccaactcactctaccacacagcaacataggtagttttatatacattttatagctaagcccagcagcccaaaaagctaaatgacttcagcgcccacagatactcctggatgagaggggattggaawccaggtctgttcaattgcaaatcccctcttgtgccttttacaggtcagatgattttgtttttataggctctagcaggtcccttctctttgcgtcaccagagaggaagatcccctaagacaaagcattccctgtagtttttagcataactagtactggctsagtaagtatccactggggttsggaatacaactgccctgcctcttgagcagccatgcctgcttccgaggtggtgctgmatgctattcaggaggacagaccatggatggraatcctgagccasaactccttagcctcatgacrttgggcagatgactgagcttgtctgagttacaataaayaaaaataccatgctgaatgatggcctagcatgacattgggaagtacagactttgcaggcaggcccctgggttcaattcctgcccctgtcattgagtaaagtaattatcataactttggaacaaattgacctctctaagcctcagtttattcttcagctaaatgaggatgattgataatcaaaactattttatagggcttgggggagcatcaaatgaaataacacatataaaaggcttggtttaatctctgaagcacattggcacttaataaatgttaactataattatattaacacctattttacagggttgctatgaggatatcatgagataatatgtatgaagaacctagcacactgtttggtgcatgtgagggttctgtaaatgttacccattttattccttaatttcctttatagacccctttccctgcaacacccagtagtctggcttctatcctgacaatgttagtgaagttgcttgcttgaaatttaccaggccaggcttatggctgtaatcccagaaactcaagaagctgaggcaggagaatccctatgrtctcttgagtccaggagtttgagaccagcctgggcaagatagcaaaatactatctctacaaaaaaatgaaaaaaaaaaaaaraaaaaagcctgtcatagtggtacatgcctatagtcttagctattcaggaggctgaggtgggaggatcgcttgagcccaggaatttgaggttgcagtgagctatcattgtgtcactacacttcaccctggatctggaaggaagggaggaaaggaggaagggagggaaggaggaatttactagaarcaaattaacttctgtaatcctaagtacttgttaaggcagaaaaacgcagataagaaaatcgaagttgagggcaaggagctcatctttcacggtcatagacctcagttgcaacatctggaaaaagagctggttgggcatgccgggcaggcttttgtgacaatgtaagagsaagtgaagattgcatctcagtatgagacaccgtaagagcttgataaatggtggaccctctgatgttgacaacatgatgtcaaagatggtgtttgctgttgtttcaaatgtcttatttcaaattcccaattagtttcttcatgccataaggrcaaaatccacatctcatactttttcaggatctgctctcacttccccaaacatgtaataccaccctggtcttmaagtccactctcaaaaaaaaaaaaaaatttggcctttggcctcgtgaccaccaaatctgatttccatccaagargcaacattgtttgtgcttagaaggaattcctggctgggcatgatggttcacgcctgtaatcccagcgctttgggaggccgaggcaggcggatcacctaaggtcgggagttcgagaccagtctgatcaacatggagaaaccctgtckttactaaaaatacaaaattagccaggcatggtggcacatgcctgtaatcccagctacttgggaggctgaggcaggagagtcgcttgaacttgggaggcagaggttgccgtgagctgagatcatgtcattgtactccagcctgggcaacaacagcaaaactctgtctcaaaaaaaaaaaagaagaagaagaagtaattcctaacagtctggaatctctagggtctctggtattatcctttagtttaagcctcacatttttctaaacattttgaaatctggtgtaatggcgttagatgaccaagaatttatagtcaaaagtagataaagtaaaagagtgaaaacagagacatgatacgagttgatgataccgtatgcaacttgtcaaacacttamatttgtgaataagaaaactggggtctatttggtggtttatttcagagatgttggatcaaatcagacatcagaaaagacamcagtaccaaacgaagatatctttgctgtatttgcagttttctctcttattaacatgaaaacaccttacatagatggaaacatctaaaggctattttttattttattttccattacttcactctaatgctttcacccgtacctgtggaaattagactgtcacctgcttttagcatcctgttttctttcgtgtttgtaatgaagccctccgggaattatgcgattacaaaaatgagttacaaatcctcattcggtatacgaaagtatatagctgctttccttctctgtttaaatagtctacaaaacaagaaataattagtcaagcactatcggtaattaagcacataagatgaacattaaacaaactgcaatcttgcatcattttgaaggtagataggcaggtttttgcatttggaatccagccaaaatgcccatcttcattccctttgctccttatttattattggtgagggaattcacttgccgaacttgctgatgtactcttgctggcggtccatctgagagttcacataagtgtgagtgactattttttgacaacactacctttgggagaagatggtttcaaagaactwactgtatcaaatggaaagacaatgtgttttcccaacatgggagtatgtttctaagttgggatcagttcacgattcagagaaatgctctgccttcttgtctatgatatcagatcaggtcagacgtaggtataagaccctgactcctgttttccaagcacttttttttttcattatgagtctatctttcggtcccctaaagcttctggtaattttttttctttttttttttttttttgagacaaagtctcgccctgttgccaggctggagtgtggtggcaggatcacggctcactgcaacctttgcctcctgggcgcaagtgatcctcctacctcagcctcccaagggagctgggaccacaggggcacaccaccatgcctgcctaatttttgttgttgttgtattttttggtacagatgggattttgccatgttgcccaggctggtctcaaaactcctgggctcaagcgattcacgtgcctcagcctcccaaagtgctagggttacaggcatgagccactgtgcctggccctggtaaaattttgtctacrtagttactgctgcccaggcaaaatctgaaaaatgttagtctaatttagttaagtttttcttgcagaccagaacttctaggaaactaatatacaggttttctccaaaatatattttcaaggaaaatcagagaataaaagtttccaatgcatttagactagaaaattaaataytcaacaaacaatttcggagggccaactatttgccaggatccttgctggaatagtctctaacctcaaggcaattgctgtctagctttaagatcaagagtaattgtgacttgatgtaaggtatctgtgttgctttgtattacattcttcttagctccattgtgttaaatacagatagacaatatttgtacatgataggttggctcaccattaatcacttaagaagtaatagaatgatcaatgattttctttctggcttgtctacgccaaaatggttcttctgctcagttggtttctatagtgattttatggatataggcattttcttctcgaattagaagaactgacagtccaggcacggtggctcatgcctgtaatcccagcactttggtaggccgaggtaggtggatcacttgaggtcaggagtttgagataatcctggccaacatggtgaaacctcatctttactactaaaaatacaaaaattaggtgggtgtggtggcgcatgcctgtaatcccagctactctgaaggctgaggcaggataattgcttgagcccgggagacggaggttgcagcgagccgagatcacaccactacattccagcctgggtgacagagcaagagtccatttacaaaacaaaaacaaagaactgacaataaatagttttctccgttttgtgacttatttttaattattaagaataagtgtcataaagccaatactttctaacatgtgtatagtatgttatagttttcaaagtctttgacaattatacctagggagccaggacagtatttgtatcatcatttcattgttcctggaaaacaggttcagagaagttaagcgacttgcccaaaatagcacagcaatctgacagagccaggattatcttccatcctctattttattacctgtgcctcccattaaatcatcctaagctccactacagctggagaaggttctgttaacacaccatacatcttttttttttttttaattgagatggggtctcactctgtcacccaggctggcgtgcattggtgggatctcagctcactgcaccctccttctcccaggttcaagtgatcctctctcctcgcctcccgagtagcgtagctgggattacaggtatgtgctaccgtgcccagctaacttttgtatttttagtagagacaggggtttcaccttgctggccaggctggccttgtatttctgacctcaagtgatccacccgcttcagcctcttaaaattctgggattacaggcatgagccaccgcacccggttatacatcttaaatataaagtttttacaatgccaccatttaaaaaaaaaaaaaaagggcattaatgcatttagcaaagacttcctgagtgtctgcttggtcgagtgacacaaactggaacagagcatagcctgtcttccaggaaccggcaccagcratgtcgtaggctgagggagaagccacagaactgtgagtgacatgtttctttggctgctcccgacacaaggaactgcaactaaattgaaggcttgaggacaggaagcaccttagyggttcgcctttcatttgagtgggcccagggtccagaaaagggtagatattcaggaagaattgatcaccttttggatgccaccacacatgcctaggcacaaaataactcagaaaacagtgataaaagttgtgattgtggttgttgtggaaattaaagtagcctcccctcttaagctttgtgaacttcagcaagctcctgaacccatctggaccctctctctcatcagtaacgcagtaacgtagagatgaaaccctaaatgccatccggtgacatcctggattagaccctgaatcagaaaaaggactgtagtgggaaactcgtgaaatcctaaatacagtctgtcatttacttaatagtaacatwccattttcataagcataccatgggctgggcatggtggcttatgcccgaaatcccagcattgcgggaggctgaggcaagctgatcacttgaggtcaggagttcgagaccagcctggcgaacatggcaaaaccccatctctactaaaaatacaaaaattacctgagtgtggtggtgcccacctgtaatcccagctactcaggaggctgaagcaggagaattgcttgaatccaggagatggaggttgcagtgagttgagatcatgctactgtactccagcctgggcaacagagcaagactctgtctcaaaaaaaaaaaagaaaaaaaaagtaatgcaataagcgtaccatggtcatgtgagatgttgacattaggggaaagacaataaacagcgtggaggaactctgtgtactctgtttgtaagtttcctgtaatactaatattctaaactaaaaagataatttaaagggaaagaaaacctctttatgatagtaacatcagttggtataaccattttggaagacttgatttacataggatcaaatataagtatatctgatcccctagaaatttcacttctggccaggcgtggtggctcatgcctgtaattccagcactttgggaggccgaggcaggcagattgcttgagcccgggagttcaagaccagctgggccaacatggtgaaaccctgtctctacaaaaatattagtcaggcatagtggcgtatgcctgtagtcctagttactcgggaggctgaagcaggaggatcacctgagcccagggaggtcaaggctacagtgagctgtgattaggtccctgcactccagcttgggtgacagagtgagaccctgtctccaaaaaaaaaaaaaaaaaaaacaaaagaccatttttaagactatgactggtcaaaatgtgctcatacatttgccaaaagacaagtacaagagtgtgtttagcagcattattcattataacacactgaatcattattcatgattactcaagacatctggtaaaccacccagatatctatcagtggtggaatggataaataagttgtaataaatccacacaagaggagactactcaccaacaagaatgaatgacttagaactaaattcaacaatgtggatttatcttacagagatgatgttgagagaaaggaggaagatacagaggaatgtatcctatgtgattatagttacaatgagttcactaaaaagcaaactattcctattagaagtcagggtagaggatggatgggagcatgaagtgtcctccgtcatgttgctaatgttctgttgcttgttcaagctactgggtgtgttcagtttatgaaaattcatttartgacacatgtatgttttgtgaatttttttgcatgtatattttactctaacaaaaagttcatggacaaatacaaaatcatatctgacagttgttgagagaattaaaggaaataataataatataaagcacaatcaatgcattccatttattcttctgcttttcccatcaattcatgttacccagtcattaatgcataccctctgagaccccaccaagccatctagccctcagctgtgtcactgggcagttgtttcttccactgtgcagtgtttcgttcttaaccaacatggcaccccaggttcagtggtgagagtgtcactggcaacttctgaaataacatctctgttagtttgtggagtgggctaaatggccagcccttctacgagctccctcatggttgcgggggactaccaatcactctctactttttttttttttttttaataggtcttgtcatttgtaaatgcagaaggaacactgaaaaaaaaaatactcttgccttcttccatctgtattttctttactaaattatccagtcttataaatatttgaataacatttggtcagtataaaatctttcctgtcagctcagtacaagaacactttttggctcctgagaccacaacagtcagataaattaatattgatttgttagaaaatagttttcactctgtctaaacatcttattctgggctcttgaaccaaaattatgaatttaaaagcagcaaaatagttcttcacagttttcccagtgaaactaattatgggcagattgtgagaaatgtgttggatgtgatttccaacatagagttctgctaaccaaaattcagagaaactagagcctcagtctctgatttatttgagcaagttgcaatttggtagactggagaatttatgtaaatagtttttgcagtttccatagggataactcaatacattaatatctcacgaatggcagaagatgaagggggaaagttttttttttaactgatagtttgatttacctaatagaaggatcggattcttcccccttcttacttaagtctatatattaaagaacagctggcttacctgctgtataaatatgcagtgtgtagaatttgactcagtttagagttgagttttaatcacatccacgtacagggatggggatggaattttttttttttttttttgagacagagttttgctctgttgcccaggctggagtgcagtagcaccatcttggcttgctgcaacctctgcctcccaagttcaagcaattctcccacctcagcatcctgagtagctgggattacaggtgctcgccaccacaccaggctaatttttgtatatttagtagagacggggtgtcaccatgttggccaggcaggtcttgaagtcctgaccttaagtgatccaccctcctcggcctcccaaagtgctcrgattacaggcatgaaccactgcgcctgactgtacttttttttttttaaagtatacccatacccattgtacacatttggtattttttctttaaaaaaaaaaagcatttactttttgcctcatgaatctctgagtacattttgtgcattctgtattctactktatttactcaatattaattatatgagaaataaatcctaaatgtaattttgaatggtggcttcacaaaagaacatttcctcttcttttggacatttgctcccaattttaaataacacatcattgaacatctctgtacaaaattccgtatctgatcttcagagaagttttaagatagatgtctagaatttcatctcacatctaaactgttttaagacacttggtacacattgatatgtattgtccaattgctttccagaaactatataaaatattacaaagaaaaacatatatatatatatatgtaaaatatatatatgaagggagaaataaatgtaaatgaaaagaaaaacatatagagaaagaatatgtctaaaagaaactgcagaggcagctataattaaagcacaaggaaaggctatgaaattctggttccacctgcaacagctgtatggtaaaaagcttattcagagtccttccttcttggaaagctttgttagagtcttatgggattgtgatgcacagatacaggggcaaggctactttttcctcgaactagttcaccaaagcttctatcctatgaaagtgaatataaaattcttaaagtttatagggtctgctgggtttaaggaggagaaatttgagttttcgtattgtcagtctcaaaccttttctgaaattggaagtgatgaagtgacagtctggctatatgtgtgtgtgtgtggtgtgtgtgtgtgtgtgtgtgtgtgtgtgtgtgtgtgtgtgtgtgtgtgtgtgtgtgtatacctagtctagggctaggtttgggaactattttctcccgtaagttaaactgaactagactgtatgtcaaaaaagagtctcaatgtcaacttaatccattgtcatgactgtaaaatgctatttcattataccagcaattcccctgtggatttctcctgactctctatgcagcccaactctattttaatctgttgtagcttttctttcccctctctcccaactccccacgttttggaattattcagtgcattcgcttccaaggcacctgtttgatatttacacaaattatgaaagtaaggtgggaaggcaatgaaggcaacaaagtatataaaacacacacacacacacacacacacacacacacacacacacacacacacacaagaaatgactacagacacctcaacacccttccaaaacacttgaatcattttcttcgggagttgaacaagtggctgaaaatgccaaaatccatcagccaatgtgtaagtacaaaagggtcagataagatatatgtggattccataaaatagtgcatttgaattcccccaggtcttttaaagatagtggttttccagatgtgacaaaacaaaagaagatttccaaatcaaaattcccatttgcctttcgggatgttgaattttctccacatttgtgcaattaagagttttgctgagtgagcttaggactctgtctctttaagtgtttaacagtaattggttcatgtcctggtgttcattgaaaatcctagacatttcatgtaaaatcttcttaatgaggggatgaatttttcattcacattagaaagctcactctgacaaacaatttctaaataaaactttggcgacatgacatcccacattggacttgtcagagaggacaggtgcattagaatataactgtatggcgatccttcaagctgtcagccatgaatattttatttcttaatgaatcatctttgtgaaatcaactttcttgttgtagtgtcagtgccatttacaacaaaaagctggctccttttaaaaggtgagctccttaaagatgctgattcctgcataaaatgtttaaccctacccaaggtgttgggcaactgggggctttgtgctttgcttctcccttctgaaagtgacttgagaacccactttgggctagtgtgattacagtgaggagaaagctttccttgatttgttgtttccttctcagaactgaaatcccaggtacctgcccagaggcagctcccttggcccttgggtccctgttgttccaggtgttactcctattctttttgtagttgtctagggatttagtttctcacatcctgaggtccactaggtgctattagctggtgctaactgacagctctaggcagaaagcctttctcaggatcccagcttccctgtcttccagaactcaaagacggcttttgtttgttagttttgaggatggagacagctrtcattctaatgaggacttaaatgtgtccctgctgaccgagccagaacttatttttatgttgccactaggagtcttctgagatgctcttgtggctggatgtagaatcgctttgctcatctctagacacagactagacaacgaaatacattcccctaaaatagcccagggttagttctatgacctttgtcactgttggtacagttctaagaggatattgattttttttttctttttaattcatagtctcaactatgtctcaagactgcccagcagtatttctgtttactcgatctaatttctcttccattcctcacagtggcaatttcaagcttctcctttttccccaagccccataatctccccctgatgcccttagaaagcttccctggtcagtcctcctcaccacctccagctccccctagaaactgaccatttatcccatcccggctgacttcttcccttttacaagaagatgtctctctttgaattcaactcagaggtcagcttcactgcctgccctgtggagtcgactctgtgtcccacccttcaggaatacggcttaataataagatgataaggattcgtaccagggattggcaaatgacagtcattttctgtttccttaagtaaaattttattaaaatacagctccactcattcatttatatattgttcatatctaattattttcacactgcaatggtgcatagtcaaatgctttctatctggctttttaagaagatctttgtccctcccccaccccccgccccgatttatactatggatcagcagcctaaaccctgcaaactgggtcccccatctaagagtctgcagtgaaacgcgagccgacttgatgtgtctcagagtgatcattcttgcccttggcggttgatgctagactgttgcagcttcaaatataatgtattttagtgctatacgacagccataagtattggcctgtgtccactggtctccactaggagaaaaccgagccaagcttgaaagtactaagcgtgcccaggggaaatggaataagctagaaatttgttgtttccttttcactaggtttaagtgagaatatttgtgagcaaactctcagtgtgggcaggtgacaatttctgcaggtattttccccccattttaacttgtgcgatatagttccctattttgttttgttccgcctcgatcacaacagctgccacccgaggtttaaagatactgttgtcctcatcttcagaacaagggttacgtttgctgtatctggagaaagtccatagtttatgatgaattttctattaatgtaaactcccactgtttataagtcacccaaattgttkgtattaaattagatgtgtaccatcttatgtctcttctttcagaaaatgaatctctgtttttttttctctttctcctaaatgttaggaattttctgaagtttgaaaccaagtggcacaaaaacattgcatttattacataattgctcctagggaaatacacatacacacacatgtacacacatacacatacacacattttttcctaaacaacatcaatgtcataacagttttgaagcacrtatacacactgacacatagattttgtaaatgaggcacatctattcttgaaatgyaattgcttaaaaatggaagttctgaaaataaataaaaagaaacatcaataaataaaagccccattttcatattcttatttgacctcttgcctctccatcattcttaaatttgacctccatcatkcttaaatttgacctccatcattcttaaatttgacctccatcattcttaatcctcatgttcttaatggacatccctcccaccctatctkggccttctgagactgttcccccagccccagtcaggagggcttgtccacaagttgctgtctgaactgggcaagcctcctggcttccctgaaatggtgctgatgtcttcacttcctgccaccttggcaacctttgtagttsctctctttttgccaggggaacaaattaagagagagaagagtgatagtgtctacatgtggtctgctcactcagccagtattttccacagccagtctttccctagaccagcatctgagcgtgccttgtctatgggccacctatactattatttactgatgacttcctcattcactttctgttttttatctaaatgccagccttagccttgttcaaggtaacagtatacaggaaatcatgggtttcgagcatgttttgtcaatatttagtaaaatgcgttcatagctattattataaagactttaggtacattcctgcaccacttaataactgaatcaatctcctttcatcagggggaacaaacctgtctttggctcacactgtttgaggatataaaaggaagcatacagtgggcctcattctgacaaatttttagtaaatcacaggttgcctttcctaaatccctcaatatgatggctagtctgtttcatagtgaataaaaagtgatcctggatgaatgaataaagtgaaattcagataatttttctcaaaactgaaattgtttamatcttcctttagttctcttttttctgcctgccccttctttcatataccctgtttttcacctcttttgtctcagtcccatctgatatttgaataacaatatgtaatttcaggtttaggattgttgatctgtaaatctcagcctagtgctttcaactcctggctttctcctaagttcaccctcctcccttccctcctttctgtaaggactctaaacgattgcgcttcattaagttatttttataatgagttcctgttaccagggaatacagagttaaaaaggtgatctcactaaaagtaattagcataagacctgctggacctgtagaagtgactggatggtaatcaatagcaatatgattacacccatgcagcaattataaattatttaaaacactacccctaggttactgactagttgcctttaaattaaattctctgtcgataattgatgcaaagaattaatgtgagaacaccttcagttactgcaactttttcaaggtggcataaaatattgaactattgcccgtcattagcagctaagctgtctgtttgctctaacatccttcttttctaaattggtcaagaaagagtctcagatcttgaaagatgacaaatgatttcgaatccactgctgggtattcttctaagagcactgaaatgtcccagtgagaaatttcatatatgaaggcaaaggaaaaaaaaattaaactttaaataatgaccagttatacttcatcaactctaacaaatgaaggagcagagttggttttcyggagtttgcttcagttctttgatatggtcagtgtaggtcggggaggtcttccctagcttgagaaatcataacctaggatatttaagctgtcagtaatagtgttttaaaactccaggcctataataaagtaaaaagtgtgtctgataaaatgggtttttttccttgcttagtgaatgtcttctgtttctckctaaacattgtcacttgccaaascatgttttctgtttcatactaattttctactggcagtgagaccagcggaatctaagaaattgcatacgaaattcaaggattggaaagaagaagaggaagtcaaccattagcaaccctagctcctctttaatctcaagaggcaagaggtactcgatgaaccacatgctaaaataaaaaaaaatgaaccacatgctaaaatcaaatggcttctgcacctgtgtgcgttcctggactctggggtcacaggatggctgatgwgatgccttcgagaaattaatactctaatgagggaaacatcctttcatgttggtgcaagagacgttctaggcctggttctacctctagttggaacggtggtcatggacaggtcacccccgctgtccagaacacatgtcaagaagtgggagctggacgacaacattcttgttcagagcgttcttcctccacattttatccaaagcagctccacttttacctgtgttatctactgagattctgcgtgtgtgaaacacaaggtcacctgccaaaagcaaaacaattaggccagcattgggctaggtgaggatccattgtcttttgggcaggtgattgtgatacwataggagccggtgtcctgttgatggcatcccacaactttctaacctctgttgtagagttttgttagccacgatttggaccaacctgcagttaggccaagggctgctgatccaattggattaaggaactctgctgtttgagcatgttggcttcattcattggtatctcctacgccaagtcctaggcttggttacaaagggcaatgaagggtcttttctgtccttaagcactcacaggtagcttaacagtaatgccttggattccttccttcaagagcgayagcaggaagcccagcttctctggtagcagagcaggggtcctcaaagcagaccgtgaggtcagaggagcactggagtcaggagtttccatctccaccctgctgagtaaactgtagttacccacacagaaaaggaggctctccaggctgacagggtcacaaagacacacgactatgagatggaatgactatagctagaaaaaaaaaaaagtggggatgcccctcttgaccatcttatgcctgaaataagggaagacattcttcttttttatctgccaacctcccagtgccacagtaagcacagagtcaggcctcgaaaaataccagtcctttcgcctgtcccctctcacatggtttgaatccaagaggctgtcataccaggctcccccattcagtatattttctttatgtttaaatagtttggattgacttctcttttcttttatttttctgttgctacttaggaaaccatctccaggctagaacaagtgcctgaaatagagaagggtgaggtcactgcctaagacacttcctcctccacccactcctctctcagactcagctccttccacttctgcccacatggctgccattttaatttttgcttaaatgttgcagccaatatttcatgtattgttgttttcttccttgcctgggagactcttttgtctgaggttccctggtattttccaggggcccttctagcacttctgtgaactcattagcttccccttgttccagaaaatgtctgtcatacattacgtgcctttctctgtctttccctgcccctctcaccttcatcgatcacacttttgcttcacagaggtaagaggaaatcamactcacacagtatcttttgttttctagcaagctagaacacaagattttctagatgcatcttttgagttgatatgcaatattttccttgacagatttgttaccagctgagcagatattgtgtctgtgatgtatttgagtaccaggtatccctgattaccatagagtaatgtcttttattgaggcttttattattattattattattattattattattattattagagacagggtcttgctttcttgcccaggaaggagtgcaatagtgtagtcatggctcactgcagccttgacctcctgggctcaagcaatcctcccacctcagcctcctgaatagctggagctacaggcaagtgtactgtggcaattgttaatgttcacttttatttccatagttagccttgatcgtttagttttaaagagttatacaacacatacacacacatctaattgttgtgttattgggttaatgggaatattttagactcaagcctggttctttgcttctctccagcacagcaaaggatacacctccaagtataatattgaacttcaaagttagtaatgttcagtgatgcttaagcatgtagatcataaagtcctagactattttttgtctaaattattgtttgtagtcagcctctctactggttggaaacacaggcttgagtttggctttctgctctacctagttcattgctgcagctgtaatccagcctgattctaattttcaactggagatggttgtcttcttttttattccatgaaacaaattgattaatgtgtcgagggagcaaggtggtacttatacctacccagcctgcttgtgtgtgtctcaaggtggagagaggctgtggaaacaatagagagaatagcatggaaggccacgttgcaattaaacaagattgggaaagaagacgggactaaaatcatgccttgaagatgtttatcatatgaagttgaccttgagaccccaagaccggcttcagttttccacaatgcggctattatgagaaaaacagtgactaactgagcactgtgcataactcagttctcggaattttcaatcagaaattatctgatgacgggactaattcttattacgatagttccaatggatccacccaggatccacctccacaastaggtgtacagaagctggagatcccatcatgccgccgggcaccggtttacgagaactctatgtcttatcttggtagtacgattaggaaaacaaacacaatggtttctgccttcaatgtttccatggtgagggcagttattaggcatatgctaaagtgtaatatccgctttttcaaaccacatttcaaagttgatagcatcaacggctttaaaatcacttttaaagaatctgggcttacccagttaacagaaatagaacctgcctgtttatcagtgggtttgcctcacttttctgtgggtttcttttcttttcytaattatgcattaagaaaataacttaagtttctgtgcatacaacatcttcctttctcattcccagtaccctagaaacacagccgttcactgaagaggatttgagtgttgtctcctctgtggggtcamaacatcatgcttctttctgttctgccccatggcagtggtgacgatggcctagcttccatcccgtagcttcttgtgtttttctattccaccagtctatcaaccctgtatttgttgtcaaatttacactgtccacaggcaaagatcyattctcctttagaatttaataggagggtttggaaatgatgccatggaaaccctgagcagcttggcaatgctgaccccaaatgagaaataactatcattggtgttttccttctactactattatcttgcccattgatcttcaaaaagttcattggtcaaattgattgaggaacgcaagacttaaatgtaatatggctctggcaaattctgagatgctaacaaaaacaagttttcttaagaacaatgtcaactgactcacagtatccgactatataaagtcgagtgctctcatgccaggaagctgatacagttcatgaaacctcagtcattctttcgtattactcctgtcttctctttggaaaacaatctcatgaatttggtcttgacgctgacttaacatcccaggaaacagatactcaattccactgtcttttttgagaaatgaacagttctcaaactttgtttaaatttccttttcacagatgagtaataaccaaagatatttctgaaagggctctgaaaacatgcaggcaattgatctttaaaaataagatagaaatagtaggttttataaaagaaggaaatagaaatacttcagaagaaataaagtgtgctgaatcatgttttaaacataattatatccggaatgcacttacccatttgaaaaaaaaaaaaagtcaccaagttgtttccaattgtttttgtarrtttgcttagtcattttcagagacaaaaatttgggaaaaggattgtagaatsactggcttcccaaaaccacttggtgtttacaaagttatcaaaaacgggctgggaccactgatggtaataacaaaacctggggccctgaatcgtgtattctacatccgttagcacactgaagccacaccgcaaacttgtgaggccagcgttgcttcccctaccccttccgtcaaaaaccgtctgaggctgatcattaacttgcataaggtcacatagctaatgagaagcaaacgcatcataatgacctgggacatatgacactgaagcctactctctttccacaaagcttgatgtactcagatagtaattagtaaacattttcataaataatcttaaccttttcaagcatttttgtcgattggattgtagcactcaaaagtaaggtctgttttactaatataaaattgggcctgtggaataattctcttcacagaagtgtgtgtgtgtgtgagagagagagaaaatgtatatgcatacatatacatatattattgagacataatttacataatttatgttctataaaattagcatattttaaatatacagttctctggattttgaaaaatgtatacgtgtacataatcatggatccaccaccccagttaagatatagaacattccagggccaggttcagtggatcatgcttgtaatcgcagcatgttgggaggctgaggagggtggaccacttgaggccaggagtttgagatcagtytgggcaacagggtgaaaccccgcctccactaaaaatacaaaaaaaagaaaaaaaaaaagaaaaaaatagctggccattgtgacatatrcctgtaaccgtagctactctggtggctgaggcttgagtatcgcctgggaggcagaggttgcagtgagccaagatggcactgctgcactctagcctgggtgacagtgagactgtctttaaaaaaaaaaaaaaaaaaaaaaaaaaaacccaaaaaaacaaaaacaagaacattcccatcacgtcggtaagtatctcattctcctttccaataaatccttttattcccagaaacaagcattcttgtttcaatcattgtaactttgttttacctgttctagaacttcatttaatrgaaatcatacctactgctttgtatgtgtcgtcttctgcttaatgattcacataatgtttttgtgattcatccatgttgatgggtgtattaggggttctctttttcaatgctggatagtatcctgtggtgaaaatacaccacaattcgcttatctgtgcacctgttgatgagcattgggttgtttatatttgttggctattatgaataaagctaccacgaatattcataaatcctgtatacatgtttttatgcccttatgtttttatgtatttttgataaatacctaggtgtgaaattattgactcttagtgtttaacttgtaagaatgctgccaaacagttgtctaaagtaattgtatcattttaaccccycgctagaagtgtgtaagagtttatgttgcttcacakcctcatcagcactttgtaatttcagtctttttaattatagcctttttgtgggtgagaaacgctatctcttgctagttttattttgcattttcctagtgactaatgcmtctttttatgaactcattggccgttcatatattttctttctgtgaactgcttgtttatgtattggccattttctaaaaattagatagtctttttaatattgaattataggaattctatatatattttggatacattctttttttttcatatgtactgtgaattttctcctttgtcttgtctatttattccttaatggtatcttttgaaaagcagaagttataaatactgatagtgtccaatttatctttttcatttgtttagtgctttcttgttctaagaacctttaccaatcaccaggtcacaaaaatattttcctatgttttcttctagacastccataacttcaatctttacattcagatctatgttccatctcaaattaatttttgtatatggtgtgaggtaatggtagaggtttatttttctctccataagactctccaattgttctagcactatttgttcaaagactaatcctcgcgctattcaatttccttggcatctttgtcaaaaatcagttgactatatatgtgtgggtgtatttctagactgttrtactccattgatctaattttttttcttatacttacygctcgattgcctggaagctaggtaataataaggattcaaactttgttctttatttcaagattgtttgggttagtttagatactttccttttacatatatatttcctgatcagcttctccatttcttttaaaaagccttgctgggagtttatttgctttggtattgaatctgttgatcaatttgaggaggatcaaaatcctgaaagtgttgagcgttaccatccatgagcatgcatctctccatttatttaaggcttstttatttataaacatttcagtgatatttgatgattttgaatgtggaggtcttatacttttttgttaaattaactcttacacatttgatttttttatgctattgtaaatggcattataaaatttcttttttccaactgtttgtttctaatatatagaaatacagttgattctagcaaactgctctcatatcctgtgatcttaaaatttatttattcaccttttcctttttgttaaatagattctgtagaattctctacatctctgaayatagttttacttcttctccaatttttatggcttttgtttctttttcttgttttaatgcactggctatagcctgtaggacagtgttgaacagaggttttgagacagacatmattgctttattcaggacttctctattatatgtgatsctagttgtatgttttctgtacctatacttcattagattaaggagtttgaatttatttctagtttgctgagagttcttttataaatgtgttcatatatatatgttttatatttttcttattcttactatctgcatattagagggagtttagctcattggttaaaaggatttgttccggaaacctaactccaaatctttgaacttcctagaaacctggcctgtttatttaccccgtatgtcactttcctttatctgtaactggaaaatgtgtacgaagagcttaatacaatgactgatacacagtgagttctccataaatgttagttattattttaatattacagcatctgtggaaacagtgggtttatatttcagcgtcctgagaaacactcatcctgaacaaygggaacattggccrcatcygccattgtcaattttaaataaaagatatgatgactagttggtgagttgatcttgtaagacttttacagatacccagaacggctctacttcttcatattccactttttagttttaaaagtttaagkagatctctgtgatccctgaagaattgtgtgcaaagcagcattaagacgaaaatcttttatatttgtgttgtagcttggaaaactagcgcgtggtctgttttgttccactggctcctaaggttcaggtattaacataaatacagcccattaacacttgttcctctctgtcaggacataaattaagtctgcaggtgttccatgaagctgtacccttggtactaattaagccttgataattaggtttgttaaattcaggactttaagcttatattccctccttgggctaccaaaacggagatgtgcaatatacaagccctcctgacttttttttttttttttttttttcctgcagagagcgttgctgctccttctctattttatttctttattactgtttttttaaatgaaggagtcagtaacaaaccgttcatcattttgccagagtagggtgtaaaccttcatgcagacctgtacatttgtttatgacgagattaaagtcttttctcctcctgttttgtgtcagctcagacactgaaggggaaagtttccagcctggtttctccatacactgaacatgttgaaatctatgccttaagcccaaatgarctgtcactcaagtatgcacgctcatattattaaaaactgtgcatgtaatttgctgggcacccaaataatttgttttttatttttccttaaaaatgagactttctgttaggaaagtgattcatgaaacagtgaagatcctgcctcacaactttcaagaaaccsacagaggtccctattcacataagaattttctaagcagaggttccaatttggatatttcgtggccttcaggttatttgtaaccagtacacaaaccacaaagtcataatcagatagattttctttccagcctgtctttcctctttggttgctttgtaaatctattactcatcagatcatatgtttggcaaatgccacttttcattttgaatcaatggaatcataaaaaacaattctactagtaccactttcaagaatattcatagtggtcatgctaacgtaataacctctcttttttatttgaaggatattaaataaaattgtacttttaatcagagcctttttttgaaaaaaaaaaaaaagaaaaagatagttgatattgtgggagatggctacaatacagattcatcccatattctctttaatgttctattcccaagaagagcactaattaatctctctagaagggtaccacagtttccatgagcgttcatattttgaagtttccaagaacatgttctacagaatggaccactgctctcttttcagacccaacccttgtatcagagtttgcacacatctagaagttccggttctcccagtcattacctttctccttcaagctgggattcagagtccattttcatagggcaaaatgcagagttcgggttccttcctatccatgagartaggtgctgaaggagataaaggaatgaagacatagactttgaaagcaatagtctggcaatcatccaaaggtttgtgggaggacaaaagatcacaaagtatgtgtttgtgaaaataagactatgtcatgaaagctttagaatatccaacacattatagaatattttcacggaaatatttcggatggaattttggctttaattctttctctttttttcctgttcttttccctctccccacaaccacttctstttcattttctgttttgctccttcttttcataagtagctggtagtcagtgttctctttttcttcctgtgagacaggatctccctctgttgcccaggctcgagtacattggtaggatcttggttcactgcagcctgtgcttcccagactcaagtcatcctcccacctcagcctcctgagtaactaggaccacaggcatgggccaccacgctgggttagtttttgtatttttttgtagtaacacggttttttcatgttgcccaggctggtcttgaactcctgtgcttaagcgatccacctgccatggtctcccaaagtgctgggattacaggcgtgagccactgcgcctagcgaggtagtcagtgttctaaacactggtgtacaatccaagtctgtcgctgcccaggatagaggagggatgacgtgaattcacacgggcctctcctacaaatctgagtgtacatcaagtgaggggcgtccctccgcacctcactgttgggctgatcaatcccattcccactccattatgtgtgtatttctaagtggcagatttgccttaggaaatggaagaagggsatgaaatagtgaccaacacaaattactgggttggcgggagttgagagctggcaaaatcgtcttggagaaggaaatggtgcagatttcagagctggcagacagcatctacatccacctctgcaggaagcaagggaaacatttttcttctggagaatcgggcagcctgcagctgatccggtggtgtctgaaaccatcctgtgtgctgtagtgtcaacaacttagcctggttactttgccaccaaaccccaccaaatgcctttgtatctttttcagaactgcatctctgcagcataattgatattacaggaatgaaaagtgttctgaggcatattattcccagggtaaagagtcaccgctgattaattacctcaaggacaaggggacggtgactttttctcttgtatccagcagcgccacgcggggcgggcgggagasgcaaggctaagaggtggatgaaaggctagggttaaggcatttcacaatgtcaggcatcttgttagactgcggctttccaggccttcccccgtgactgctgcgggggcctaggccaaagatatgcccgagtagaaaatctgacaccagcttcccagttttctcttctgctctctttggctgcaasgcttttaccatggsyaaaccattaggccggctctgcagggagggcaagaccacagcagctcagtatttcctgctcagggaaaaaggccaggtcttttgttggtggaaatscacttttccatccactgtcttctaagaatgaaagtaaatctgttgtgctttcctctgccctgtcctcaggcttagccttagtgggcctggtttttgcccccctccagttttagcttcccatctaaaatacaagggaaaagacagcaaggacaggacacttcctcctagtgtcttgtaaagctgcaagggagtcgcggctgagtcgaggatccacattcctggatgagtccttttgttaccagcggagggtgtccgggttcttggcattttgaagaaatagttggacaaaatgcacaaacaaagcaagagaagaatgaagcaacaaaagctgaggtttattgaaagcaaaactacactccatagagtgggaacggcccaagcagccactcaggggccctggatagagaatcttctggagtctaaatactccctagaggtttcccattggccacttggggtacaccccttataaatgaagtggtggcctgcaatcagtcttattggttgcagaaagcaaccratcagaggctgaagtgaagttacaaatatcacactcctatgcaaacatctgattggttttggaaagcaaccaatcagaggctaaagtgaaattacagagttgctcttttatgcaaacgaagactccgcctccagtcagtatgattggttgtgggcagcaacccatcagaggctgaagtgaagttacaaagttacactcctatgcaaacgtctgattggttgcaaaaagcaaaaccactcagaggtactttcaatttcccatctgccctgcagaaaaggtaaggggttgcaaaagagtagcccctcctccttttgttacttaggcgtggaaagttaagggtttcctttcagtttggttctaagaagtcagagtgaaatggctttagattccctgcctgcagattctattccccagcctcactttgagaagcacctggacacttcgctctaggcacgtgtcttcttcaagctgccatccattatgcatagtacaggagctcagaaaagtcacccgtgggttcctttctagctcaatcatgctgagagtccagtccatttataacataattcataaaggaacattctatttagttctcagaactctgtggcaggggactgttgttattcctcctttacagaggtgggtctgaaggtacagagtggataagtcattttctccgggccagccacacagcgaatgaatggagaytccttgtgtgtagtaaatggctgcagccctataagctataatcatatatcatcaacacctttaccctgttattaacgtgtctgaaattagggaacaccacgtacaaaagggatcagggtccacctttctgaagaaaactgcagagcttttgcagttattaaactagcaacagatgtaaagtccaactgttagagtttttctttaaagcagaagttagcarttacaggtgcttgtgatgtcatcacttagatgatcttataaatgccttttttttttttttttttttttttagtcggagtctcactctgtcgccaggctggagtgcactggcatgatctcggctcactgcaacctctgcctcccgggttcaagcaattctcctgcctcagcgtcctgagtagctgggacaagaggagcacaccactgcgcccagctaatttttgtatttttagtagagatggggtttcagcatgttggccaggatggtcttcttctcttgaccttgtgatctgcctgccccagcctcccaaagtgctgggattacaggcatgagccaccggcctggccataaatgtcttttctgggtggggcatggtcactggaaatgtaaaccctcccttccccaggtcagcctgcctcccaggtgttggtgctatgattacagtgaccacataatttatcatccacactggcacctttttgagagaggatggggagcaggtaattatgctgggacaataggcgtatgtcaagatatctggtcaccctatctatgatctgtcacacttagtactttctaaaattctcgggcctttgcaccttctttttatcaacgcttagttctatgttactgaatatttcttaattaagtgcaggaaagaaaataaccaytttttctccttttaaagaagcacacacacctttcttttattggtattacattccttttccctgttggtgcccctgttggttttccaaattgtcttcccatccttgtcctacctcccaatagagtacctcatcctatagtgttattataactacagaaaatatattttcattccttccacttcatgctttcagctagaaatgtgagtctctgagacttgtattcttggggtcacttaaaacataytgcataatgaggccttcaatgactctgatttggaactgaccctctatgaggggttatacccctggacaccaagctgctggcctgagcatgaggttgatggccaatctcaggagaggaggaggaagaggaggaggcggagaagaaaattgcgtgctaatttcagttgtatattgagcccacacatatttacttccaatatgaagcaaatctaagaaaaattctgctttaaagaaagaaatgtaaatcaagtgactgttgatggacgcttggaagaattcttatttatttatttttttggacaggctttcactctgtcagccaggctggagtgcaagtggcccaatcatggcttactgcagactcaacctcctgggtgcaagtaatcctcccacctcagcctcctgtgtagtggagaccataggcatgttccaccacacctagttaattttttattttttgtagaaatggggtctcaccatattgaccaggccggactcaaactccgagatgcacgtgaatctccagctgtggccccttccaaagtgctgggattagatgcatgagccacctggcccagccagaatccttccattaataaaaggatggaccatgaactcccttttatgatatgagccgatcaaatgtgagcagaatagtatcctatttatacaatgtagtttaaaaccaacttcttagaaccatgagctaagggggaatctggatttcaaatgctagttgcatcaaacacgtttccaccccctcaaaacgtggcccaaagtcattagtgtcggagcacccagccatccttggctccttcccacctatgttgattaattaaaggacccaagagctaaaagggagaagtagctgcatgcttgccacttagtaatattttgataagtatttttgggatgaatgcaatgacgcatgaatgaatgaatgaatgaataacataggctacagtattttgtcttcttggttagggaccttgagtaaactgaggagtctgaggggaatgccatggaagtctgtaaacccaaaatcctcagcgaaacctcagccatctagggacatctggggcagcagagagccactggtgtggtgagttatctccctgggccttgagatagccatgctgttttgtctccacaaggaagaagtaggaggcatagcccaaggcagcttgagaggaaagcctcttggccttgaataagatgactttgttactgggcaaagaaagcccggctggaagtgctctttgatatgcaaatatagcctgataaggatttcctctccttcctactttccctccccaaccctcccccaagctaaaattctcttcccaggagccctgtcatcagcagggagttttctgtctttgtccccatctcttcacttgtgctgtgcaaaatcaggccacgattgcagggtagtccacggcttccaaagagaactgcataaatatacatctttcaggggaagagggagaacctggagaagtcaggagagcaaaaccatgccagtcagcttcagtgatgataaaggttactgttggatgaaagtttgcattttgttgtggtgtgggaaggaccttatcctgtcagctctatggatgtgcccagtttaagctctgaaagttcctttaacttgaaattgtttttgatcatgtgacaaggtcttctgaccctttatcacccacagtgttttattcatttgctctaaaccagcagtaggtgaagttaggaataatatgtcaagcttcctaactccatggtgctctcattgttgtgtgtgtgtgtctgtgaataaacacggaaataattacgcaaataagctattggcaggtggtgataacgtaaccgcccaatgggttcattctgcctgatgcccagataaagccgatttatctagacaggggaattgcaatagggaaagagtttaatgttggtagagccagctaaacgggagactggagctttattgttactcaaatcagctttcctgaaaattcagagactggggtttttttaaggatagttttgtggacaagagaatgggtactgctgatgggctgtggatgcaatcataggggtgtgtaaaacccttgtgccctgaatccgcttctgggtggggggcagggcacaggaccagttgaatggggatggggctaccagtcctcaaaaatgcaaaagccggaaaagacatttcagaaggccaaccttaggttctacaaagtgatgttatctgcaggaataattggggaaattgcaaatcttgtaacctctggaataatggctgctaatcgtttatgtccactctttagcagaattcaggctcctgtcctcctcctaacttggtggtcttttgctagctttacaaaggcagtttagtttgggggtagggccattatcatttaaattaagtactaaatatccccccaaagttagcttggcccaagcccaggaatgactaagggcggtctgaaggttaaaggcaagatggggctaggttagatcagatctctttcacggtcataattttcttactcttacaatttttgcaaaggcagttttaataactgctatttagcaaagacagttgggtaagttactagagggagtattaccttagatggggccaggagggtttctctgaggagatcccatttcaacagatctagaaatgtaatggagccagtcctagggaaacaggactaccaggaatcctcaccagcccsgcaaagacgagggagcagcaagttccaaagcccrtggcatgtcaagggtcgatgaattcaccaactgcaaggggctttggtgaccccagtgaacagatgagaaaggggaggaggctgggatcagtgcacagctttgcaggctttgggaaggaatttcgagtttatctcatttgtccaggtatttggatgaagccctggcatactaaccctatgaaagtttatagttcccaaattgcaggataacaaggctctgtaatcttcatttcctcaaagttttacaccaggattctatggccaagtgtgtggcagtgtcacaacttaagagccagtgtaattgcccaacgggttctccttgcccgctgcctaagcaaagccgatttatcaagacagggggattgccataaagaaagagtttaggtccaggcacggtggctcatgcctgtaatcccagcattttgggaggccaaggagggtggttcaactgaggtcaggagtttgagaccatcctggccaaggtggtgaaaccccatccctactaaagatactaatattagccaggcgtagtggtaggcgcctgtaatcctagctagtcgggaggcagaggcaggagaactgcttgaacctgggaggcagaggctgcagtgagtcgagatcacaccactgcactccagcctgggcgacagagtgaaactctgtctcggaaaaaaaaaaaaagagtttaattcatgcagagctggctgtgtgggagaccagagttttattattactcaaataagtctcccccaaaactcagggatagagatttttaaggagaatttagtgagaagggggtcagggaatggggagtattgattggtcaggtttragatggaatcagggagttgaagctggcctcttgcactgagtcagttcctgggtgggagccacaagaccatatgagtcaatttattgacctgggtggtgccagctgatccatcaattgcagggtctgcaaagtatctaaagtactgatgttcggttttaccatagtgacattatcccctggagcaatttggggaggttcagaatcttgcrgcctccggcagcatgactcctaaaccctaatttctaatcttgtggctaatttgttagtcctgcaaaggcagtctagtccccaggcaggaaggttgtttattttgggaaagggctgttatcatcttttgtttcaaagttaaaccgtaaactaagttcctctcaaagttagttagtcctacaaccaaatcaactttgaacaagacagcctggaggttagaagcaagatagagtcagttacatcagatctccatcaccttcataattttctccgttataatttttgcaaaggctgttttaataacagccagtcgttcatgtttccttgtgccacgtgattattttgtacagtcaacattaagagacaggcacttgtaaatgttgagatgccaagggggaaagaattttagaatccagatccgctttggtaagagtggccttcgagcctcatgtattctctgttcagctgttaagattgttattaaactttatggaccataaaccccacagaaacaaggaggttgaacaaccatgctattacacaagtgtcaaaacaggagctgtatttcatgtcctgaaaagtgtgcacggttggcctcctctaggtcccacgtgccttctggatggttttaaccctcagcctctytttggcctgtgagtgaaacccatcatttgacacagaggctttctggaaatgatgctcctcttagatgaaagttccctttcagaaatctttcattccctgacctctgtgtccatcccactaatatatttcttaccaggagtacatagtttgttctttaagcaaaaccatatgcatcgtattttaaatggaacagggaggttgttccatgcrtcaacttagtccaaawgtagagggtcaggaaaacaatgatatgagaraagggccggttactgtctgggaatccataaatactgcttggcaaatggcacattgcatgcttattccttaggcatccgtttagcaaaataagatgtcaagctaattgtaatgatatttctggggtttcatcttctctccctggtacataaaagaatgcaattccacctatattttgatttaagatcaaatttttgcaaagtataattacatttgatgtaattgcccatgcaacccagatgtcatatatttatgttattattatcatttttcatgtgtagatgtggtgatcgtttgtgctttgttaaatattcctcgtctgtccttctggggatgatgctttttctccctttttggtcaggcatagataggtgacttgctttagccaaagaagcatgaactgtcacttcaagggggagatttacaagccagtgcaggtggattccctgctttctcctgacatcatgatcatggactcacatgacaaaatggatcctccatcttccagcatctctgattgagactaacaagggccctgacagccttttctggacttgtagtatgtgcaagaattaagctttttctgtatcaagtcaccgtgttatgggggttgttcctcactgcagsagaaccttgttcatccgtattagaacagtgtggtgtttcatgttagcagagtgtatcaggatcttttgtttttttttttttttaaattaaggatgctgtatgagtcttttctcatactactgagaaagacatacccaagactgagtaatttataaaggaaagaggtttaatggactcacaattccacatggcggtggaggtgtcaccattatggcagaaggcaaacaaggagcaaagtcacatcttacatggtggcaggcaagagaacttgtgcaggggaactcccctttataaaaccatcagatctcgtgggacttactcactatcacagaaacaacatggcaaagacccatccccatgattcagttacctctcaccgggtccctcccatgacgtgggaattatgggagctataattcaagatgagatttgggtggggacacagccaaaccatatcagatgcaaagttatgcatatgttgatcagctcaatttagcctttccatcatgtttacatatttcaaaataatgtgttgtgcacaatatatatgtgcaatttttgtcaattaaaaataaattaaaaaaattaaaaaatggctttcccacagcctgtcgacttccatccccatgtgtggctctccccagggcctcccttcttgttctccccagttgcagacctcagacaggagtctgcttgtcttcctaggcccttgtcagagtggaaggtggcyctccaccacaccagcccactttccagttatcaaaaaggatctttgatttaatatttccagagcaattttggtgatttccattcaaatctgttttttgtcataactaccttgcttgcctatgggacatgttcccatttcagtgcatacttgacctttaccataaatcacatatttgtaaactgtaccctcctgctgttttaytrggcatggagaagcagtcttttctttttcttgatggcctgggttgaccagatcctgacttttgtggagacattaaagtgctagaaatgataatggtgaaagattcagaagttgaaggagatataaggagagaaatggacaattcttttggtaattgaatgaaataagactcttaggaaaattctccccagtggcaatgttgtaagaaacaccaggccgggcacagtggctcacacctgtaatcccarcactttgggaagctgagacaggcagatcacttgaagtcaggagtttgagaccagcctggccaacatggttaaaccccatctctactraaagtacaaaaattagccagacgtgatggtgcgtacctgtaatctcagctactcaggaggctgaggcaggagaatcacttgaacccgggaagcggaggttgcagggagctgagatcacgctgatgcattccagcstgggtgacagagcaggactccatctcaaaaagaaaaactcaacgaaacaccccagcttctatcattctcaagcttagtgtgtgcaagactcatggatgctgcttgttataaaggaagataaattatgaacaggcagactggtctgtgaaccttacccagaaaaatacacagtagtccagtatattggcctccagggcaaagctacctaggttctgagtccaattatggccttcatgagtcttgtttctttggacaggttttccagtgtctntgcgcctcaacttcctcatgtataaagtggagatgatgccattacaggttgctgctttatggcacataattaatactagctcttatttataggaactgaacaaagccccagttgttttgaagcatgtcctatcattaacacaggtaatcaggatatattcattgaagtctcactgtgtgccaggcactatgctatgcaccttaygtgtgttattttatttcatccttccagctctgggaggtgatgactgtcatctgcattttgcacatgacaaatctgagggtcagagaacttgcccagggtcacacaattagtagatggcagctcaaggggtttttgcctgcgtcttcacccaaagccactaacacgggatctgtcaattgcattgctggtgatcaagaaatgccagctcctccrctcttccctgagtgccttgttggagacaaaaccagcaggattatatccccagcactgtaatttagtgtggcagtcaggggaaaacaccttgtagaatttcatttcttatcatttaatgtcccctttaattctcatttaagttcccctctgtaaaaggcagtcccttcagctctcataaaactttatggtctttacttgtgattaggcaatggtaaaattgattctctaaaaccaacttctagtcaagttatgtaattagccaataagggaggctgagagaggaagatatacaaggttctccctcaagaggtcagacgtattatcattggttagatgccgtatctttaaaacaccatcagcttggaaaacactatccattagcaagagatcagagcaagagaaacctcgaagggtcgaacggtccrttctgagggctccacaaagaactcggcatcccagaaggatgattagccttccatctctcgagttgtctcagagcacaacaggtctgagtgtttttttctttaatgaattaaccctttggatttcagccctagcttttgcttcccacatctgacatcctgccctacctcctgccagaaaagattttgatttcgatcatggcagttgctgtcgctgaggtaatatgaggagatccgagacctcatccttgcagggagtgggcttgagataattctcgttacaagtttgcctagtgcttcacataagcagaggccccaagacatcagcaagcccgttttttgcctcttcctggttcatggttagactgcatttttgagcctctgcctgttaggtgcagccatgtgcctgagtcttggccaatggactgttggaagacgagacgttggccccttctcaacctgacctgtaaaaacctgtcttgcaaaaccctcacggctctttcccctgcagtcttgatgtgaacaagcatgatgatgttggaagccatacgcaagctggatagagccagggtccctgagttcaccacccagagcaaagtcacttgtcgatcagaaatacagaactagttttggacttgatgtgagaaatcttttactgtatcatagtagcaagcattaccccaaccaatacctgtgctcatactgctacagttttttttttttctttttagtgactgggtcttgctatgttgcccagacttgggtgcaatggtgccatcatagctcactgcagcctccaactcctaggctgaagccatcctcccaccgtagcctcctgaatagctgggactaaagtgtgcaccacaatgcccagctaasttttgtattttttgtagatacggggtcttgctatgttgtccaggctggtctcaaagtcctggcctcaagtgatcctcctgccttggcctcccaaagtgcttggattatagacatgatccactgcacgtggcccatactgctattccagacaagaaattgtaccaggaaattcactgatattattggtccatctgaggatcatcagagatgaaaatgagatttgacaactgcatttggaaatggagtatgacagtatcattctgatgtagggaggatatcacctcacaggagtctttcctggctatcctgtccaaagtcactactcacaatttctctatcccataactctatyttatttctctgtctagcacttatcactatctgatattttctgtctatccatccgtctattcattcattcattgctaatttattagtattgccttcccatgaactattagctgccagagagcagggacctcatctgtcctgtccactcatgtcttcagcacttagaacagtacctggcatataggatgagcttcagaaatatttgccggtgagtgaatgagggagtgaatgaatgagggatttgcagcttgaacgctgtactttgaaacagttccagattcatgaaatttctttttaatgcagaagatttcttatgtgattaactgaatgggaattgatgctttgtggaatgaaatggattgagtacagagtgtgggatcaagaacttttaggcactgtgagtataagagggaaaccaggccgggagcagcggctcacacctgtaatcccagcactttgggaggcggaggcgggcagatcacgaggtcaggagatccagactatcctggctaacacggtgaaaccccgtctctactaaaaatacaaaaaattaactgggcatgctggcaggcgcctgtagtcccagctactctggaggctgaggcaggagaatggcgtgaacccaggaggcggagcttgcagtgagccaggatcgcgccactgcactcccgcccgggtgacagagcgagactccgcctcagaaaaaaaaaaaaaaaaaaaaaaaggaaccagatggccctgcccttgagcaggctgtggtctggcctggtggagagacagagaatcagttaattccagggtcatgtattaggtagtaagatagtggttcacaccaaaaacatagaaaatgatcacttagcctgatccagaagttcaggaaagggctctgagcaggagatggaagacctcttggctggttaaatggagatcaagtggcagcttggactcctgctgcaattaaaaaattactctccagttttcttcatgtgcctccccattcactccaccaccactcaccccaaatcagatcatgattcatttgggttgtaccgattaagagggttccctttacatgaccattccagtcatgaaacagagaatctggtcacctgtcctttatcttggctggtccaattccataagaagtaaatgctgtgtgtctgcaattcaaaagacccctttcacgggaggctgggagatttttcyatctaaatagcttaattgttactctacagggcaatcataaatgtaaatcgacttaatatgacttgattgttagtaatgactgtgcctctaatgacgctggccaatgagcctacacagaatgtcgcatgcagatcaatgagccaaatgttagcaggggactgggcatttgaagatttaaaaaaatgaaaaattgcactgtgacattgctggttcctattagcaaaataacagacagtgttatcagtcattgactcagaagatagtttcttaccgtttggggaaagtgcttgtctattcctctccaaagccatttwaaaaaaaaaattgcaccrgttctcatcccatcatctgccttgatcaaacatttgcttattggaatcacttcgaaaaggaacttggtatcgttcacatgtgtttataactctcaaatcttcttcttccaatttttaatcttsatcaccacagctttataacaggaagaacgctcaaagaagaaaaatagaagaagcctgaattttaatttgctatttcttcacacacaaaacaccccaagctcaatcaatgcccagaaatgaaggccaatagatgatagtggggcctcagatttcccacctattgttttgaactctaattagggaaagggaatttggaaccattgtcttctctgagtgtgcagacacgatgttatcattgtgtttacagaggtggtcagattcccakcacagtgtactcccgcacagataaccgtcccatcttgataaaacaatgctctcagccgaatcctaaacacgctgcacaaggaagaccttatgctgacagtagggaggaagcgacatgttaacaaacaagtttgccggccaggaagttttaatcagccctttctactgcagggggtatgatggatggagaccctgtttcagaggggtttcctttagataaaacaataataccatgctttcaagaagctcgttcgacagctgtaaagctatgattaatcccccaaaagtcaaacatgggaagactggcaagatgagattattcactgggtataattagccacaattatcgctaaagagaatttggggagattctgctctaaagggaaaagctttgtaaaggagaattaccagtagagtgaccttataatttaccatccaatggattttgaatacttytgagagagaaatgagatactgataataattataccaagacaacagacataaattgggattggcctagacgagcaaagatgaatggtcattctgtctgttagtaaaattccatcccaggcacaatatctcagacttgaaacaaaataaaagtgattctttctaggataaactctaaactaagtgtctgataaattctgggaaagtttatccaattgttacaacccagggtcaggaaaactgttttcaattttctgctgtatgaagttgccagtgttaaaccctttygatagcaagtagaagaaatgttcattcaaacaggcttaattaactgaaagatataggtgtggtaaggggatcaggtaaagcttgacccaggggctaaactttaaggacctggttcccctcttttcatcccttggttttatttttctcagcattggcaccattttgtgacaagctcactccttgggtcttatgacaaatgttgactcttctaaaccacatctttccagattcaatatagtaggagaagaccagacttgctcttttcctggaatttagtctgacgtggctgggacaacatgcccactctcaacyaatttttgtagccatggagatttggaagtctggcaagtcttgggtcacatgatctaccttacagctgttactrcagacctcccaaagctcacgaactgagagtcaggaggcgtggttcccctaactcaaatcagaatttcgttatcaaaagaagagagggatggttctgtggtgtcccacactcaaataaacatcctttaaatacctctagatgcttataattcctgttgcagccttagtcagtgggagccactgasctgcattcgtgtaggaactgagcaaggttcatctagtctcggtagctasctaccccgagagctggctgatttttttttycttaaatttaattcaagacttcatgaagtcaacaaaatggtctgttggaaattattcctaacccccaaccactgtcactgccacaatcaaacatattttcattcttttgcagctgcagcccttctacttgaactttcccactcattgcccttataacttgccatttaatatctcttgctttcctacatggctgtgactactcgtgggcagggactgtatctcctgtttttggtagtgcctccagaaccaaacaccatatgtcataaggtctattaataaatatctgctagtttttaaagtttgagaaaaacccgtattgtggaatgaaaatgatactgacaagggaatacatctagatcagaaatactgatatcstaagtgagatcttgttttttaaaacaaaaaaaagtttaagaaattgtcatataggctgggcgtggtggctcacacacataatcttagcactttgggaagttgagkcaggagggccacttgaggccaggagtttgaaaccagactgggcaacacagtgagaccccacctctacaaaatattttaaaattagccaggcgtggtggtgcatgcttgtagtcccagctactcaggaggctgaggtgggaggataggaggctgaggtgggaggatcacttgagcccaggaggttgaggctgcagtgagctgtgattgcaccagcctgggtgacaaagtgagaccttgtctcaaagataaaagaaagaaagaaagccctatcaaaattttaaaaaataaaacataagaaaaaaataaatggatacatgatatttgtacttctaagaggcatcttctatacatttcctgtttctctcttccttttcctaaggagtccttgttgatttgtggccatgaaacctctctcctttccaggctggcttcttacctaggtcgtgtcctatccctttattttctggcagggctggactgtcacttggttgttctcggtttcaggacccacgtcttttgtctctgtaatgaatgtgttcagaggtctctgcacagagaagctggctgttaggaaaactatttcttctttccgagacaggctgcaaaatgcttgttactattttgtgtattcctggcaggatttgtattcttagttttattactaatgataataacagttaatgttgaaatcagcttcatcctgaaagcactgcatccattatcttattctagtctcaggccctggaggaattttctctcactatacccatttcagaaattccagaattaatgctcggaggagtcaagttacttgtctaagctctatattacagaacttaaattggcttctctctttcctttgcggggtctcacatgatccgtcgttccaaatatgagcactttctcttgtcttttctgagctacctattccaagaacacagaggagttgttattgtggttacttgtggtaagaagastaccttyctgattggacccagggcagaaaaaagaactttcaggtggaaatacagtcgtggtgtcaggtagtgtgtaacttcgttaagttcagtcatagcagccgctgccaaggggggctgttcctgttcctcatttccaattgaaattaataactcacttgagatcctactaaacaacacacggaacaatgaccgcaataaccaacatactttgagtaactattacatgcatgggctctgtgctattctcttatgtgtattcatttatttaattcccttaacagttctttctggcagagacacccccccactcttagcccacttttatagatggctaagcagaggctcagagaagtcagacaactcacccaggatcaagcagagggcaagtggtagattctagaatttgcatccaggcagttgagtctagaattgtctttgtgtattttgctccatggtctagcacaggatcmccattggtagatcatcacttagaatgccatcactaccttctaacagcaatcagtccccttaagtggctttcttctcttttttttcttttatctttktgttttttttttttttttgagggagtcttgctctgtctgccagatggagcacaatggcgcgatctcagctcactacaacctccgcctcccgggatcaagcgattctcctgcctcatgctcccgaatagctgggattacaggcacacaccaccacacctggctaatttttgtatttttaggagagaggkgttttaccatattggcccagctggtctcgaactcgtgacctcatgatccactcgccttggcctcccagagtgctgggattacaggcatgagccactgcacctgactaagtggctttattttcttatgtggggatcctggagacacagtgtgtgccaaagcgtctgcagaccagtctgtacagttgattatagatatattaatgaccacttctgagctaaaaaatgatctagaataatagactaccaaacacataagcttatttacggtttgcctccttctcatgcttttggaagggaagcactgagggtcattgtatcagtcagcgtagactaggtttgccgcagtaacaaacgaccccaccatgccatagcttgcaaaaacaaagactgagttcttgtctacactgtagkgccgtcaagagctggctctgcttgctcttggtcttctccatgccaggatccagagtaaaagcacagcttctctctaggactccaggggaaagagaaaagacaagttcttaaagtttcttccaggacgtgacacctgacatttcactggccaaacacagtgacctggtcactctggggcagggatgtgtaatctccccatagctggagaagtaaataataatgcacaataacattgtctcccatgggtgcagatgtgatgctttcctccttgtgactgttttctgtcttgctgtcccaagtcctaaggtcccagccacctatggttctttggacctgtgattttcgctgaccccgaatgactggaggaactgctgcctgcatccccaacccagccctccttrtcagtcacgtagaaagcagttattgtttccaagttccctgcccttgttaaatgtcagctttgagtgaaaatgttcctaattttactcagagtgcaaagaacayccaggtcaggtacctgacctgcttgattcatgtcttggaaacactcctttgtctttcagagaaagtaaagagtgatggagacagagagagaaagtgtgacctactttttattatcagcaccatttcatctgcaaaacacgacttttctcttcttrttacgctgagcatgaaaataaaatgttttccaaaagacctggctttggctgttgtgaggaaggccagggacttgttcaaaactctgatgagctcgatgagcaaatgattccaatttttaaaaactgtaattgactttcaaactgctctcactgtccacacataatatgtggtacttttctgcaaataccagcagcaaggtaggacaaaaccagctcccacactggctgtttgcttgatattaagctttgccagtccaatataggtcacatttccaaccagattttgtgcttatctctacattacaccttgtagcaagggggaaaaaaagagcttcttgacatctttttgaagaatggcgctctttaaaaaaacataagggaactttttttttcaaacactgtaaygagggtattcaagtctgcaggcaaaacagagctgtttgaaaagacattagcctcgaaaccgcactgtgccagaatagatacagctacgtcaaaatgccgcatttattttgccattacttttcactgactaaaaccatttgctaatgaaagttctagctgccataatttcagcacctgctgatggaaaggtggactcactggtcatggggagtacagtaaaattaggagagtagatagaatcctgaagcatttgagctgcaaaatcatagtaacaacagctcttaatatcctataattgaaaaagagattgccattttcaaagacctttcacagtcattctcttaatcaagtctcataataaagatgtcattgggactkagcagcttactcacattctcatttcactgatgaggaaactggagctcagggaggttacatggattctggatgacctacaggtcatggaggtaagagaggaatgggttcctggcaactccttctgagtactaactgttaaagtaagcagagtgtgtgtctaaacttctcatgggctactgtgaggagtaaggggtaactgcaagttagaaggcatgatgcccaagattgtccttactctgacacccactgcaagtttgaggtggtcctcaaacccatcctcatggctgatatttgctagaaggacttgtggcacttagcagaagctrttgtatttacagttacagtttattacagggaaaggatacaggttaaaattagatcggggaagagacaaatggggcaaagtccaagacaagtaccagatgtgaagcttctattgtcctctacccatgacatcaggacagaatacttttctactatctatgtgtggcagtatgcatggaatattgtcagacagagaaactcacctgagcctctgtgttcagagtatttattgggtcttcgttgcgtaggtgtgattgggtgattgcccacatatttgatctcagcctccaagtcaactgataactgtggtacagtgtccctaccctaagcaatattgttggtcctttaagaatggttcatctgcaacctaaggttacatgggtgtagttaggccccaccctaaatcacattaagagtctccagagtatgatcagaggtgcccaagcaaacaaagactctttttttcaggaatatattctgcatatatttcagtgatttttttttttttttgagacagtctctcattctgtcgctcaggctggagtgcagtggcrtgaccttggctcactgcaatttctacctcccgggttcaagcrattctcgtgcctcagcctcctgagtcactgggattacaggcatgcacaacaacacccagctaatttttgtatttttagtagagacagggtttcaccatgttgcccaggctgctctcgagctcctgaccttaggtgatcccctcaccttggcctcccaaagtgctgggattacaggcgtgagccacgaccaccagcctcagtgaatgttttttaatttggaaaggattttmtaagaaaggattccaactttcccatttacagagaaggaagctgaggctcacaggtttcactcaaaccataaagctcaggagtaactaaaggaactggagcttgggggtcccagtcctgggcaccattgctaagtaatgtggcctattttcaataagggcttattaatcatactaaaaataagaacttaaaactaaatttttatttgcctagaaatctaacatctttagataaaaatattccatattcaggaggcataattctttctcttttctttttttcttttttttttttttgagacagagttttgctcttattgcccaggctggagtgcaatggcgcaatgttggtccacctcaacctctgcctcttgggttcaagtgattctcctgcctcagccttgcgagtagctgggattgcagggatgtgccaccatgccaggctaattttgtatttttagtagagacggggtttctccatgttggtcaggctggtctcaaactgccaacctcaggtgatctgcgtaactcggcctcccaaagcactgggattacaggcttgagccactgtgcccggccatctttctttttcttcctctccttctaccttgcccaccatggcttaatttcaccagaatatcatcattatcaacatcattatttctagttcagatcattctaaaaatagagcagtcattttcttctatataagtcccaggtccagcctgctattttttgagcctacctttcctaatatctagtttatattttgttttgttctttcttgggattgggagtcagaatatcaactttttcagaaaagagctttggaaattctacatacataatatatataaattttccattcatagtgtgttagcagctttttctacaaatctcttggcgggtggggggatatttcactcttctatgaatcaaataatatatggctttttcctattggaaaaaattagtcgtgtgaactttattcttcaagaaaaagtagtttttatctgccttggaaatgtcaaaaggattcacragtttcacaagtgatgatctgggttgattgctaggaactgtttttagttagtttttttttttttttttttttttcagacggagtcttgctctgttgcccaggctggagtgcagtggcgcgatctcggttcactgcaacctccgcctcctgggttcatgccattctcctgcctcagcctcccgagcagctgggagtacaggtgcccgccaccacgcctggctaattttttgttttattttgttttgttttttttagtagagacggggtttcaccgtgttagccaaggatggttttgatatcctgatttcgtgattccacccaccttggcctcccaaagtgctgggattacagacatgagccgctgtgcccggctgctaggaactattaatccatagacaaggctctggttagagaagcagaaagaaggctgggtagaccggggaaggtagctgggaggtctctgaagcttggtcttgaagctgtgaattcatagacgtcttggaaaagaactttataatgtggttagacaagttttataagattttaggattaggaaggcttttttagggggtggggttgcttttaaactttgtttgaaaaatggagcttgctgccatcatatcatcatcaaaaatggaacttgtctatccacaaatatttatttaaaagtcagactaatggcagaatggaaagaatcccagctttggagttaaaatatctcacttaaaacttgtcttcgctgcaggctacttggttgtacttgagtaatttactcaagattctcttcagcccagtttccttatctgtaaaatccttccactgttgttaggaggatargaaagccagtattggtaaaaacatatatcagagtccttttgactgtttagaaagtgttaatttactccacgattatccattcaacatttattagttggcttctgtgtgggwgagtaaccattaataccttgamtaagtttataatctggtcattctgtagagcttcctatatgatgtcttctgtttaagtatttctgtaataccttatagacatctcttttagactactagtgattgttggtgtcaacatatgtgtgaaaatgcatatatcctttattaggctctagcacacagtgtgctctcaatgtttgtcttttcaaataaacatacttggccaggcctggaggttcatgcttgtaattccagcactttggggggccaaggcgggaggatcagttgagctcaggcgttcaagaccagcctgggcaacatggcaaaaccctgtctctacaaaaaataaaaaagttagccaggcatggtggtgtgtgcctgtagtcccagttactggggaggctgagatgggatgattggttgagcctgggaggtcgaggctgcagtgagcaatgatattgccactgcactccagactgcatgagaacgtaaaaccctgacttaaaacaaaaacaaaaagaaaacgtgctcattggctaagcctggtagaagccacatgaccaaggctgatcattgctgccactgggtggcagcatactgggattgaggaaaataacccctcaactgcccggatgataaacacagagttctaaaatggcaacaaagggagatccacccttctcagttattgtttgaaaggacagctctcaggcaaaatatgtccacgaagttccatggaataattaccttccttggtgttaaaaaatgccctcacatttcaaacatgtcctgctttaagttcccagcgtcttaaccaggaactcgcttatgtgtgttgttttctgcttctttccactagggagctattgctgtaaaacagaaggggtagtattacagggaggagatgcacattttaaaatatatttctgcttcgtcaaactgtacagaactcttttcctcaatgagaaccaggtttttgcatgtatcttttgccaagatttgagaagggaagtctccaccttccagagctttggtcatattttgtttctctctaagggtgaagatgctgtttgttcttgcagggtgaggctttggccaataagaaagcagtgctcagaggtaaagagcctcgctgaagccctagttctagcctaccaggatttggtcatttcttggtttttcatttgatcccacccttgcctmccttcagaatgaaggtagaatgtgggactgtttcagaccatgaatgcgattgggcagaaagactgtgaaccaagagggcagggagaagggaagggatgtggggagagctaagtgtaaattgtagagtctatgaacaattctggagacagacaggacaggtaaggagaaactgctgctcttggtagaggtttacagccaattgtagaaccctaagaaaatacagcactttgggagtggatggacccaaaatgggtggatcatttgagcccaggagtttgagaccagcctgggtaacatggcaaaaccttacctctcaaaaatttacaagcttagccaggcatggtggtgcccacttgtggtttyagctacctgggaggctaaagtgggaggatatcctgagcccaggaggtggagattgcagtgagccatgctcgtgccattgcatttcagcgtgggtgacagtgagaccctatctcaaaaaaaaaaaaaaaagttcctaagaaaataaagcctggcccatgcaatttgaaygtaactgtctataatttctcttggttactgaaattctgagtttgtgtctatggtttctccatccttgtctttgaggaggagcaggatggcgaagtcgcagccatttaaaaacttgttttcagtcattttgcagaaagcagacgtacacttctttgctgttggtctgtgatgcgggagtggtttgtcagttctttcattcaacaagtgctgatctttgggcagcatacactggtatgacctttatcatttgttcaggtgttgtggagaaagttgtttgcttttgaaagacttgatggagaaaagtctttctacatttctagaaagaccatgggtgtgagtattgagagctgagtgccagtttgtttttttgtttttgttttcgttttttgagaaggggtctcactctgtcacccaggctggagtacattggtgcgatgaaggcttactgcagcctctacttcctgggctcaagtgatcctcccacctcagcttcctaagtagctgggagcacaggcaccagcaatgacacctgcctaattttgtattktctgtagagatggggttttggcatgtttcccaggctggttttaaactcttgagctcaagccatccacccgccttggcctcccaaattgctggaattataggcatgagccaccatgccctgcccaggcaccattcttgactgcgagaaagtcactgtgatggtttctccagcctgagttttctcctgtatraaatggaccttgttttgaggagagaatgaggtatgtggtactcgtgagcaggattttcaatgcctggctggttgttacttatccatttagtccgagcttcagggaaagaacatgacaccggcstccagcagagcctgctcttggtcyactgtttatcctggtgaccttaggcaagtcatttaatttccttgagttttggtgtaagtattgatggagcagaccatcaataactgttcttatgtctrttattaccatgtgtctgtctacatgtttgtttgtaaattctctgtgggtaaaagttctcttttcatccccttgcctcagcacggagcccagagccagactgcaggtaggcactcaatagatatttgataaatggatgttagtcatttgatttctgaagttgcgtaggtaccagcactacaaccctatgtagttcacataactatttgcagttgtattttcctttaaatctaaattggagagaaggaaggtaattaaggcataattatcagacttaatcaagcacttatttattgagcttacttggtgcctgggcttgtatcttttgtttctgatttttagtttcgtttcattgctccagcgtgggggaatttgcctgtgtatccttgaataaatgtctttctttggaaggcagattaagtagggatttctcttactgtttatttttgtttctaactgaagttcaatgaattattcttttacccagacacttacatattcctagccattccttttgcttaagtttgcagagatttgtgcttaaaactgaataaacaatctcagggtttgtgtgtgtgtgtggatgtgtgtgtgcgtgttatatgaagtcttgctagaatgcataaacaaacaaaaaaaatatcatactctcagatcctggatactgtggtcrcctggacttcaaaagccttttgyccgtatgtatttacataatgtattctccatgtttggttttcattaaacccatgagtttaataataaagtgtttggaactatgcttttccctaccacttttctttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatctgcccgcctcggcctcccaaagtgctgggattacaggcgtgagccaccgcgcccggccccacttttcttgttgtgaatattttttccccttctgaagtgaatactgatttttcgttacagatatttgatgctttgggggcctgttaaaatagttgtaaatacactttctaaatagatgaaatgtaagaaattctgagaaggggtttctttgacttactggaaaaaaaaataataggaaagaaaatgtgatcagttggtatatttggctctctttcatcaacacttttatggacctgcattgcagtgtttctgtgatgtgtataaaacacagtttcagtgatcgtgcaagcctcagttttagaagataaaaagatatgaacttgaacccaagcttctctgtcaagagaattataatgtgttttgactgtaggcttccttcgagttaaatttacagtattttcccctaacaataacaacaaccagaagtgcccctttaagttgagatgcttgttaaactttacatgtatgcatgcatataaatgtacatttctgtatatataatatacgttcacatatagttacattagatttttaaagaatttcctttttgccttcaaatcattgcacagaacatccaagtagacatcatgtcaaaataatcaaaatgtatttaacgctctctcaagaaatccatttaagaataagaacacggtttgggggtgattttcagaccgtaaattgaagtgtaaatattcgaattatyttcataaactcttcagttctgttgggcttttatgttatcatacagtgatttttttttttgtatttaagttttctagcagttctcttttttaagagcctcaagtgtccaataaaaagcaaatacttgaattttcagtttctatatagtgcatattttttctcctgcttgccttatttttataacagtgatttataaagacattactaaagaataggaaagaaggattttgaagaggaactgctatataacactgcttaaaaatctatttccaatgctaaggagaggaaaaaaaaatactggcaccgtatccgagtgggatctgggatccgagtgagatggccataccttcagtcattctcctccccaaatatttattgagcctggtggacaaggagggcgggataagattgccaggccctgcttctatttctggggttgggatggcgactaaagacccgcgtggactgcatgctgcagccagctcaggaaagatttcaggaagagcgtttaggaaggcagctttgaaaagaaaatggaaagatgaggttgcagagggtcagtccawggtgaccagaatctgacctggggcaatgccataaatccaagaaagactgggtttcaggtgcaggaaatgcgattgtgcacggacccttgcctttttaccmagtatctagcccatccttctttcttagaagcagaattttctaagaggtacacggtagttcaggataaaaattccctgtgctaactgcccttgcagctagctctctgtgaccgtgtgaccatgtgacccagttctagcgaatggggtggcagggaagtcccacatggacttcttgggcgtgtccttaggggaagcatagcttcttgccttcttcacactcctccttcccttcctgccgtctgggatgtggggtctggcagagaaacaatattgtgaatggaaatgggaggaacttgggtcctgaaaattacaccataccccagagcctggggtggattatttcaggacctttcttccttccttccttccttccttccttccttccttccttccttccttccttccttcctttctctctttctttttttattttttttttcagacagggtctcctccacacccagactggagtgcagtggcacattcatggctcactgcagcctcaacctcctgggctcaggcgatcctcacaccttagcctcctgagtagctgggactacaggtgtgcaccaccacacccagctagctaatttttttttttttttttttttctgtagagacggggtttcaccatgttgcccaggctggtcttgaactcctagcctcaagtgatccgccagcctcagcctcccaaagtgctgggatcacaggcataggctgctgcaccaggcaaggactttttttttttttttttaaacaaacttcactcagtttgaaggcaccattatttgggtttcctgttaattgcagttaatcctattgagtaaatgtatcaaggacaaagagcagaatgaaaaaatgagtgagtaaagttgagcagaagaactcactgaaaagtcctggcaaggttccacggcacctgtgatgcttccatcacacatatttgctgagtacccgctgttcataggtcagtcrctatgcaaggcactgaggtgacaaagacaagsagaatgacagttaaatgtaacatgggctttgtggtcaattagttctgggttcgttcccaggtcctatcactaactagtacccttatgaacctggacatgtcactagcagcctcagtttcctcatccataagatggggatagcaatatctatctcctacacctgatgtgagtatcacatgagaaatgcacatgaaatgttttacttagtgatgagcatatggtaaataagaatttaatagattttagtgaaagcaaaataaaaggtcctatcattgtccttaaggagcttacgaaaacagagctatacgcacatccgtagacagttaccacactcaggaatagtggaaaactgacaagaccctggagatgctgtgtggggagggataatgggaacgcaggtcagcatgctctaggaatggtaagagaractcccaatctgaacggtagtcaaagaaggtcttcttctctttggagactgaaaggctgagagggtacctgccctgctaaggaaatgaacaggacggaagaatgatggagggagaatgggaagtcctcagcacataaaagtttgagctggaaatgaaatatacaactctgcatagtcagcrgattttgctgggctgggccagttcagctcagcaaggattgctgggcatgtgcttgaaggagaaaggtgaggatacaaaggcaatgagtacatgatccttgaccttgagaaacctatagtctaatagaggaggcacatataaaagtaattaggtaaaatatagtgcagaatatgcagtcatggagtcatctacagatctgcctggaatacagagggacaagtgtttagtattttccaactgttcacagaggacaagacacttgggcagaagtttgaaggcaattccaggttagcagtacccacttgatatggtttagctgtgtctccacccaagtctcatcttgaactttagctcccataatccccacgccacatgggagggatttgaatcgtgggaggtaattggatcatgggggtgggtctttcccatgctgttgttatgatagtgaataagtcccatgagatctgatggttttataaagggcagttcccctgcacaaactctcttgcctgctgccatttaagacatgtgtttgctccacattggccttctgccgtgattgtgagactttcccagccatgtggaactgtgagtccgttaaacctctttcctttataaattactcagtctcaggtwtgtctttattagcagcatgagaacaaactaatacaccacttgaattgctggtacgtctgaggggcttgactcccagtccttcgaacatggaggggtagcyctttttctaagctcctcataaagtattgtatccaattcttcagaagggatgaaggtatctggtcctgtccgcaaacagagaagtgcttcttrtactgaccaggcagtgacctaacgcagtccttgagacaattccaggtgcccctcaggccgtttttccaccctggtgtttttctttgtatagacagcctatgcctggataagaacatgctgcgtcagasagttctttttcactttgcccctcaaaatgtgcacaccgacagccacagatagatcccagatgtctttttcctgmtcttgcaaaccttgaagtgggccctgccggcaggcacacctgccaaggaaaatgctgtcctcgaaatgttcctggcaccgttttcaagaggtgccgaccaagcgctggaattgctgacctccctgaaagagaagcctgcagctgcggcctctggggtgaattccccccatgggaggacctggtggagttaaaacagackatatccacatcacagagagctggcccattgctcagggcctgggaagtggtagggagggaccttcccagaagagagatgactcaggctggtcccaagcccctcctgtagaacaaacagacaaggtgaggagcaaggaggcatttggaggtcatctggcccagcacccttgtctggaagacagatttaagttccataaagtcacttaggaggagaacatagtccaggttgaaccttgctgcctgccctctggttgaaacatcagtgttgaatcaatagaccacgtcctgtccataccttgggaattagactcacccagactctgagttaagagtttctatgagacagagggctggactgggggagcaaggcttgcaaatcgaaagcatcagttgctacccctgagcaccatctcccataggagactctttgaacacttttttaaaaggcaagatgttggcctggcgtggtggctcacgcctgtaatcccagcactttggcaggccaaggcgggtggatcacctaaggtcaggagttcgagaccagcctgaccaacttggcaaaacccagtgtctactaaaaatacaaaaattagctgrgcatggtgtyacatgcatgtagtcccagctactcaggaggctgaggcaggagaactgctcgaacccaggaggctgaggttatgttgagccaagattgtgccactgtactctggcctgggcaacagagggagactccgtctcaagaaacaaacaaacaaaaaaagtcaagatgttgacataacagttctgaagaccaaggtggtggaataggttaggttaggatacgtcggaggagccagtgtgaactgctcctttaagacatgaattagyccattttcatgctgctgataaagacatacccgagactgggcaatttacaaaagaaagaagtttattggacttacagttccatgtggctggggaggcctcacaattacgggggcagacaagagaggagagcttgtgtagggaaactcctgttttttaaaactatctgatctcgtgagacttattcactatcacgagaacagcatgggaaaatcctgcacccrtaattcaattacctcccaccagcttcctcccacgacatttgggaattgtgggagttacaagttgcaattcaacatgagatttgggtggggacacagctaaaccatatcaaaacataactatagctgggtgaagtggctcgcacctgtaatcccagtgctttgggaggccaaggtgggagaattacttgaggccaggagtttggggctagccgaggcaacacatagagacaccgtctctcaaaaaaatttaaagaaacttagccggggccgggcacggtggctcatgctggtaatcccagcactttcggaggcctaggtgggcagatcacaaggtcaggagatggagaccatcctggctaacrtggtgaaaccccgtctctactaaaaatasaaaaagaaattagcctgacatggtggcacatccctgtaatcccagctactcgggaggctgaggcaggagaatggcgtgaacccaggaggcggatcttgcagtgagccgagatcgcaccactgcactctagcctgggcgacagagcaagtctccgtctcaaaaaaaaaaaaaagaagaaacttagccaggtgtggtggtgcatacctgtagtcctagctacttggaaggctaaagcaggaggatcacttgagtccaggaggtcaaggctgcagtgaactgtgatcacgccactgcactgcagcctgggcaacagtgcgaaaccctgtatcaaaaaaaaaaaaaaaaaaaaaaagaaacacaacttaccaaaccaagaaacttacagagaacatgattagaagctagcatctgtttttaccctaccctcttcccctatgacccaccaccacgcaggccttgctaatgtggggtctttgtggaggatcttcaggatcttcagtgccagaacccagcatttaaactcttatttgacagtggggccacagcagatttaaaaggacaatgacatgataaaaaatgtgttcctgagagatttaaatgcaggcctatagagagcagatgttaaaagagaagaagcagactgggcatggtggctcgcatctataatcgcagcactttgggaggccaaggcgggtgcatcacttgagcccaggagtttgagaccagcctgagcaacatggtgaaaccccatctctacaaagaatacaaacattagacacttttcaaaagaagacatttatgcagccaacagacacatgaaaaaatgctcatcatcactggccctcagagacatgcaaatcaaaaccacaatgagataccatctcacaccagttagaatggtgatcattaaaaagtcaggaaaaaacaggtcctggagaggatgtagagaaataggaacacttttacactgttggtgggactgtaaaccagttcaaccattgtggaagacattgtggcgattcctcaaggatctagaactagaaataccatttgacccagccatcccattactgggtatatacccaaaggattatatatcatgctgctataaagacacatgcacatgtatgtttattgcggcactattcacaatagcaaagacttggaaccaactcagatgttcatcaatgatagactggattaagaaaatgtggcacatatacaccatggaatactacacagccataaaaaaaggatgagttcatgtctcttgtagggacatggatgaagctggaaaccatcattctcagcaaactatcacaaggacaaaaaaaccaaacactgcatgttctcactaataggtgggaattgaacaatgagaacacttggacacaggaaggggaacatcacacaccggggcctgtcgtggggtggggggaggggagaaggatagcattaggagatatatctaatgtaaatgacgagttaatgggtgcagcacaccgacatggcacatgtatacttatgtaacaaagctgcacattgtgcacatgtaccctagaacttaaagtataaaaaaaaaaattagctgggcgtgatggcacctgcctgtaccccagctacttgggaggctgaagtgggaggatcacttcagctcaggtggtagaggctgcagtgagctcacatcacaccactgcacttcggcctgggtgacagagtgagaccctgtctcaaaataaaataaaataaaataagcagcagcagcagcagctaggttccaaaaaaaaagttggaagggtgtgatgggattttagttgctggatgctgaagttctgccaacacagtgggtttggagagtaggagtgaaagagtggagactggccataagttgggagggtaagtaaytggttgtgattgaaaggaaagaaggaggtaatgatgagttttggtctgggaaccggagaatggtggtccatggacagaaatagagaaggcaagatgagaagatgcaataggcaaaggcagtgagtttaatggttgacttttggtatttgctgtgtatgccctctgtacctttgacctgggccttcaacccttggacagagcttaagatggctgcgtcccaagtggtccatcccaagcgagttttccctggacttatctggaatgactctgaaccttttgaagaccccaaaactaacccaagctttgcatgatctccccaggatgggtaagacttcttactctctagagctcttttctctgtaggcttagctactcagtgaataaataggtacataagtgcttgctagcaagcagctgaggcaacctattaaaactcatgccagtggtaaagttaagctgctttctggtaagaatttcasaattccaggacgtctcaaatttctggctggtacaccytgggyaaggtccacaggctggatgggttttggaacatgtcttgattgtactttttcctcttggtttggaaagcaacrtaccctaggtaaggagagatttctgacaacagctcagcaatcacagtttccagaaaatggctccagtggatcaactatgagttaagtaaaaaaaaagtcagtgctaccgtttgaagtatgtctagagtatggttttaatccatcgctgtcaggctcacataaaattccaggcttctgtaactctttaacttgaagtattacagggtgtcacctgctaaatggaagccaagagaagcaaggagtttttcatggttaaatcttgtaaagatgctttttaaagcatattaatccattagtaatccatttggatttgggaatacggtcatatactgtttggtacaatatgtactaaacctggtcctggaaaattaagtggaaatataggtttaaactactggaacttcaaaatagcttctcagtaattccttctcagcaatcattccaattcctagatttaaaaaaatgttgatatatcaaatttccatcaagaggaacatacatatggatttttggagaggggagcagagcagaagagaaaactttcaacttttaatagtatttcaaatttacctgaaagtgacccaaataatacaagcaactgtttaccctgattctccaatacacctgcatctttaattatgctaatttgatacaggtgtcagattatgcattaacaaagacatcctttttctttgagtatgtgttttctatggttatgtaaattatggaggtgctaaacatacctttagagaactttgtatttgtattaactttttttttttttttttttttttaatagcgatggggtttcactgtgttgcccaggctggtctcaaactcctgagttcaagtgatctgccttgcttggcttcccaaagtgctgcgattacaggcatctgccaccgtgcccagctatagagcttcatttatttatttatttatttatttatttatttatttatgagacaaggtctcactctgtctcccaggctggagtgtagtggcatgacctcggcttactgcaacctccgcctcctgggttgaagcgattctcctgcctcagcctcctgagtagctgggactacaggcacatgccaccatgcctggctaacttttgtttctttttaaatagaggtctgtttttactatgttggccaggctggtctggaactcctgaggtcaagcaatctacctgcttctctctcccaaagtgttgggattacaggtgtgtgccaccatgtgtggctatagaactttttaatgtgccaaggtctgtgttcagtgttttcttattcctcatctgacttagttctcaaagtccttgcctaaggtattgctgtcctcaccgtcctatggggagataggtcactttcccaagtctgggcagccagcagcagggctaagatcaccactcagaccctgtgwttttatttttcatctcctcacatctggcgctgaatgtcaggaccttcctggcctctgggaaagacacaggatggctgttttgagaggagtgtgaaatacatgaaggcaggacttccacacacctggacgtgaactagaggtgaggtggggaaagacaggaagtagatcagtgttgcccagaccctaccttttccaactagggtgtggaccatccttcagagcttggcctccaagttggaacccgtgtataccactgacagtgtttcctgggatggtgatatttatcaagtgcagaggcccagacacagagagcttgaggacctttgtgtgagacagtgaaaccctcaaaggcaagggctctgtttcatgagttttctatctcctgctgctgtctcggtgggcctgtttgagttgacctgtcccgtcggtattagcaactggcaacagtgggtttttgttaaatacggcaaatattaagagtcgtctctgggcattttagtttattcattcatttgttcatttattccacagggatttattrtgcatttactgtgtactaactaatggggagatagcaatgaaggcagactaagtgtctttgttctagtgcagccatatagtcagtgaatgaatgagtgagcaagatacaggagagaagtgaggtatggcccattataccagataaagtgatagagaggggctggcgaggagagcagtctaatttcaggaaagtcagaaaagtctttaaggaaactgaaggctgagctgccagggccagccacrtgggtactggagagtgggaggcccagtcasggggaatgctggcttagcacaactgaaaaatacaaaggtagaatatgaagtgtaatgacatggtttagattgaaatctgatgtggatggaaaggttttgtggcctttcagcccaaggtttgaaaaagaaatggaatttctaaatggagtgggyagccacaggagggctttagacaggacmgtggccccgctggattttctgcccattgacttgggctcgaagtcacgtccatgttgctattacagatgcctcccagaacagtttatataatcrtcaacgtatattcatggagcatcttctgtctgctagacacagaattgggtgttgggctttaaagatggatgaaaggcagtacctggtctagagaggctgctacctggatggtgtgtttgccatcctcagtartgtgtgtcccttacagatgatgcccartgactctacaattgctgggatactttttagaattttctttttgtgcattacttttgattcttggttctttctttggcattagctcaccagtggcaaatatgtatcctttaagggtggacttaattttttgagaaatggccaaaagtttgtttcaagtctagtctgatgaataaagcaggagatttatttttggcaaaagtggcaaataaagagggctgatttttgtatatggctactgaaatggcttagaatgccattttatcacatggtcaaattattcaatgatcaaatatcgaattattaaaaattatcaaaaggaagttccctgaaacatgaaagtgtttgggctttgtaggtacccaagtctactgggaaaaatccccatttctgggtaacccagccccttttaatgacaacttcagttctccaaattccacttccccttttagcctgcctcccttccgtcatccttcatcaaggtgacataggtctggcgatctttttggcatagacgtgtggacgttgtttttgacatttgtacatgcttttgctcaagttgaaggccsaagtttacccaattcractgcccccacccagatagaatattcatggttagaccataaactacataactggaaattttaaatctatttttatatgcatacaaaaactgcaggcctgaagcttctaaaaataaacgttactttcatcccattatasaaaaatgcatttgaggtggtcatcattttatttgggccagggtcttccgagacttgggacaataatatattttttctactttaggcaaatgtatgcagattcttaaagcatgaatgctgtattacacacattataaattcgagtaacagaaatgtttgtgtgtagaaatagaatacggagtatatattttgtatwaaataacctctgtggtatttgtttaccctgattttttgatttatgagtcgtcattgctcgctatagaagaagaaaaataaatatgcaaaacagtggtagatttttaatggggttacttcccatcttagctcagtgtttctctaccaaagctgaccttgaaattgctttttagatacaagtcaaaatatgcaaattccagaatcaggaggagtatccggtgttaggagttctttcgaagtcacatttttacatcatttccatcgacatcccgtgttccatctgcttcttaatccattagtacctgagtgggggtatataggttttctcaaatgctctaatctccacagaagttaaaatatccctaaacaggcatgtgcayatatgtctttctttcttttcttaggttaacttttttttttttttttccttttgaatgaccacaaagcatatctacccagcggggttactttttttttccytttcagtattcatgacgtcaagtccctgtttgttatcttattgtcctcttatcctggtccttagagtctttcaagagaagaggttgatcccggtgtaatgtacagcttcattctaataagttgtatcgatcatgtattttcagtcactcttcatgtctatgctgtccatttgcttggatcccaaggaattttcttctgcccccccaccccatcccactcatatttcataagggtcttctggaacctgcatggtgttgggatgtatatatcacttttcccttgttatgaccagaaagactcacagccatgaatttcactgaagtttatgattggtccctgattgcctcacatcttgcaaagaatcctcttctagaaagcgttcttgcagttagattaacaagcagatatactgaactggtgcatgaatgaataggaaatatcccagttgcaaaggataaatctatcatgtagtggagagcgtgttcaggcaaaacatttggttctgcggtcgcttggaggattgggcccgtgctataattaatgccactagcagtaaaaggacattagggatgtcgcgcatgttgattatttcttcattttgtttatccaagtttccccgccttggaagctccgtggccattgccaaagaaagccctggagacagagcgttagccgttgctcctcgtaagcgcatcattaccttcctccgaacaaagtcctttttttttttttgtcagtagagggtgaaaacattattggattcaggagttcatagtagtcctgtatgaagctggggacggggggatagagttatgaaatggaccatttcaaatggcattatcttcccacagtgaggtacacctttcataaatcataggagagtgctcagaaaatagagcatttgttattcctgcagtacattgtatttgcatcccccctactcacaggaaagaagaaattctcaggtttcctttcccaggtttgaaaaggcagttaatcgccttacaatgaaattatatttttaaaaaaggtatcataatcaaataaaagaagtacttcatgtaagtcaaggattgtgcttttactactattttttctttttttgtaatcatggtggttctttttgcccacttatttaggccttaatttaattacggcgctgattaagttctttggttttattttttactgtaaacattgtgctgtattccgtaggaaaatgtagatgaatgtgggtcattgggaaataaagtgggtggaagtattggcgagcatttctttcccactctctacctcgcctggtctagccgctgataggtagttactctttagtatgcccaagttcaaattacgtatgactgtgattctaacacggaagcgccctccttttctagtagcttggatgtgattggtatggagaagcagagtgggtgcgtctttgtgtgttcttgacatagttaaagagtttggtatagtcaattccctttaaagtagtaggcttcttaaataattctagttgttcctcgtgctgccaagccatcttgaagaatttttcttcatttgtaaggggttaaaagtcatcaagctgattgaaaagtcaagaacctctagcgcagcctaccccttgcatatttgatactctcttttgcactctcgggagcagttttgaggacacactgtaaaaatgtatgacagcagtttgaagataagtctgttgccccaaataatcataagaagaagacagaagaaaaattgattcccgtagctctctgggcagtgggatgggggtaaagcaaggaattaataaaaacccaccagaatacattatttcagacaatcaaggagagcgttacattttaaaggtacttcatctcagaaagtttgagacatacttttcacacgtggcatgaagagaaaatggaatggaatgagcactaatgaggaccttgaacttaactaactgaacttgatggtcatcgcaagacataggggagaaatattttgagacatcattgtgcaggcaaacatgagcaagaaattgagaaatccgttcatgcacttctctctggtttcccggaagggatgaattccaaatcccgtggctcaggtcctaggtcaaagacagctctttagaaagagatgttctttgcttctttgctgactgcccatcccctcctctctctcaaggaaataagatattcatttgcaagtaaataatgcagcagtcttggatttgtatcagatcaactttgaatgaaagcctgcctttctgcgtttatttttgcttatctctcctgcttctgcttcctgttttgttaaataagggcaatgacggcaactattttaaattgctataaagttttagctagacagcgaatcaaggtggcaacacatggtgggttcttaaataatagttgtcatttgagtgctttctatatgatgtacatttcattttgcactttacaaataacctcttcctttttctgtttaatcttaaaaaagatcccgggaggcaggcgttattgtgcccatttcctggataaggagaatgaggtacgctaaacgagtaaaaagcaacccgagatccaaaccctttggcattcaagattacactcttattcactaactgttcatctcctccgactgcatcgccactcccccaggccagataacccatccagacctggagaactcctagagggagaaacagggaggacccaggcacataaacttgcagagcagctgagttatcagatcttccaagccatggggttatcgagctttatcagagcagccttgctcttgcagtttctgacacatcaccattgatcagtcctgggaaacaaacaaaatagagggcgatggctccactctgtgtggccccgtcaatggcctggacgcagctgaaaaaatccagaagagtgtaggacactggaaaagtagcagggtgtgcgattgcagggatgggaccagcagtaaaaggtagccctgccaagaccattaagcttcctgcaactccttctggatcccacaatttgaaggggaaatctttcccaccgcacatcactgtttggtggactaaatggctccccgatgtcccgaaagagcacagcttctggaagtgtggtatgtggtccctgagatgaagcagcagccacaggaacccatcattcctgctacccaaggcctccattgcctggttttctgttgtcagaagagttcattttcaggtccttcaccagatattttagaagctcatcaaggaaaggacgtttgaagaaaaacaaataaacaaaaacacaaaatcaaggacgtattgatttctgagaattcctcctgggttttgtttgtttgtttgtttgggggttttttgctgtggtattgtctgagcctatgataagattgttgttgattgatttttgtctttcaagactcagcacaacacatcccatccttctggataatctcttctaccctccctttccagataaaagttgactctcataattgtaactctcccctactttatcagcatctacatctttcagcctctaccacattgaattggaattatatgtctgttttatgtaccatgctgtgaactccttgaagataggagctgtcttatcttcaaggtgctcaagacacgtttgttgcatcagttgaatggagtcaaattataaacaggtgatgggggcaaatatcacaatatgatactctgaacatcttctctgacaaaaactggtcctcaagatacaacaacatttatatttgatttgtcttgctgtatcgaatcaagctgtggtcttgagtttcgtacacatctatgtaagcactctgaattgagtgactctttcccaaagatcatactgggatctttggaatgaatggcgggtcacccatccaattgcttttgcggagattcgagcatgtggggaatgcaagtcacaatatcctgcaaaagccaacttgagacctcctaggactgcactgctgcttatgacactgatccttagcccatctaagtaagtgagcatggccctgtaagtgaaattggagaggttccttgacattcccacatagctgcttccctggtaattcacctgggtccagaacacagaagggagattctaattgaaaaacttttcctaaaggccaggcacagtggctcacacctgtaatcccagcactttcagaggccgaggcagggagatcacttgagatcaggagttcaagaccagcctgagcaacatggtgaaaccccatctctacaaaaaatatagaacattagctgggcatggtggcgtacacctgtagtcgcaggtacttgggaggctgaggtaaggggattgctggagcctgggatatcaaggctacagtgagccgagaccgcacctctggagtccaccctgggtgacagagtgacaccctgtgtcaaaaaaagaaaaagaaaaagaaagaaaaagctttgcctgtatatgtagaacaaatgaaaaccaaataacagtggcaccagttcttctttcagtttccatggaatatcaagcacgatttgagttgagcaatttgatttgattgatcttcttaaatgtataatctcaaactttacaataagaaggctacttgtctttataattgtgaaatccacccttagttttaatgcatctaaagtctctgtatcaaaaagatcaaaatcaggtttgaaagtctgtactgtaactaaaaaagttttggggtttgttttgttttgaccaatttttgtaaatctcttctgttactgtttatatacccggccacttctgccaaaatatgctggccttttagtcttttggttttttctctcttttkgtttgttggcttatgttcgctgcttgrtctgactactggttttatttctaaggatttttttttaagttggcatctttttttctttgactttccttgtatgcccccctttctcccctgcattgtcttgcttcattcatttctttccaggttcctgcaaattgtttttatttagggctcatctggtatgtgtattatgttcttggtagacagaagctgtctttagttcgtatgggttgagcatggagggaacttcatctcrtagtcactggataaggagccagtcctggctcttcctttaactgcccttgtgaccttgaacatgtcagttcatctcaccacgtagtcattttctcatccgtctcttcaggctaataatcacctgtcctgccttcctcacaggcttgccgggcaacccaaaagagccgctgatctgcatagcacttcgcaatgaagctgtgctctagaaacataccacgatctactggactttcttaaataaggtggttgttcaggaaattcctcyarttaattttactttaattccccctacaagaatgccgagacacctctgcctattttctctttctgtgtttgttgtttcttttgtttttgttttcgagactgagtcttgctctgtcgcccaggatggagtacagcagtgcaatctcggctcactgcagcctccaactcccggctccagtgattctcctgyctcagtctcccaagtagctgggattacagggatgcgccaccatgcccagctaattttttgtatttttagtagagacggggtttcaccatgttggccaggctggtcttgaactcctgacctsagttgatctgctcacgtcggcctcccagagtgctaggattaaaggtgtgagccaccgtgcctggcctctttctgtttcaaagaaatagtcaagaagtttctagatgcacacaaaatgaccaaaccagtctttccgcttatttacacaatgaagaaacatcasagttcaccctggaagacagagtttctttctgtcttcatcctagggcacaggagagatgcagtgatggcatgtctccactctgcagacatgttgcaggcctggaaaactgtgtggtgcgtctgtttttcagagcgttgagagtcatgcgggccatatggatgcagtggtccacagaattggcagtgagcccccgggggagctcagtgcaagacaagattctggcgtaagaactgcggtagcaaggacaagagggcgtcacggtgtaagaatggccgtggcaaggacaagaggacatcacacgatgaccttctcagagtcagtaggatagtttcccttcctggaagattgagatgaaataaagctttaggagttggtatcgcacgcaggcattaaatggattgtgaasagggactttgttcccsctcagtcttgtctctgcctccgtaaaggagtaagttaaaaaagaaagtttctttttttaaaaaaaagccttactgctcaataaatccctgtggaaaaaaaaaaaagagggggaaaaaggaatgcacattagtcttccattaaaaatagatcaaaaaagtacccaaaagagaaaaccccataacaatgaaataaattaggataatccaactggaggcctgcaaatgagtttgctaaatgttatattttctcaagccacttagatttttaactccctgtttctgcctgaagcaataaaggcaggaacgctgtcattagcttcaaacaccattttttaagcccctagctgcatttgttatttttctcttcccccccttagctgtatccctgcatttattacagcgcaggtgcatcttgcttttgagtgctaactgagatgaaaggagtgagraaacgctctcttcttcttgcaggggagggctggcaaattcagygaatgcagagtcggctgggagcctttcggctggaaagctcttcctctgatgagctgtctgttacagattttcagggatggcccttgataaggcaggggtgtctgtccacgccacactgtggtcagataacccccgatcgtaataagccggaggataatcgcttgcattgttcaataaagcaattgctttgtcccctcacttagccccttcagaaaagccaraaagaatgtgccacctagatgctatttataaccattttcacctcttgcctccaggggctaaattggaaacctaattttagatgcataaaagccaaaatatgtataggagaagctccaaaataaaatatcccagagtggcttgtaagcatccttccaacaggttcaggttgatttaccttgctgtggatatttaattatgtcattgaaaaaaacaccagtaattaaatcattatttcttagatgtgaggtccaaggacattctagaggaagtcaaaggcagagggaggaaggrtgggacgatggaggcctgaagggctggtggagaggaaagaaggcagcctgtgccgtcagagagagttcaactccatccgtgcagctgctagcatcttgccttactcagcctctgtgaaccttaagttgctcagaatgagacaggtaacacctgcctccgtggtttgtcaggacatttagaaatgcagacttgctcaagacctggatctcaggtggtaggttggtccacagacagtggcaccactmgctattatttatttgttgtcactgtttgggacccctgttgctgtctcaccaaagaacttcttgtctcccttttagaagtttccagagcgtcttcctgatgttgcatagagcactcacacctaacagatctcagaacttgtatcttttctgggtggctagactgaaaaatccattttcttatgagtgagccagaggtctgtctcttgcggcatttctgcttttgagaacctcccgtttcctgaaaggcaccagaccccaagacagctctgctgcctgattggtagatgcccatgacagctctgcttcatgcctgctgcctcctcatccctctggatgccttgtggtcctgcttgtctgaagagcataaacttgggggttcccactcgaaaagaggttccagcagttccagcccctatgtcaggggagccacttttggggctggtggtaggcagaactttggccctcgacatctcctctgttggcattactcctatggtggtgttacgtaacatgacaaaagggaccttgcagatgtaattaaggtaactaatcagctgactttagaataggaaggttatcctgggtgattagcatggatcagagttctcacaggagcccttcaaagcagaaggggaaggtggacaagagaatcggagagatgtggcrgagggtaggcagagagattgcaagcagggaaggatttcacgtactgccactggctttgaagatggagggggcacatggctagaaatatgggcggccctcagaagctaagaactagctctttctgacagccagaaggaaatagggaccttccacctacaatagcatggaaaacggggacctcagttctgcaactgcatggagctgaattctgccaataacctgaataggtttggcagcagattctttcctggagcctccaaagaagagcccaggctggctgacaccttgtgagtggccttgtgagacctgaaacaggaaacccacctgagccactctttgcctgggacttccaacccacagcaactgtgccgtcgtgactagatacgtttttttaaggggatgataatttgctgtggcagcaatagaaaatctgatacactgtcatggggccttccacagggtggggctcaaccagccctcagctcatctagcatgtttcctcctacaacctggactttttcctgttgtcccctcccgtgacactcagctccctgcattcaatagaattgcttttgtgggatgatgagtgtgttcagagtcatactcagcctaattattgcttttgaccaaccccaacacataatgctgtatgtcatgctgtactacttttaatttcacagatgaacacatttctgttcttttaatccacctctccaaggctcgtgttaactccatctggacaaagccttgaggtatacgtgtggcttcttttgagcatcgtgccatagctgtccctgatctaccttgcggggcaawcacaacaagtaaaaggttttcctcttgaaggattgaacgcctcaatgcgtgcatcctacattgtctagtgggagaaatctccgttgtagattctgacatgtcactccacatctttgtaactttttatggctctcagccctactttcttaatagtagcagcagtatttatctactgtttattgtattccaggtaaaggatatgygaagcacttttcatgcattatttaacctagctataatactcccatttgacagatgagaggactgaggcttgtagactttccaaggctgtgcagctctaggtctagtctgccatttgaatttgggcgatgataccagagaccaagttctcaactatgatatactgcacatgtttttgtttttgtattttggttcaaaaagagagtatgatctcacttttcccttcttgataggttgtagattccatgtctaatccatscttttccaatattccctcctaatctttcagttgaattayggtctttagctcaaatgcrtgacatgatgtgtgtgcctttggagtggggcggtattagtcagtcgatggttatttccttgaggaraaaggaaaggagaagttgagtacttttcagtgtttgttactacaaaagcatggtggcatgccattgttctgagaggaaggggsttttttgccttgtcagctcctgatgaaaaagatgttgggttggaaagctaagttacagcaggtgaacttgaatttgaggaaagacaaagcaaaccctggctattaaaggaacacacacacacacatacacacacacacacacacacmcgtttctggtattaggaaatggagatttctaacataataaaaaagattgaacttaaaaatgacttccattaaatagggtaagaattttgaggtggaatcctttttccttgggtcagtactttctgcaagcttctaagtaatggtttctcttagacactcacggtgataaaattgggagttttcaaatgaaatctggaatgatctactggcatcatgcctaggactttggaaaacttgaaggttggcacctttggggaaaaccagacttttgaagcaggggctctgattgtctcttcttattatagtgcaaggtgtttggcagaggtgtggtagctgaaggcccaaggataacattgtccagattttcagtctttggagccataaacatccagttctttccagccccgctcaaccgcctctcttaattcaccaccctgttagcttcatctcaggccagacattgtaggtggcagcaattgtaggacaatgagaagaggccagatgaggacagaatttttattttccattgccagtaacaaacacagccctaacttgcttagaccaaagatggggattgaytggcaactgggaagcctaagggtggatctggcrtggctggatctaagtgattaaatggcgcggtcataattctatttctctgcatctctcagctgtacttccatctctgtaaacttcatttgcagacatggccagcatgcgcccatagccttaatgctcagggaatattggtgggagagaaagctcctttcctatagcttcagcaagagtcccacggctgactctcattggccctcagtgggtcacatgtaaatcattgagccaatcaccgtctttctgtctggacctggaataaagaccaccttagagcatgggagcgggatccccttgatccacaccatatagactgtgaggtatgaagtacctcacagtaaagaagtcatgttattgctggaaaaggggacatgggtattaaaaagacaaaaacaacagggcttcatcacagcagctatactgctccatcaatacccatcccaggagacagtggcagtcttgatgtcaatcttgttttaggatcattgccagtggaattcaggactgcggttctacccggtaycggggaaccaggtgagggggttaagaggcctgggcccatggaaggggtgagagagagccacatacttacagttgtgaagggggccagccaggatggtggcttgcaggaaaggtctgagcagagtaagaggcagttcctggcaccagcatgccaaaggcagatagcaacactcttcaatggatgtgggtgagaggacagtggaatccagcaggggccattgtttccttccataatatttttaaactgyagcaaagtgatctttttgagacccaaatgtgagtatgccattctaatcttcccaccctcagataaaccacagcaatgattttatactgtctgtagggtaaagacagacccctaatcataacctacaatccctcgacccagtgacctagcccccgtgtaccttccctgtctcatttctcactgttatcattgtaaccctctaccctctcttttggcttcctgcagttkccctcctgcagcagggcttttgcacatgctggtttctcccttactttgcctctactcagtctttatatttcaactcagtggtcactgtctctaggaagccttccatgactgcattaaatccttctataagttttcatagttctgtgcatttcctcttggcagcaatgcactgagctgcagttttacatttttgtttttttgttttttgrgtttttttttttttttgagacaaaagtctcgctctgtcccccacgctggagtacagtggcacgatcttagctcactgcaacctccacctcccaggttcaggcgattctcctgcctctgcctcctgagtagctgggattacaggcatgtaccagcacacctggctaatttttgtatttttagtagagacggggtttctgccatgttggccagcctggtcttgaactcttggcctcaagtgatctgtccacctctgcttcccaaagtgctgggtttacaggtatgagccaccacacctggcctgtttttgtgtttgtttattaattcctatttttcccacctgacagtacgctccgtagggcatgtgtttgtttcggttccccaacgtatccctactgcccagcagaaggcttagctgttaacaagtgtttattgaatgagtaagtgaatgagtacgtgaataaatctgcgctttagaggcacttgctcaggcttgtggaataattctacagagagaaacaggaatcaaagggaaacctgaagctggctcagaagatggatgggccagcaaaggcttcagcaaaaccacacaatgctcatgaaaaatcacgcatttctctgatttgtggttattgcttccctggattttttttttttccagttgttgttgttcatggtggtggtggacaatctgaccatataccaaccaaattgactgttaaattcaatcatcagtgaccactcctgataatctgacctcctaagttagagcccctgggaagttcagccgtggttctgaccaggcaggataactatctaagtgttcccctttggacctagactgagccaaagwttctccttggtctatataggataatagatttctaaaacaaaccaatagctcaggcacaattatagtggggggtggggggcatgtttaacctactttagagaacaaactctttttaagggctttgcacactaattgtatgcaaatggatgctgctaattgcaaacacaaaattcaaacctagtcaaatttgaaacctgttcatcaacagtccctttaggacctctgccccactctatgtatgcagtttaaattgctgatttatggctacataatgtcttcctaacccccagtttactgttggcttccttcagagtcattgccccaggggactcattgacggcagagagtgtgtcccctccactgttgcctcaatgcccagctcagcccagtgggtaccgtacttcaaaacctcttattgaggtccacctctgtgccaagcatttcggtaggcagtgacagaagagagtgcatgcatgaatggataaactctttcctggaatgcctgctctcatcacctggtttcaaagtcgagccagacgttctgtctcagctcagattctacctaccctgaggttcgcagctgggcatgatcgagccactctccactctcctgtagcatttttgggctttgagtttatttgacacttttcacttgctgccttatattgcgtttatttttattaattacttcagtagtcatttacaaaatgctgctgaatccaagtccctgtgcaagatgctgcaggagacaaaaagatgaacaacacgtggtctttgctttcataggttatttctcctcttccatagcaacacatgtcaaggcaaggaccatatcttattcagttcctagtcatcttttctttcttttsctttttcttttttaaattgttaagatctgccataaaaatgtctgtcagagtaggcatgattgcatattctttagatggatgggtggatggatggatggatggttggatggttgggtggatgtatggttggatgattggatggatgatggttgagtgagtgggtggatggataggtggaaggatgaatggatgcatggctgagtggatagaaggtggatggatggagggatggatggttggatggttggataattggatggatgcatggatgtttgggtggatgaacagatgaatggatgcatggatgaatgagtagttggatggatggataaatgatgcatggatagatgaatggtgaaacttttatattttactaaaaatctgcattgatagcctagtggcttgctaaaaataagggagctgcccaaatgccccatttcctttatatacttgtggagcagcagcgaaggccaagccagtgccaggggctggaaacagacacataaataagaacaaataagatacagacctgacctcaatgattttttgatatagaagcataggcacataaataaattcctgtaatgggagtctagggtgaggggtggtgggtgccataataaaaattatataaagtgctatggggaagcaaagctacatgaccaatttgttctatttatttatttgttattattatgttttttgagacagagtctcgttctgtcactcaggctggagtgcggtggcatgattgtagctcactccagtsttgagctcctggactcaagagatcctcctgcctcagtttcctgagtagctgagaccacaggcacgggacaccatgccagtctaatttttaaattttttgtagggacagggcctcactgtgttgcccaggctyatctcaaactcctggcttcaagtgatccttctgcattgtcccccacaaagtattgggaatgtattctttcctgatcaggaaactccgcagagagaaagtgacagttgaagactatattgaattttggcccacaggaaaaggaaactttgctgttagggtcagctggaggagagactgcaggggtcagagatcagggccatatgctagagctgcartgtgggtgctcaaatgatgttcagtgcatcttcacagatggacctccacatgtccctcatgccctaaaatagatattctccacasctgcacatacaacaacgtcagtgaaatccgttgagaggagcattgaggagatgagtcaggtgtgccgcagcactcaggtcagacttgaggcaagtgagaggtgtgagttattcagagtcccagagagcttgggccaaaagagattctrtttttactggagcatgtgagggtggatcacaactaggatggcgcgaagttcacctcgtgtaagcacaccaggctgcagggataataactgcactttttaaaaccagcaaatcattcatatttactttatgaaacctcttttaactttattttttatattttttttattttcttgtttctttttatttttaaaatttatttttgttttttttgttttgagacagggccttgctctattgcccaggctggatggagtgcagtggcccaatcatggcagcctcagcctcctaaactcaagcagttctcctgcctcagcctcccgagtagctgggactacggttgtacatcaccacctctggctaatttattttttgtaaagatgaggtctcactatgtttcccaggctggtctctaattcctggcctcaagcgatctcccatcccccctcagcctcccaaagtgctgagattacatgcatgagccaccatgcctggcctctggccttcttttcactttagaaaaaaacaaaaaacaaaaaacaaaaaaaaacacamaaaaaacttttttttttagaactgttttagttkgggagccaaaattgagcagaaagtacagagagttcccgtatacctccggcagagccctggctcactatctacatccccactagatccatgtatttgtttaggttttgggggtttgttgttgttttgagatggagtcttgctctgtcacccaggctggagtgcagtggcaccacctcagctcactgtagccttgacctcgagggctcaagcaattctgctgcctcagcctcctgagtagctgggattataggcacatgccaccatacccagctcatttttttttaatatatatttttagtgaaggcggagtttcaccatgttggccaggctggtctctaactcctgacctcaagtgatccgcccatctcggcctccccaagtgctgggattacaggcatgagccaccactctaggcctgtatttgttttaattgattaatctacaatgacacatcatcatcacctaaagtctataggttcattaggttcacagttggtgatatatattctgtgggttttcacagacatggaatgacatgtatctatcatacatcatatattgtatcatatcatatcatgtcatatcatatcatatcataccgaataatttcattgccctaaaatacctctgttttcactttttaatctcttwgtgcacacatcaaaaattccttttgtgtttttgagtttcaaaagtgtgccacaaacaagaaatttgggatctgctgagcccagcctcagacctgtaggggaaacaaagagggcaacaggaggtcacgaaggcatgctgtgcccacttttggaaattgtgaaggagagtgtctcaaacatgtaggcttgagccactcaaarttctgggaaataggatgttttgtaaagaaagtttgctactgtcacttctgagtagttgcagtccctcccagtacgtgggtatcttcggtgagaacaaatttcctggcagcttgaggactccgtgtgttattcacatgctttatttaatagacttgcctcatgtgactttctatatcatcctttgtgtctaagtgatttgcactgggaagatagtaaacgctcccactttatatgcagaaggttgaaaacaccatgartgttgcaatctgaggtatctgcccttaaagaagcaatatttactgaaatgcagggcacacgacttttccagcaaaccacaccgccgtccttttgtgtgacgaaataattattttgagataccgacatgcgtgacgaccagataattatctgagaaaacttagcatctaatgatgctgttttgagatcacaagaaagaattatattagcttgagctgaattgttcttttccccctgtctctctttagttgtaaaaacacccacaaatgtgaatgcttcaggcctgaacttgtcaacagccagtggctcattgtagacatagggatgtcgcctgtgtttggggctgagacaccagaacaggtgttctgtgggaactgagaatgtctactgctgcacacctttaatctcgggtcttctttctggtgaaatacccgtgattcataactcagtcacgttactgaggtatgtctcttcggatagattctatctctaaaaactacagattctatctctaaaaacttaagtcaagggattttsaagcagttgtttgatttatgtatgtgaacctctcccttaggagaagaacttttctttggcaaacaccataggaacggagaccttaacaaaagaattaggactctcttgtcctgttttaatctcaaagctgtccctgcgctggtgcggctggcccacttgtgcctttgtgaatttgcagagaagaggctgggcgtggggggacacatgactaatccgccctttcttttgtttgtgcaacaactcaattcactgtcaccacatcagcacatttgctgcaaatctcagtgccctctcactttcgttttatttaatgcgtttctacattttcccaaggccacatgagctgttttctggcgcgtggtatgcctgcctcaaataactaacattgcctgggtcttggaatctgagccttcatattctccgatatattatttggtcctattgttccttaacttgctcatcattcacacggcgaaggaaattccatttggtccttttaagaccgccagactagctgacttaaacactcagctccagctacttctgaatatttcggttctttattgaaatggtccttttaatgtcatctttaatttaatcaaatagtgtcatcaaaataacatttactctattactgaaaattcactgcattattaactagtgtaactagacaaaaaagatggtacaaacccccatggaaatatatacttactgtaaaaatggatagagttcatggatgttctatatttaatttgcactttcaaagtactctctatggagaggttttatggttctgaaataatttaaaaacacactttactacaatccatagcaggtagttttgccaatttgggaagttatgktgccttgcagtttccaaagtaagctgaacagtgttttytaacagtgctgcccctctctcccactagaaatgcgagtccatccttttaccaagtgtggtacgacaaaggtttctctggttttcttttggtattctcagacaactgaaatataaattacatggtatgtgcaggtatcaccaggatgcaattagtttgatgaaatataccaagtcgtcaatgccactttggatagtttaatctgaaaataggacatggttgkggtagtgggcacaggggaaggaaggttatgtaattttaaaattcttcctttgattcaaaagaaaaaaacatgtttgttgcattcaactccaaagggtgagcatagcttagtggggagagatttggactaaaaaataagagttctgggttcaagatctgaggtaaattatttgctaggccttagtttcccatctgtgaaaaaagggagttctataacagcaagacatttaatattaaaataatgtaatgtttttaaaaatgcttgtctacccactttttcttgagattagtaagaccatcttccaattagaatgtttatccgaacttaccgctaggtatttccttgtagagtatgaaagtaaaatatcaatgggccatctctacgtcaaggttctcgttcttctcattactgagaaattatgttcctggaataatattgtacagacttagaaataagggcattgaacttaattcatttatttttcaaaaggcatgtattttttacctgttgctatatctgctgccagccaagtgctgtgcttggccctgagaaagcaaagagagatagagatgtccatgttttggaacttgacgtccattaggggacataaacatttgaaaagataacactaacaagctaattcaggtatgataataaaaaccttcacagggttagccatccatctatctgtccatccatctattcactcatgcattcatccacstgttcatccattcatctgtccattcatccatctatccatccatctacttctaggttgtgagaacccgtagtattgactctcagtgtgataggaaggccagtgtcttggtgaaagatcaaagagctcatcaaaatttgtcggatagactgcaggctcagacactgatgagacccccctgcaactaccacatcaaaaggcctaggagcctttccatgaccaaatgcccatattgatgaatccgagacaagtgagggaaagatgtcctctgtcggtgttctgaaccctgtggaaatcatacggggaactataaaagatcctgatgcctggttttcttctggagagtctgatttaattggataaggatacagcctgggcatcaagagtttctagatgacctaagtaattctcatttgcaaccaaggttgagaataaagggtgtgtataaggtgagagacttctggttaactaaaggaaataccaatgacatttgtgctttaggtctaccagttagtgggtattggtgcatggtgggacagactaaatggctacaggtcagggtcattgtcaaagagtgagggataaggggttgtgctgtggctcagaggcagagtagactgaggaagaacagctaattccagaaagccatgttgtggtgtaaaagatagtacctgacttgtaatgtctgacaccaaaaatgaccttaatttgggtcataggacaaagacctccccacctccagctatgaaagacagaaaatgataggactaggcttcatattttctagcgtaacgtttggcttgtggtatattcaaaactaagtccgtgtttgttgctgctgagtgactgggctgatactacctgtccttcagccatctagacttgctctctaccatcctcaatacttcatatgaaaggagactgtcacttcatgaaaatcatttatttgctttagcttaaatctactggagattacaactgcctcattttgtcaccttcttaccccagaaggaaatatctccacaagagagcaggtatttattgagttatgactgtcaggcatggaacagatccattggtcagaaataaggaaattgtctctaccttcaaggttctcacagtctggagggaacagagagccatcagggacaataggtccctgtgccatcagctactgggatgtatgacttyccagtagaggtacacagcacttgttccaaaaggagcctatgtagctttgggagttctctatttagtcaccttattttttttgtcttcttgttaaactagcatcctgttttactgaatctctgcctcagttgctttatttactgtatacatacatagctcttttgaagacttgatgtcaaaagtaaagaagttcagaacctacggggcttgctttgggtcccaaattatcttagctttctggaaagagaagaatctataatgtattctccrtggagtatctttactcacttgtgatgagatgtctgtaaaagtaatcagctccatacatctgggcatgatgaccctcaggcccttgagactcaggtgttctcagctcatggtgcaagttcccctgaaagaaagactcaagccaagcattcaatggttatgttccagatcatagtctcctaaaagccaggggtcctttatgcagggatggtgacatcagaagttaaaaggtctatgcagattaacgaggaaaaatgagggaaattactgtaaggtttttaaaacatgatagttatatatgaactgatgattatataattgaacgtgcctaaattgatgtagttctctgtaaaactagttggtgtaaggaaacttggtctttgaccatcaaggaggttgcagtttgtggcatggcacaaagataacactcagcagatatatagctatgggatacatggatggatggatggatgggtggatggatggatggatggatggataggtagatggatggatgcgtgggtgtgtggaatggtgggtggtaggtgggtacatagatggatgtatggatgggtgggttggtgggtgcatggatgggtgagtaaggggggataaatgaaaggcttgttcttctgaagggactctttacaaagagtctttgatcttccagcttcacgtgcaagagaatccccaaggtgagcttgttaaaataagcatattctgggtatcacttcctgattttctggttcagtaagtctgaggaggaacttggggaactttatcttttaaacaagtacctcaggttatcatagtagtcttgctgtcctgaatcttaatgcatctctatttctgctacatcttccatgaagttgattttgcagaaatcattctgtggttccacattgactgcatccaagacctattgccttcagatttacatcaagcacaatttggcaggtattagggatggacccagcagccaagtctttgttgccttaaacagatcccttgtctcttgtcaggacctccttccaggctgctcctgagcaagtctggatgtgacttctacctatgatccagtgggttgggccataaaggagctttggaaagggacagtcttagggtgaaaaagagggagaggcttgccatctgaacaggaatctctcccagaggagagaagagaagcctaggctttaatgaggacagccaccctgtggatgactttctgtgtgatgttatgtggaggtggcttcttttttctctatcccattagctgaattctgtgccagaaggaagagatttggagtcagcaaggcatccttttttttttttttttttttttttaaaaaaaaaaaaaaagaaggaatgtgattgtgaaggaagcaagaaaaggcccaaaggctctggacaagggctaggaggctgaggagttttacacattcataatttccttgtaggccaagcttactctcagggatgacagtcattttctaagaaagtgagattgcttcacattgcatttaaaggcttaaataatgtattctgtcagacaattctctgaaatggttttccaagtgaatgcatcagaaagtgccyagaaagaatgcctggcacaggaagaggagggcattcagaaaatgtgagctgcttgcatcagaatctaacttgagatgtatcattcctacggtaaggtgcacacacattaaatgtacagttcaatgaactcatacttatttatacaactgtgtaaacaccactcagatcaagacagagaacatttctaacacctcagaaggctcatctgttcccctttctaagcaagaagtaccatcagcattaagaggtaaccactattctgatttctatcagcatagttttctgttcctgaattcatataaatagtcacccagtacgcattctttgctgtcttgcttcttttactcctcattaggttgtgggatttgcccacgrtatttcattctttattgtcattcttctttctctgccactgccatcctaccaacagtttgtattatgaaaaattgcagacgtacacaaaagttgaaagaattgtactgtaagtactctgatatgcaccacctagattctacaattaacatttccctctatttgcatctctatccatttaccattcctcttgtctatccatcagtctatcttgattcatttcaaaataagttgtaggtcaggtgcagtggctcacacctgtaataccagcattttgagaggcagaggtgagaggattccttgagtccgggagttgaagaccagtctgggcaacatagtgaggccttatctcttcaaaaataaaaaaaattagctgcccatggtggtgtatgcctgtggtcccagctacttgggcagctgaggcaggagaattgctggagtacaggagattgaagctgcagtgaactgtgactacactgctgcactcaacttgggcgacagagtaataccccgtctcagaaacaaaaacaaataaacaaacaaaaagctaaataagttgcagacagcagtcgcttcactcctaaacacttaagcaggtgtgtcatccttgaattactgaattagagttcagtatttgcttatgctagttatgttagtggtatgctttttaaaaataattaaggtgatgtcatgataaggctattaagagccaacatgcattgagtatggactttctgccagacattgcactatgcacttaacacayagacacatattgttttttccattttaagatacagaaagtgggccttaaaggtgctactgacttgctgatatgctttggctgtgtccccacccaaatcttaacttgaatcgtrtctcccagarttcccacgtgttgtgggagggacccagggagaggtaattgaatcatgggggctggtgtttcccatgttattcttatgaaagtgaataagtttcataagatccaatgaatttatcaggggtttctgcartttttctcttgccaccaccatgtaagaagtgcctttcacctccaccatgattctgagacctccccagccatgtagaactgtaagcctgattaaacctctttttcttcccggtctcaggttatgtctttatcagcagtgtgaaaatggactaatacagtgaattggtaccagtagagtggggcattgctgaaaasatatctgaaaatgtsgaagtgactttggaactgggtaacaggaagaagttagaaccgttgggaggtctcagaagaagacaggaaaatgtgggaaagtttggagcttcctagagacttgttgaatggctttgcccaaaatgctgatagcaatatggacaataatgtccaggctgaggtggtctcagatggagatgaggagctcgttgggaattggagcacaggtgactcttgttatgttttaacaaagagactggcagcattttgcccctgcgctagagatttgtggaactttgaacttgagaaagatgatttagggtatctggccgaagaaatttctcatcagcaaaacattcaagaggtgacttgggtgctgttaaaggcattcagttttataaaagaagcagagcatcaaggtttggaaaatttgcagtctgattgtgcgacagaaaagaaraacccattttctggggagaaattcaagctggctgcagaaatttgkgtaagtggcaaggaacctaatgttaatstcgaagaccatgaggaaaatgtctccaggccatgtcagagactttcacagcagcccctcctatcagaggcctgaagtcccaggaggaaaaaatgatttcatgggcccagccctgggtccctgtgctgtgtgtagcctagggacttggtgccctgtgtcccagccactccagtcatggctgaaaggggccaatgtatagctcaggctgtggcttcagagggtggaagccccaagccttggcagcctccatgtggtgttgagtgtgtgggggcacagaagtcaagaattggggtttgggaacctccgcctagttttcagaaaatatatggaaacacctggatgccccagcaaaagtttgctgcatgggtggagccctcatggagaacctctgctagggcagtgctgaagggaaatgtagggctggagcctccaggcagagtccatactggggcactgcccagtggatctgtgagaagagggaaagtgaactaagctctttaaacctcatatgtttccatcagtaacatgggaacaatagtaacaattccacagagatagtattgatggttgaacaagatgtttaaatcactagtaaaatttggccagacacggtggctcatgcctataatcctagcacgttgggaggctgaggtgggtggagcacctgaggtgaggagttcgagaccagcctggtcaacatggtgaaacccyatctgtactgtaaatacaaaaaattagctgggcatggtggcaggcacttgtaatcccagctacttgggaggctgaggcaggagaatcacttgaacccggaaagtagcggttgcagtgagccgagatggcaccattgcactccagcctgggtaacgagcaaaactccatcttaaaaaaaaaaaaaaatgcccgccttattcagatacacagtctaatgctttccactagaagattctggcactgttagcatctctrgcataaactatgttactcaacccagttctgtcgtcgtcatttttttgtgttggctttgcccttcccgcattgtgacttgatcccatttaagcagyaacctctgcacacacaatcttttctctgtccttcactcagtgatgttataatatctagaggcttattgattatttgtttgattctattgtgggcacaggagcagttcttagattaacactattagattttcccaagcagtattgccgtggtttatacaattggacgaaatgggtgatctaatttggactcaatttgctccaaagtagagttggaggaaggagatgctgtgatttggttctgcacctgagaacaagaatggaaaaagttatctccaggtgctatctgtgtgcctcatcaattttggatacactgtgtgaccagctctgaggattccaagcttttttgcgtggcttcttacctatcagctaaagaacctagctttacttatccaacttagatattaaatcccatgatataatttatttttccgtgtgaaatatctcaggaacaaaaaagtcaggttgagttttctaaaggcactggtttaagaggctataggttaagaggagataacagacatgctcagaaacaaatcatttcctgatagctgtttcagatggaaccaaatggaaaacagtgcttctttccgtttactgtacaccccctatcctggcatctaaacatatttgtaatcatactgtctatagaagttttggttctgcttttgaccttaacactaaaatacccttccataatattataggcttttcatgtacatcgtttttaagatggctataaattccacttagtggctatgactgtagttttttttttaactcttcccctaatagtgaaaatttagattgtttctaaattttccttactataagtaaggctaaaaagtaacatgtgaatgttttgaatcaataaatatagtatgtattaataatattgagctatttcttaagattacattttcagaagtaagatcactgagtcaaagggtgcacactgtttaaaggagcttaaatatattgcaaaactcttttcatggtctgctgatatcactgaaaatggaggtctggattcaaatcacatgtgccaactgttctactttggcagaattacctactgctttgggcctcgggtactaaatttgtgaaatgggaaaaataatagttcccacctcatagagttgcagtggagattgaatgagtttgtagataaaaagcgtctgcgttgtgtctggtacatggtaaggggttcgtaaatactgagttatttcttattaacatttattattgtctccactggaagaagagcctgtagaatatgcagactattcaaatgcttcctttggtccattgttgtcctttcttttctcttctagaactttccccatagtcatgcatctgtccctgggttatctgatatgtgtttcagcctgttttcccaagtttacctgcctctctgagaagcccatcagccctgagagatacctggaaggaaagaggaaaatgcgtgattcaaatcatgttgcaagtggatgaatctagccccaaacaactgggaggcaactactcctgcctgccgaggcctttttttttttttttttttttttttttgagactcactctgtcacccaggctggagtgcagtggcatgatcatggctcactgcagcctcccgggctcaagctttccacccmcctcagcctcctgagttgctgggaccacaagtatgcaccaacatgcctggttaatttttgtggttttttttttttttttttttttcctgctgagatggggatttcaccatgttctccaggctggtttcaaactcctgagtccaggtgatccacccatcttggcctcccagagtgctgggattacaggtgtgagccaytatgcccaataccccctatgtagacttttaaagaaatacaggaaacagccaagactggtgtsattcagatttagcttgggagagtctagtgggtgttaggttcccacaggatgaaggatcaccatgaacggtcaggacctgacttaggaggactcagaagctggagactgcagaggatggcacagagttccaaatctttggggtgtgtaagagtaggagaggcaggatgggagaggatgggagtgatgccacataaatcaactctgttgcagcctccggggccacatcagtagctgcaggaggaggagggaacagggagacagggagcctttcttcctttcctcacccccagttctgtgtttatacttctcatttagcccataccccactatattaaaagaagatgtataagtgtatgtgtttaatctaccattccttgtggcacagtgcrtggtctgcatggcacagtgtgtggtctgtatggcacagtgcatggtccgcatggcacagcgcrtggtccgcgtggcacagcgcgtggtccgcgtggcacagcgcgtggtccgcgtggcacagcgcgtggtctgcgtggcacagtgcgtggtctgcatggcacagcacatggacatgattcatacatgcaagtgaatgagtgaatgggcgatttccagactatccagaaactgtgccccatagtcctacccgtaggaatccaacagggaactgtcaccaccgacccgaggcaggaaccatgtgctctgagccctggccattttgtgtagatggagataaattgtcattgctaattgccagagaccaggtcctggtggtagccaaactgttccctagggagttctcaccaaccttgcaaaatgagatggcaatcttcatcgtggatgcaattatgtttcattgttaaccatcacaagcaacgggacattatgatgactgttataagttggtttcacatgtaaactttgacctcagagcaatggggcaggcttttcccaaggaccctgttgagaggttcatgatggtgacaaaaagcacaagccccagctgccaaggaggctgatatcgggagaggcagaatgtgtcttttctttcttcttcctcttcttcttcttctttttgaaaccatgctcattgkttttaggaatcattagcatggtgaagattaaagctattggagatagcacagattgtttcattttattatgttcaattggattggatccgagccatttgcaaagtgcagtattaccataagaagggacttggaatgtttgtcacataatacttcttcatggagaaggcagtttcttaaagaaaaaaaaaaaagacaacttgaaatagcacagcttttttccactttcaaatgtataacaaaatagaactttatatttccagatggactgcctggaacccggggagtggctcagctaccaggcyccagtggccsttgtcttgttatttcctccattagagacctggcrtataattgtgggagggagaagccagtggagcagtcaggggactccctggctgtttctgtgtctggtcttatgggtctgggcaytgaattcagtcacaaaccctagcatgctcctttgctacctcaggggacaaagtcaagaaaataacactaggattgccaccctgctctctctctctctctcttttttttttttttctttttgaggaagggtctctctctgtcacctggctggaatacaatggtgctatcttggcccactgcaccctccayctccctggttcaagggattctcgtgcctcagcctcccgagtagctgggattacaggggcacatgccaccatgcccagctaattttgtatttctagtacagacagggtttcaccgtgttggccaggctggtctsaaactcctgacctcaagtgatccaaccgcctcagcctcccaaagtgctgggatgacaggtgtgagccaccacacccagccactctctttcaactagaacagttcctctcttctttgttgcatatttttgtatttcatgcaaggtgctgtttatgaacaagggagtttcctgcagctttaataaagaagagaaaagaaaagaaagaaaggaaaattcgcatgttgaaaacattgtactaatcaaaaaagccagtcacaaaggaccctatgttatatgatttcatttacatgaaataccccaaagaggcaaatctgcagaaacagaaagtagagtggttgccaggggctggggatggggygtggatggaggcatttgggattaacagctaaagatagcaggattccttctaaagcaataaaaatgttgtaaagttgattgtggaaattctttcacaactctttgattgtactaaaactttgaacactttaaatgggtgaattgtatggtatatgaatcatatctcaacaaagctgttaaaaaattgtatgaaaactgtgatgggattcaagtagtstaaygctcaaatttcccaagtgccctcatttaagtctggaccacgacaggaacccagatgtggcctgagtagcacatcgtggaatgggcctgtcacctctaccccacacatcctcctgctgttaatgccccctttgaaagccattagctcttttgataaccacagcacggtgttggctctcagttagagactcagatttatccctgcccgaatcattttctttgattctctgcccttccccactacagtgtaaactccatttggactytctctagttcactgtgaatggtttttgaataacatcaattagcataacctcatgcccagcatcgtccttattgttgagagcacagcagtgacaaaggtgcaactcttgctcttgagcgatcacagtttatttggggaacctggtactacctaataaaaccaggggagactcgacccaaggcattgtgtttgagctaggctttgaacaatgtatagaccctcaccaagtatggaagtggaagagtaagacattcmaggtagaaggaacagtatgaggaaagtcagagagctaacaaagattatagtgtaatgccagaatcatgagaaatttgctgagaattcatttgaggccataatttaaaaagataggaggagccatgtgtagaactttcacagaacagtgtgtacctcccctccttcttccttattagtcgtgattcttggggggcaactaaacccagcttttggcaaaagggagtatgttggttcatgtaccaggaagtcttggagtgatggcttcaggcacggctggatccaggggctcaaaaatataatcagatgatttgttygcttctgtcttttgctatggtggtctctgttttgcttacttctgcagcagattttctctacctggtgggagaaacagctgccagaaaatccagattcccattctcatgctagcttcataacagcaggagagctcctcactctgtttcccagggtgtrtatatatatgtatacatatgtatatgtatatcaatatatatatcaggtaagattctagtccagtgtgagccatatgctttattcctgagcaatcgctgtggtcaagagatagactttttagggccgggcacggtggcctacacctgtaatcccagcactttgagaggctgaggcgggaagatcacttgttgaggtcaggagttcgagaccagcctggccaacatgstgaaatcccatctctactaaaaatacaaaaattaggtggcaggcacttgtaatcccagctactcagaaggctgaggcgggagaatctgttgagtccgggaggcggaggttgcagtgagccaaggtcacgccactgctctccagtctgggtgacagactctgtgtcaaaaaaaaaaaaaaaaaaaaaaaaaagagagagataggctgtttaacaggtgtcgtaggtcatgtatctacagccatggaaagagaatggagcactctaatggatccctgacgggtcaaatggagcaaagtgtgcttcccagaagagcataagaaaaaggaagggtactgggtggaccaaatctattgttacaatatcccttatattccttagggttcctttttttcaagttaaagcattgrgtcatgtctctgataaatcgcccccccaccccgatccccaccctctgccgcccyggccttctttttgtrctgttgggttccaaactttacctgaggattttcacatgcacatctgttaaatgccatttaaagagaacactaacaagagaaagctagttcatttytcttcctgggacctcagtttcctcatcagcagaatcgggatattagtgcagaccttgcaggctctttatgaggatccatcgggagcctcaggcgcacactcggggagcattggagctcttcccaggccgaggtaggagtttgtccacctgctgtttactccgaaacttcttgctccacctgtcactttagaagaccctgatctgccggaaggtctccccgtatacccagcagcccagacctctcaggaaagagcaggctgtcgtcctgcattggaggaggaagcttggggcaggtggcagagcaacttcatttccagatgaaactgggctccctggccatcagctgccgtgcttggaggggcgttcagacaaagagccaaatttaaattcatgtaatgttgctgtttgtaacattgaatacttaagacatctgctcagagtctcgcattataaatgaatggaaaggatccaggagggctttattggatgggagccgtgaagtsagcgccrtgtatttcaaagcaggatcttaatcagacattatttatatctataatattttacaaattaaaagcagtagaaatagtcactggaaggaagtcagcaagcaggggtgaaaaaaaaaaaaaakaaaagaacctgaagccgccaagagaggctcactgaccatctctgggggaggaagggtgaagagtagcaaatttaccgtcatcagcaggtgtstaaatgttccatttamattgaatggcacatgtcataaagtacataccgctgcacatcccaccctctgtttctgtttcaactgcagagcctatttttctttcccttccagctcagctgccttctcctccctgacytcaggtcacccaagactcccactttatgatttccttttacttttagttcattattctctgtgattcagtggaaacataaaaaatggtttttaattttaattaatggcaaacttagaacagacccatttaataaatctgtcctctgaacttaacacgtctccccgccttgtaagggctgcctgtcattttattagcgctggagcctcccgaccgaagggctgagtaattgacaaaaactgcaggtaaggcaagagrccygtaattgattcataagatcccttcctccgatcgcattgaagagttaattatttttcctgcagttgggactcagctgttgtttccactgggattaaacagctgtcagcattgttaatgacatcaaattcatgcattaaaatcctctcattcccttcccgtataaggtggggttgcggaaatctctgccacgtccgcctttatgaaggagtgaaatcctaagaaagataaaggcccttattacaaaaccacagaccggagcttgtgttgatggaatctcgtaatgagtaattaagccgctttgcagaagtccgggctgtcatcctggcgtttgggtacttatgttccctagtggagacagccgggtagactggggaaggtgataaaagggagaaaaatagaactgttctagaacgatctccacttttaacagcacaatacagagaacagagctactcaataattagccaaccaagtatgaattctcatatgttcttaaagtatctgctgatttcttcaaacatctctaacaacatgtctgatgaatacgaagcctccctttatttatttattttctttttgctttctttttttgggggcagggggcacagtttttctttctgtctcagtctctcaaactgtaggaggaccaacttcagggttttattttgtttgctttgctttgccttgtctggtttttcaaagtgctcttttaacaaatgaaagtttaaagcttgagttcaatttgagtaatttgttcccagagaaraagtaaatgaaaagtatttctgggtatttttaatgacacaagtttctgtgctgatatgcgggcaggggttcrggagtgggggcaccagggctcatgagccgagagcccctgcttcccttggaaaacggaaatttctatctccaactagggaaaaatttgcatgtgtagaattttggttttttsttcggcgtgtttatttaatttaacattacctatcctacgattatttcaaggtgattttattactagtcagctttcttttccctagcacaaaactcatgcaacatttatgttgaatgtttaaaattcttttctaaatggtttcacctttctgaaaaaatcttgcattcaaaaagtgtaaaggactctcctcatttctgcgcttgaaagtgcagtgtgatttcacaaatcaaacaatatcaggaaaattcaatctcgttaatacttttggagggaaaagaaggcaagcgtactcttcagagaacggattcttttggatttgtgttagagaaaaactgtstctaatgaccgcacagcacaaagcaaagcagttaaatgaataaccgccttccagtacagataataaagcaggagaattttgtgtgtcacatcaataaacatcttaattgaacagcacgtgggttcttccctagtacctgccttgctatacactagccttggaaagagtcttggtaaattgttcagcctcaagttccacaacaaaatgggattctgttttctagaacctggcctagttatgatgtgatgaatccgtctctgttaaggttatcaactttaataaaccatgtattatttccttaaatattgtgcaatgtgcagggaattattgcagttttgttttttatttagcacaaacctaaatattacacgtagcaaatgtcacccgatgcaactgtctgtcctgaagaggaggayagattattctgtggctacctaatggtgtttacagagttgccactttgccaaaccccaagasccacacttggtctctggtgttgggtccgccagctctccacccttcagaatgggatgtttagggcgtaatcttctgagacccacaacctaagccgggaagcagaggcaatttattaccccagcttcctgtccactggaggcccggggagaccktgaaatgctcagctgcaagtcagggtccaccgatgcagcctcggaatttaatgaggcctctccggacccaaagggagatggacatttctaggcttgtggaagggactccccagcccctcttctctcctggtgagaccgttgttggatgtgaaaaggccttcactattgtcaaggctgggcccctgcttttgccttgttactctgcattttaactstggaccagaattgattgccaccaataaaagatactccagtccttaaaaagtcaacattgttatgttttacttagttatgacttagtgaacacctatacgaattagcctcatctggttcaagggttctcagatgggaccacttttgcacccagggaaggtgtggcaatgtctagagacatttttgattgtcataacttaggatgaggtaatagtgtgctcctgatttctgggggtagaggccggggatagtggttaacatcctacatgaacagggcagacccttgcaacaaaatcttacgtggtcctggatgaaaataacactggaggtaagaaaccttggcctagagggttccccaacctttttttttttttcaktatggccccctcccccaggagccttttgagatacgactttcctaatggtctttgcccatgaaatctgaataccacagatgtgctgaatgcctgttcgtgtaccatatacacatggtatatgcctcgtaaatgaaagggtgaacagtgtttattccccaactgtcgtccctcaaaaccaatgttaacacccctggatgtattgtcacccctgttgggaatacaccgctcagagaagggttttgtccataggcaacacagagccaattgaggcctttgggcaagcggaggtcawgatggaattcagcctttcagacaattctgccaggcccttggagggtgggaggaaacaggcaagacctctggctcctagaaccrtaaggacccttgccattaggascaaacctcttccagctttctcagcagccacatgtcaccccctcttccaccctttgccctgccaccctccatcccctgataccctcctgccttttagttgccggtgcttggaaacctttgcaaagtctttttatggagatgccatgtcctttcaatggtgcgtttagccagcgccccgctctgggctccagcaacattagggcattgttattccatccgaatgacaatttcaagctcacgtctttgttgtccatcctcgtatatcctgcaccgttcctggcacagagtaggcactggataattatttcttggatgaaagaatgaacaaatgaatgaatgaatgaaagtttttttccttgcaaatctccctgcacactttaatcttaccagcatcttgtgaaacactcctacttctttctgatctttatttcttacgtagttttgaaatgagaaccgatgaagctgcttttgctcatggtacctcaggtcctcgctcactcccagcactcagggctgtgtggtcagagtctcagattcggagcatgtgatgtgcgtgggcctgtgactaacagccacatggcacgcaatggtggcagcctgggaggctgactgagcaagtaatttctgcttaagcaagaacgtgaggggtgatgtagttgcatgcactttgccatcatagcttgatctaggtctcagcctgggatcttgcagctgcgaaaagcatggcgttgcgtttccaagcctgaacatccacacccgcgaagataagaccatctcttggattaatgtgacgctgaaataaaataatccaaagagaaaatgcctgagacccaccaggagctcaccagatactacttctatcttccccactctaggtctttttactgcaactaccgtttaaaatactttttccatgaggcagatcttagtgctgacagtgtcagtgtctttaatgcctggttcagttgcaaacatggagggcagaggtttgatagcatccaaagtatgcacgccgcactccacctcccatgcccttttctttttctcagggccatcagaaaggaagtaactggcttagatttgacacctctttttttgktcgttttatgtttttgaatctagcatgtataagctcatcagagagctttcccctggcctgggacaatcaggtttcaactgaggctcacgcacacgtcaacacaggaacctttttgatgcctccaggcaatttcctacaagctctaatatcttcctctttactcccatatgtggtatctctggtaccctatatatcattcactcaastgtttgttttgaaccacttattttggcaagacttcttcagacaggagagccctgagagctcttcaaaggctgggcctgatggtgtttgtcagagaggttygagctcttaaatttaaatggcctcccacagggaagcagaagtccttttggatcctccagaggactgagatcctccagatgctgttcatttgccttattcgttatgaccatagaagtttgtggggtggcactctttattctgtcctcgccccgcaagcaaagcacacaccacaagctataaggagatgagctcagtaggcctgtcctttactttattttccctattagaatcccaccatagacgccctctctgcatgtgtccttgtctgggggagtcgcttaatttcctttttctttgaggggctataaaatttttgttgttacaaaaatgaaaggggagaggagatagaagaaggaaaacagtgaaagctcagcctcgaaagaagtgcttaaaggaaaggaggttctgacagagggctcggatcatcagcaggggcagggggtgcagggggtgcctgcaagtctgtgaccgtcctgaaggacccccttcctaggatcccaaacatgcactcccatcccagcctcacaccaagctcccatctgggaagcagcagacacacataaaagcaaggaaacttcaaggacgctttttgttttcccctacttttaaaaaattgaggtgaaattcacataatataagattaaccatttcaaagtagacagttcaatagcagtacattcacaatggtgtgtaaatacygcatctathtatttccaaaatatttgtatctccccacaataaaagtctgtaccaattaagcagctactacccattcctcttccctaccattctaccttctgtctcagtaggtttgcytatttgggatattttatttaagtgsgatcatacaatagcatcatgtgttcaaggttgacccacattgtggcatgtatcagtacttcattcccttttatcactgaatagtattccactgtatattgataccacagttggttgacccattcatccatccatgggcatttgggttatttccacctttttgctcttgtgaatccatgctgctgtgaataattgcatatgagtatttgggttcctgtttttaattatgttgggtatatacctaggagtggaagtgctgggtcacgcagtaattctttttaactttttggggaaatatcaaaccgttttccacagtggctgcaccatgttgcattcccaccagcgaagtgcaggggttccagtttctcacactgtcaccaactctgtcagtctattctggcactgctataaagaaatgcctgagactgggtaatggctgaagaaaagaggtttaattggctcatgattctgcaggctgcacaggaagcatagaagcttctgctactgggggcgcctcaggaaacttrtaatcatggcagaaggtaaaggggaagcaggcacatcttacatcgccagagcaggagcaacagagagcgactggggaggcgctacacacttttcaaccaccgaatcgcatgagaactctctcactgggacaacaccaaggagatactgctaaatcatttatgaagggttcatcctcatgactcagtcacctcccaccaggccccacctccaacactggggattacaattcaacatgagatttcggcggggacacagatcyaaaccttatcaccagcgcttgttatttcctcaggtacattttgatgtccctccccactttactctcccctacaccttgaagcaggtgcaatcattttaggctatgaggaccagcatcgaccttcatcagcatctgctctcctttacggccaggtctccttcgtcctccctgctcagaatttcagtctttttttttttttttccctatacagacacaggaagtatatattttcctctcgaatatcacttgggtcttatcttgttttatgctacatgcatgtggcttcccccgttacaaaaagaattcacattattagagaacatttggaaaacatacagaagtaaaacaagccatccccattcccacctcccagagataacgcctgtgttttagttcatctccttctaacctttatagttttttttctatcatattagttaggcattggtttggctccaagtgaaaactgcttctgttattaacatcagcagcagcaacaagaagagagaagtttatgtctgtctcggaatacgtaygtgacaggctcccccatcgaggtgctcagatatggtggccactgcatgattttgctcaggactgaattagaggcaggtgaaaggccctcactccctggaatcagctagcgatggctaaggctcctgtgagggtttctacagaggttccacccagagaggagagtcaaatgggagtttctaccgatgctcttgaaaggatcttgttactcagatgtctctaagacaatgatcagtacccatctctcagagcctgtgyagccgtccatgcttgaggcatgagatgctgaagataaaggtccccagtggtccaggtttttccttctcagcttggaaagcagcaggaaaactgcactgcatttatccaaagggtgtgattggtaagtgtgggtactgatatagaataaatcaacgtggctgggtgcagtggctcacgtctataatcccattactttgggaggccaaggtgggtggatcacaaggtcaggagattgagaccatcctggctaacatggtgaaaccccatctctactaaaaatacaaaaaattagctgggtgtgttggtgggcacctgtacttccaggtgcttgggaagctgaggcaggagaatcacttgaactcagaaggccaaggttgtagtaagctgagattgcaccactgcactgcagccttggcaacagagcgagactccmtctcaaatcaatcaaccagtcaatgtgtgcccccttttcctccaactcccaccccaaatccttgctgaatcatacctatccttcacctttataagcatctagtttttaaatctttgctgtgaagttggctgtgtgagctccatttgacagatggaaaaactaaggtagtttgccaaagatggctctttgccttcaggatttccatgtctttattttgagtaaacacttgcactgctaattttattccaacaatgtccttggaatggttttagttctcttggctgtaaccaagtctacacgataccacttgaattgacaacatcacagtcaaacctcaattttcacaattaattgtgccgcagttaattaaattgactgcctggcaatccagtctcaattaaaatactaatagtttatttatttattttgtcttttacgaagygttttcttttaccatctctcaggatcctatgtaggtatcctgatggtaagaatgataataccatgactgattattccatagttgcaggaaccccacatggcatttcaaatcacaatcagaactttgaccttgaaaggggacccggatcagctccattctcccaaggagactttagctactacctttcttactttttgaataagtattttgcagggcttattttcatcatctggaaaggaggaatagatagggttatcttgaaagtcctctcttggaagggattatggttctgtaatsctgtaggactggactcagtgggtaaatgtagaggtgatggtatctccgtttttattgtcttcagaaatgttgagatcgagtgatataaagtcacagggttggccccacagtttagttcttggcttatgtagaaatctgtgctaagaagcgctgtgttgcgtcatcatggggcatttttgtatgtcatgcagtcatactttgcagacccctgggagcctcattcgagttcttcctgtggagtcccatgccttggtgttgaaccagtgtcctagctgggaggaccgttgtactgcagcrctttcctaaactctgcatgtggtctccatgatgtcctggctgtgttagcatcagaaatggctttgcccacatctcccaactctgccctcttattaggatttctctgcgctggctgatgcctgagccatctaatgatctttacgggaataaccaaaaatgctgggtggggggggaaaacgccagcagatctctttagggcagagtagggagggacacggacaatgtgggcagctgtccatgcagcacgtatcacatccaggatgatgtttatatgaagcatcatttttttttttttttaggtggagtcttgctctgtcatccaggctggcatgcagtggcacaatctgggctcactgcaacctccactttccgggttcaggtgattctcctgcctcagcctcccaagtagctgggagtaaaggcacatgccaccatgcccagctaatttttgtatttttgttagagatggggtggccaggctggtcttgaactgctgacttcgagtgatccaccggccttggcctcacaaagtgctgggattacaggtgtgagacattgtgcccagcttggagcatcttaatttaagccctctacatccctgcacggtagatacaaccagctccgtttccaaggacgaggagcaacagagtgaggtcatttccctgagttacactgaagatggtctaatttcaaagtccttcctgtgtccactttgccaggtgccccccgaaaagcaagaagactccttcaagcatcctgaagatttggatgctacaactgtatgtcctgctggagagaccctcccagaacattgaaggctccagtgttttgactggcagaatctcagtttcaacatctgtctctaagggctctggacctatgctgggtgaaacgtgttgtctgtaggatttggcccatctgagcctcactggggatgggctaaactccgtggggtttgtattccttctccttcattgctcagaggaaaagaagaaaaaaaataaaaagaaacgaccccaaacagcctctttcgtgcacacacgcctaagaaataggaacatgaatttgcattccttccaactggtgtgtttccaaaatacagacaggcaagtttgaatcactttgactttgaaagcgtgattttgagcaattatctggggaaaaaaatacctcctcttcactaaataagtctgtcaaaaagagtcatagtacagcgtgccattgccagaatacacgtgtgtgctggtaagctggccccaaccaattaaatagtgaaatgtcgactgcattcaggcccttcctggtctgcagacagacttgtgttagttcattttcatagtggtgtgtatgtatctttagactttaactgacagattcccacagtgagtagagtagggagttatcaattacatggttagctaggcgctgctattgtatgctctatggcttcttgacaggagcaggcagagaaggagggaaggactaatatttctggtgcaggaggactgttaatattttagaccgggctcctcaaacatgtatgcttatttagtgaggagaaaatgtgcatttgaatcctgcaaaccctcgagaagtttgcattaataaatagtgattaccagaatattctcttctaaaatatattttatttatcaaatgaatacccttctgagcccctctttatccttcctgtgatggctaaactaatttcatcaaattttgatttctgtgtggtgatgttgtgaacagtgcctgaaataataaaattaccctgagcagattgcatataaaactgtttgcaatgggagaagcagtctttggggctgtggtttcctttggctgcagtgtaatatattcctttgtttcttttgtgaagtatttattgtgggtctcctgtagtctgagtttcttgtggaagtgggcttgtgttttgcttttgtagactgacactgagaatagcatccaaacatctttttcccaccaaggcatcaaactccatcrttaggaattccttcatagaatcaaagaatcagaaagagctgaaacatagaccacggacactcaaattgtttatcctgaaatgaatgggaaaacctaagctgaagaaaggaagtgtctggccaagaagctggcgggagagtagaatcaggaaccagggcctcctcgtatctggtctcacgcttcttccgtggtgttctttcttaagttgagcattgcattctccttggataggatggatattttcctgggaaggatgatacatgatgtatttatccataaaactgaacaggtgttatgtgtgccttttctaataggaaagaccatcatgctatgaaaagagaggaaggggagaagaaatggggtacgttaagatctcagaatgagttgtggggctaaatgttcagcctgtctcccttttctccttgccacaccactagattatattttctagactctcctggtgttagatttggccttgtgacttccagccaatggaatcggctgcaggatgaaactagtcttgatccctgaatgactgcgtggagcacatctccttctggtcaataaggcatttcaggagtgagagataaacttctattgtgttaaacccctgtgactttgagacatatctcctacagcaggtggagttagcttaactaatgcagaacgataggactggtgaagcagtccatctgttatgagagctattctttttttttttttttttttttttgtgagatggagtcttgctctgttacccaggctggagtgcagtggtgcagtctcagctgactgcaagctccgcatcccaggttcacgctattctcctgcctcagcctcccgagtagctgggactacaggcgcctgccaccatgcccggctattttttttgtatttttagtagagacagggtttcactgtcttagccaggatggtctcgatctcctgacctcgtgatctgcccgccttggcctcccaaagtgctggcattacaggcatgagccatcgcgcccggccagagggctattctttgtcttttatttgctttgagtctggtataaccatgtggcacatacccctgtacatgtttgccaagactgctatatggtagagcttggaattcttaggagctttatcaggtaattgcaagtcccccacctcyaasaaagcactctctaggtcaagaatcagcaaatgttttctatagaggcccgtaaaattaatattttatactttgtgggtcatatagtctctgtttcaattacccaactctgctgttgtagtgcaaaagcagctgtagacagtaagtgaatggatgggtgtggccgtgtgccaataaaactttatttacaaaaacaggcagcaggccagaattagccctgtgggatgactcacatgagcagagagttctggcatcaactttgttcggagagatactgacatacttctactcaagtaagtcaatgtttctgtctcaactggttgattggaacaacatacaaactgacccttaggaaccttctaccaaaaatatcctgtgaatcttcatacttttgtaatagcgtttagttagaagtggtcagactttcttcgtcctcttttcgtgatttcctctgtggtgtctgtggatcgataccggcagctcaggtaaggaacgtgtgcaggggatgtaacagaaaggagaaagacgaggaagaagggtgcatggagcgtgcaggggaagaactgattcttttttcagttaatcggctcatcaaggttctggtgttgaagtctgatttcatttgccatgttaagaggatatggacagatactgggcaaaaggaaaaaaaaaatattggatccttgcccagctccaagtgttgctgagtcccttgccccctccaccccgctctgtcaggagccaagctctggccgcccagtttttggactttgtaactgtttccgaacggatcagattccatctgaattgcagatggctttagccccagcagcagaggctgccatgacatcggcatgcgatttcttccaggacttaactctggagagagctccatttcctgttgatcatgagggttttacaggcacaaacgctgtcttctgtcactctgtcacagtgcattatgtcagaatagaggaagcagttcagcccgtaaatctgtgccaccggcacgcagggtgttgtgttgtctccaatgtgccttgtcaacaccacagggctaatagcagtgtcagggtccccgtgccatgaatcacttcacatctctggctagtacagatctctccctgtcactagtggaagtcgcctgcactacattcagaataggggccaggcgtggtggctcacgctgtaatcccagaacgttgggaggccaaggtgggaggatcacttgaagtcaggagtttcagaccagcctgacaaacatggtgaaacccagtctctactaaaaatacaaaaattagctgtgcatagtggtgcatgcctgtagtcccagctactcaggaggctgaggcaggagaattgcttgaatccaagagatggaggttgcagtgagccaaggtcgtgccactgcactccagcctgggcaaaagagtgagactccatctgaaaaagaaaaaagaataggcacagacaatttacctggatcctcacattgcaatgctgaccactccggaaggagtgtagaagttgcagctcatgcctgcattccaaatggctgccttctgcagtcccgtcagccaggatccctctcatacaaacaccttgactggccgagaaatgcagatgctgtgtcaaaagttcatggctcagagccaacaatgcactgtgctgacctccaattttccttgaggaggggcatcccagggtcagaattttatgcaatgcaagcttgtccacgatggcatgggagcgtgtgggaatgtcaagatgaaccggggctccgggagacatttatggagtcaggagcacacatacattcctggttctgtcagcatttccctaggcgagatgagtcacacatttatatttttacatatgcagcgcgcttgcaattttccactggggaagatagaaaaacttattgaaaatagttaatcagttttacaaagatgccataggtagaggtgcttccagacctatagttttgaaagtcacctagaggataccagtctgactcagagctttatgaaggcatattcctaatatcctccctgtgctccacgaagaacaattggtttggacatgaactggtttccatttttagactccaggcccacagtattctaagtaggttggggctgtgctgattgtaccactctttggattttagtggattttctttttaggatttcatgtaagtaacctgtgcagagagtgaggataaataagaacaagaatgacaaaccgataggctacttgacatcattccttaattccaggtcactggcggacatcactcattcatcagtactctgtttttctcccaagaatggatctgactcttgaattctctttaatagagtgttctgggaggctgttaccaattgaccagggttgatgcacatgttgaaacatctttgccatttcttgatagcttcagaagagattttaaagtactattattttgatgttgttagctttcaaagattaattccacagagatttttgggcatctttttgataatacacattatgcttgacttgggagtttcaggatgcgcaagagactccttttgactgcaaggactcagtaaaacaaagtatttcaaggtcatgctacaaaaagtcccaccaagagcatggtcaggaggtacagtgcacttacccacacggatcagagagggatcagaggaggctggctggggaaatgatcctagggctttcttaaaggacacagcgccatggttatttaagtacagcttttaaggagaactaacttgccactttgatagcagtataggactccaatatttctcatttgtaattttcagaagcacacgggaggtctttgaaayttaatgtctccctgcatcacaaaccaaaagacgagtcagtttataagtaggctgtgcttattaactcagtcctggctttattgattgctttaggttccatgatctttggcatgtgagtggttttgctttgttttgacaatgatctttttgtaccttgtatcgggtaggttggaatgtgtttgaaaatttaagaatattttcctagcaaaggcaggatttttcaagtttgttcatgctggagctcctgccacgtattttgtccttttttcttttttctagcaactctcgagaggatgagacaaatggattgtgaaactggaaggagggtttctcattttttaatccattgttttagtgagagtttaaagctttcctataaaatatgtgggttgagaaaaattggaaaagacctcttcaaggactttcctctatgctccctcatgtttcaagtggcttttttgcatgatggtgcatatgtctttgtttctgtacagggccctccatgttcagaggcagagtaacgtgaattcatttygcgctaatgagagttgcgatatgtcggcccaaactctctgtgtccttttcttcttgggctgatgaacttgtcaacttttaaaaaatgtgctctccaaaaatttccagcaggactttcccaccttgctgtttaaacagtgaatcagccctgtgggctttgctgcttacaacatgattccggtgaaaccacaggtctcgtcatgtcccttctgtatccatggtagtcccagtgggaaagaggtaacaaacccaaattgagtaatttcaagaaattttaataacaaaggggctattttataaagggggggtggtcaaggtgtagggaaacataaaagagagcgaatttctggtctggtgctgtgggtcacgcctgtaataccagcagtttgggaggccgaggctggtggatcacctgaggtcaggagtttgagaccagtctggccaacatggtgaaaccccgtctctactaaaaatacaaaaacttagctgggcatggtgacaggcatctgtaatctcagctmctcgggaggctgaggctggagaatcacttgaacccgggaggcagaggttgcagtgagccaagatcacgctattgcactccagcccaggcaacaagagcaaaactctgtctcaaaaaaattaaaaaaaaaaaaaaagaaagaaaattaatttctcagaggtagtaataggggtggctgtcaccatccttggccaaggagagggagcagatactggagacagttgaaggtgccaggatggagaagactccttggaaggagctgtaacctttggttgaggaattcagcctaccactggtaatactccctctccccaggagaggtcccagcggaataaacatccccgccccttcaactctttgccattgttcaagccctgctagaaaccagatggcaaaaggaagttactgatgtgttcatattggtcaactttttcaggcacgaagaccagtacagaaggatggaaagtgcatttgggtagggaaatgggagattcctgcatagctgtcaagttagtttcttcccagagagaaagaccggtggctgtagtctgtgccccactcccagcctgtcctttctcagccgtggcttgtgtgcatccctggggccrgcatgttgctgcgagccccaatcgatcagtggagaaacgagctctggtgggcagtcaggcaaagcagatacacgtgcttcttttcagctttgttggaaggtttcattttgcttcasgaactaggcaggagaattcctgagttcctgtacaacctgagttctctgttaaaacaaggaggaagtaatcatcctgagttcgatgattcagagtaagccatttaacttgtagagctttgggactaacaatgatccctttttggagtccttaattactaaaattatcagcatatttagagttctgaagwtgctgaacccttattgtatctccccagggttagtgagtaattgggaatagtgttccatcttggatgcccccatccactaaccagctttcctcttcgggtggttctaagaattctaattcaattagaaggccttctttttagtttgattagttcaatatcaagagctaaatacattagcttatatatatgtctgatgaactcatctttgcttccttggatccccaagatagaatggccctaatgcagtcaaaccaccctgcagaatcttaacagcaccacaaatattgcatccaggcatcctgcccatgctggcttgcaggctggggatccctgtccatagcgcccatggctccaccaccagtcaaaggtagtggggccagcagtggactcctgtgtggttcagctctcaaaaatgtgaactgaaagacacagaaaaagacttgtgtttggggataaatactgagactgagcagtcttgtggattcaggaattgggcatccagttgggaccctttgcaagaagggtgttagggagcagagagcatgagtaagccggaagcagagcaggagagagaatggagcaggtgtgcaaagagggcggtgagatgctgagagtaatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacrgatggagggaaagagaggcgggggattccaggtacagtggctcatgtctgtaattctagcactttgggaggccggggcgagcaaattgcttgaactcasgagttcgaggctagcctgggcaacacggcaaagscctcatctctacaaaaaatacaaaaattagctgggcttggtgacagacgcttgtagtctcagctactcgggaggctgaagtgggaggatctttagagcccaggaagtytaggctgcagtgagccatgaccttgccactgcacaccagcctgggtgacagagggagaccttgtctcaccaaaaaaaaaaaaaaaagagagagaggttgagctcaactgatcagcatctcagattaagggcctccattccccccatgctttgtaattgctgcctgttttccatgaagcctgactgtgcattggttctaagtcatgggctctgcaagatcctccttgtgccttgagaagggccctgtccgcagcctgaggagcctcaactgttctctgcacgacctagttctgggctagggaatggctgtctagcttcagtggatttccagrgtccggagctactaaaggtcaacagctgtgttaytgcaaactctgtggcctgcattctatcaatgccaaaatgcacatcacactgacaacagctctttgtttacaccggggagcccccaaagccccagggtaattccatcaccacccaagttktaagatggtagagcgaacaggccagaatgtgataaagtaaaatgaaagaagaaaaaggaggaaggaaaaagagagagggagaagcasatagaggaaagaaggaagaaggaaggaggaaggagggagggagggagacagggaaggaaggaagtctggcaagagggcacagtcagacctgccaggatccctctgctgtcttaatcaagctttgcctcagtctttctggactgaatttgtctctgtgttcacttggcattttttaaaaggagacaaaacaggtgatgaacacagcatgagtgatttttcccttaagagagaggtgtcatgctgagaaagaagaaccgacctccaggggagcttgtcttcagaccaaaaccctggcaaggacagcctgtttggatcttggtcattttgttagatttataaagtgcctttgaacagagcaggacactctggggacaagtcaaagcatggcagccttcagcttcccaaagaagagttgtggagaaggaaaagtgaaggaaagtaccttactaagtcattgatggcacattcagcccttgtcaaagtcaaagaagaaatytggagaaattctcaccactgtgcttaggagtcaccctgaactatttcttggatgaaattaccaccctcccacttttggcaatgagacagcaagcttggaatttggagtccatgttaaatccaggtcccagccaggcacagtggctcacgcctgtaatcccagcattttgggaggctgagatgggaggatcacttgagcccaggagtttgaggccagcctggtcaacacaaggagacttcatctctataaataataaaaaaattaaaaattagctgggtgtggtggtgcacacctgtagtcccagctactcaggaggctgagatgggaagatggcttgagcctgggaatttgaggctatagtgagccatgattgcaccactgcactccagactgggagacacagcaagaccttgtctcaaaaaaaaaaaaaaagccagattctccacctaccagtggtggggccccttgggtaacttgttttcactccctcagaacctcagtttcctttcctatacaacgcaagccataaggttaacccctcctcgtggtgatgttaagatgaaacaggaaggtgaggggcttaacacatttccgtgttcccataagctttcaggagatcttggtagttttcatctcggtcttcattaccatcatcactgcttcagactcctgtccatgtggggccctgtggtcttgcgatcacctccataaatgttcctttgttcccgcctaacacaataccagccacaaaataattctcaacacatattcattagtggatgcaggggcgaaatgaaactcagggggttgggaaactcacctgaaggatcttctccctctccccactttcaggctctcctttcacacgcatgcattaattcgttcattcttggaatctacccacctgtgatgtgctagttactaaagatgcagcaatgartgaaaggtaatcctgtccttgaggcattcacaggtaaagaagcctgcttgggacattgggccgtgagctccaacaatgtcactattcttctaggctttgtggacctttggtcaccccttctgtaagaccaactcccttatctgcctgtacagtgttctgcgaatcccggtctctactaaaaatacgaaaaaaattagccaggtgtggtggtgggtgcctgcaatcccagctactctggaggctgaggcaggrgaattgcttgaacccgggaggcagaggttgcagtgaacccagattgcgcctctgcactccagcctgggcaaaagagtgacactctatctcaaaaaaacaaaacaaaacaaaaacaatttggctccagtgagctcattttacgttgtatgtaccagtatgcaagtgttgtatgsatgtgagcgtctgcgtaggtttttatttttctctctcagaatgaaaggtttgattcgtaccagctccccatcccttcccacgatcccatcttaatgtctgttgtggaagttggcccacagaagcctcaaggctaaccaacaagaaagatcacttcatatgcattagctggaaggtaacaagaggaaatcgcctgccagggtccctgactcccggaggaaagtgtcctctgagccctccttgagggacataaatagccccaaaagtcactgaatgctaagttggctttctccccaaaccttctaagtaggcaatcaggatttaacgacccgcaaatttccaattttttagtttatgaaaaaatatatctacatataatttttgcctccattagagtctcatctttaaaaaaaaaaattattcagtgacttcctccctctctttccaatgaggaaaactggactatttatgctgcattttaggctttttttcatatataatttttcatataaatgcacattttccccttctttcggggaggaaatttaacttttgtggaaatgtgatgtgtgtttaaattaccaatttcataggcaatatgtctgataattgcagagagatactgagttaacttgtagcaatgagtttctgtgacaaagggaaatcagtttgtttgcagtaagccgaggataacggcgccgaaactttactatttgggggtggggggaggttggggaagggaggccctgaaattgctttttataattaaaaagggaatctcagatgttttatatcttgaatatttacaataaaacctttaagtgcttgtcaagagggtaatgtgtcattaactggggactctgcctcgcctctcctctcggacatgacagtgcggctggataagagaagagtaattatagttcagcagggctgccaggtgtgataaatgactaatcagcacgcaggagcctcagtcctcaaaggaggactattacagtgttatcagctgcgggcctgggtgtacggagccccgaacagggatggggacaggaccttgcgctgtgcggcttggcatgctgctccagagtgagcccatggctgtctcttagttttgtcaccggcggctttatgtggctgccacggggggacaggaaacacacaggggctccagcaatctgcctggtgctaatatttatataacacactcgccagactccatggcctgagtccgggggtggcttttcggggtgcagcttggatggcatcagaacctgcaagaagccaagacgcctgttctccacggcggagcccgctggtcggtcactcctgttcctttcgtgtccgttgggtgcaggcattatttccagtgtatgtgaccgcttcccccgtgggaacagtgtggcattgttccctgggcaagccaacagctcagccctgtcctagagaaccctggagctacgacgagggtaccctggacccctgtcctaaatgttctttgactctgcttagccactgaggatgtttgcatttgattcatttgcttattatgatcaagaaacgttacctgtcaacattggataaaccatccgagggaaattaatcaaaacccccttcagacaaactgcatcacatcgattctctccttataggccttcttgttttgtgttctctgtgtgtgttttttttcccctagcgtgctgaagggtggcattggagtaccatttaaagaataatttttaagaaatgaacatcaggacatagacgtctgaatatgaggaagtgcctcatgtgaaaaaggacgtaatgtgctttaaagaaagaagaaggagataggacgacacttttgatacaaaggttatttttataatacttgcatttttatcggttcacgtattttaacagggagccctgactgaagtcacaaaaattatgactccggcaccgaggtacttatctgacaaatgcaatgcgaatggtcttgttcttatcaatgagatcagatttcagaaatgaatgcgaagaccgaggcgttgctttgtgcacagataaccttgcaggcgcaaactcccaaaccagaataaaagaattctctatgaaataatgggccaggaagcccaatcgcgtcacactgtaatagacagtggggggtggaatcaaaagggggaaaaaactcatttcatctcagttaatggcagggaaacgaaggcagagaaggactttctttggagcggagctggtacgacaaagagcagggtttcgccgtgtcatgcaccatttgccgttgcactagggctcttttcaggagctgtgaagccattattataatgtgaaaaaggtggaaagaaatactcccttctggacactggaagggcaaatgaggtgcaagccttttttttttctttcttttcttcttcttcttcttcttttttttttttttttttttgkttttcctcccagcctctctcctttcccattatgcacaatgcgctgagaaaggattcccagtccccctggtaaaaagtctgraggatgccgaggagttcactgtgcccttagataataacagtttgtcttggctctgatcacycctttttgtgacttagctggctgggaagtagcaaaagtatcttccaagctcagcttctctctgcttgcattctttccmaatacgtgattccaaagcccatgcccaatccttgcactgaagcttttagcaggaaaggtgaacagaggcatctggatgcatcgcggccagtctgccccttgcccaattccctcccctctcctgcgtacaggtcatccctgagaagtgtgcctgtggactgcgttctttggggtaggacatggaatgggaagatgaaaagaaagccttcctttttctgtcctcagccgtaagaaagaatggtttcttcacagtgccgattggtaaaaccaagttctttgtaaattatggaacccaagctggaacttggagagcattcttctaactgaagataaatatggttgccactgtctttataaaaaaaaaagaaaaagaaaaagaaagagagaaagagaaaaaactgcaaaaccgcaaactggcttgttcttatgtggttgatggggacagcaagattacatatatagccagcatttgattctcaggactggtaaagtgtgaagaacagcagtgacattctagtcttcaataaatcactataaaaatgtttatgaaccctgcaatttactgtcttttatatgcaaattgaaaggggcatcattgcaagtgtaaaggagacccgaggtggcctgaaggaagtgtaaaatgttgcagtaggttttggagattgtgtgatcttaaatgggatcatttccaaacgattttgcgtttatacctctgtgacagttcgattaatttattaatgagattgctgtaagttgcagggaagtagaggccagcttggagttaaagggtggctttgaatgaaatacattttcatttcactgaaagaagagggaaactggtgattccaaatccagatccaaaaagttattttggcaaaatgaaatcagaacgtggccccttccatgaaagtcagctcaggcgtagaatgttcttttttttaattttttttttaacgaaactcacatcttctttaaataaaatctccatttagaaatttttgaagacttgtggatagaagaagtaaccttgaaaagggcagagctgagccagacmmcttttcagctgggtgctccctggaagatggatcttgccttgtggatgtttttctaccgtgacagaagatagaaaggatgaaatagaaagagtgtgagtgaattctgcacccaccmccrccccccagcttccccacctgtaaaatgatttgctcaaagtttgcaaagaatggaggcatattcaaagtgctcagcactgggccggacccatgggtatgmattcataatgatcagcttcattctctccctttccctctctctccacacctttccattcctcctaactaatgtgggagagaagagaaaattacagtgagagatggtggtcagtttacaacagtatttagatgagaattaagattatgtccattcagggagactctagtgtgctctacatccccccaaaatgtggggacaatatggcaaatatggccaggtacagtgacagaaagtaaacagcccatgaaaacaggttgctctgcaattctcccaactgttcccttcccgcttcccacctgcctcgtatggaaaacacccaaagtaggcactgtttatagagccatcgcttgcagaacatctccccggcctccgacatatgtgccataaatgctgcagagctgcgtccacagtccctgctccggagaagagcattttgcttgttttcaaacacaagcatcctctcccgcgcctgggagggcgaggtgcggatcttttcgccttggcagtccctcgctcaaatgtgcgtctctggcaagtcctgtctgctgatagttgatagtgctgccacagagcggctgtcagattccaaaggcatcataccatctgcttttccaatcttctgctcttcaatgtagacatatgttcgagtggttcgtgtgtgtgcgtggtgaggggggtgctattttccgggggaagaggaggaggagaggatgcttaactccaagagtcctcaaagcaaactgaaataaaattttaagtgatgccaaaataagcagtcccagcaagacatgttataatataaggtcctttccttaaaaccatacctatatcagctttggaaataacgtacctcttaactgcatggaaaatctagaagattcgtggcttgggtctgtttctattcttaccacggtgacacgcaaaagaattttttaaaaaataggtttgttgttatttctgtatatctgtatgggcctgacctcccttttctctgggctttctactccagatttttattttatttttacactttcattgccctttgctctttctggctttcacctaaacaatagcatgtatatacaacagtacctataaaattgacgctcgtgtcactgatcatgccaagaaacctaatgtatggtgaatttgcactagtatttatttcctccctccctgtctctcccctctcctcccctcccttcctttccctcctacccctctttctttgtattattcccctagaaggaaatattcaagctggctttagagaggatagcaattgtaaggtcaaccaagtatgggatggggaccggaatagattttctctgcagatttcacgctgccttcccgggaatttctgaatgttttgcagcctaatgtttagcttccaacattctttcttttttttttagacagagtttcacccttattgcctaggctggagtacaatggcgcgatctcagctcacagcaatctctgcctcctgggttcaagcgattctcctgcctcagcctcccgagtagctgggawtacaggcatgcgccaccatacctagctaattttgtgtttttagtaaagacagggtttctccctgttgttcaggstggtcttgaactcctgacctcaggtgatcccgcccgcctcggcctcccaaagtgctgggattacaggcatgagccatcgcgcccggcctagcctccaacattctttaagaaaactgcaccatgagtaaaatggggacgtttttctcttctgctgggacccaggacatgttggactgcacatcagttcattctctctgatctaaggtgttggctgctcttctcccttctccactgggctctgagcttcttgagtgaagggtctgtgggttttcacgctttgtactcgggcccagagcagagcctactgccttcacagaagatgctccacatgtgtttgtagaaggaacttggaagacagtcagttttaaagattttttcactgagggactaagagaaatagaaacagaggggattggccacacctgaagtcattctgtgttcaaatcttggctctaccacctatgatctgggagctsttagaggagttaatcgatgtagttaagactcaatttcttagtatatacaataggtgtaatagtaaaaattagatgactttgatgtgtgtaggtaagcggctagcacagtgctcagcatgcatgaaggactctttcattatcgttattaactgatgtttttaacttatacattgaaakgtggaaacaagcsttgcttctattgaatgacttcttgaaagtgccagtctgatccttgaccttcaggtgcatctctaaattctttcatgtcagggtctctgaaatctgaacacatctcaaagttcccttatgcctggcaggggcggtgtccgactttgttattgcctatgcatgtataaatgtcccaaatgccagcaaccaaacttgcaggatgggtgttgacagattccaggaaagtcccagatgtaacagcggaatattccaccttctaggaaccaaatggctgtgaagtggagagacaggcagagctagaaatattccggacgtggaaatcaaaagtaggtttgcgcaacacaactgcagagccagctcaagaacccagcgccagtggctgatgcttcttctttttttttttttttaatggattcttctaaggatggctgcatcagccaggggcagcrggtcatacctgtaatcccagcactttgggaggccaatgcaggcggatcatctgaggtcgggagttcgagaccagcctgaccaacatggagaaaccccgtctctactaaaaatacaaaattagccaggcgtagtggcacatgcctgtaatcccagctactcgagaggctgaggcaggagaatcgcttcaacccagaaggcggaagttgcggtgagccgagattgcaccattgcactccagcctgggcagcaggagcgaaactccttctcaagaaagaaggaatagctgcatcacttatgctcttgatggtacagaaaatgatcygcatggaggaaatctagacatcagcgattcagagtcaaaatgttattcaggggagagagacccttcatgtgaagaaattttaggaatactttaattattttttcacttacattttatagtatttattgtatgcaccagagtgattggtgataaaaatggaggcctacttaagtctaagagagttcttgtgaaagtgggagggggatgagggttggaaaattgcctgttaggtgccatgttcactattcagatgatggatacactaaaagtgcagacttcaccactacgccatatatgcgtgtaagaaattggcacttgtacccttgaaatacataaaactttataaaaaattaaaaagagttactgtaatgattataaaatgaaaattctacgtcatgagaaagcattgtgccatattttcaccgggagcatttttttttccttaggggaaatgaaaaataatggcatctatgatcttagatttagtaaaacgcagtatcttcttccccagctgaaatagcgaaagggtctcttcaggctcctgggataaaaaccaggatscttcatgtgtctgagcaggcytcccaccatttgactgctgctcctttgtccagacacatttaacaccatctccctgcaccccttcactgggctccgaagctgcgttcacacggcacgtcattggcagctcatctcagaaggttccagctttgcctggcaaattctcctccttcctttagatcccatctctggtagacagagtaatgagycccgaagatgtccaggccctactcctaattccatggaacctataaatatgggaggttacatggcagwtggggaattaaggttgcagatggagttaaggttgctattcactcatcttcagattgaaagatcatcctggattatctgggtaggcccmgtcgaatcagagatggggaaaagagaggcagatgggtcataatcagagaggtggctgagtaaagaggacttggcctgatgttaccagctttaaagagggaggaagcgtccaggagccaaggaattcaggcagcgtctagaagccagaagaggcaaggaaagagattctstcccagaacttccagaaaggcacraagccctgctgacctttgattttagcacagtgatacccattgtggccttctgaccttcagaaaataaatttgttttaagccactaatttgggggtaatttgttacagcagccagaggaagctaaggcaccctataatataccctctaaaagcccctttcttgggaagttctccagccttccccattgactctcagaggaccctggacctctcttccatggcattgccatggtttgtcatgttgcacttatttgtgtgatgatttaattaatactcatctgccccactggacgtgggcaggaatagtgtgtggttcaactatgagattcctagggcctaccaccgcctggggtccaagaagagctcagcgagtatttgcagagtgagtgaatgcaggaaggagtcaataaatacattaattaattaatctgcaggagaaagaagggcaaggtactatgaactttaattaaacacatatcccacatccaggtgccagtcagggagctgcgatttaatttgctgctgaatgcacttttgaataaagggcctagaagatgcagtctcgaggaacsgaggccggttagagacaggctggcagctttgcctyctctcccaagacaaaggcctccccgcccccctaaatccagcacacaatcagctgctctccctccccctattctcagcaggagagtcaggatgcatatttctttaagggatgctgttgagtttcttctggtggagcgaaggatttgtagcaaaacccagcatgtaactcgagtgttctgtgaagccagatattggtgccaagctaaatttgtgcgtgcagcttctgtttaaggcaattatatagtgtgtaatacccagtagmgaaattaagtcgaagtacattttgcccatagagattatcctctcagttggatttattttaaacaagttttgccccttatacattaaggtgcatgcaataaatcacttatgtaataaactactctatattatgtgggaaaaaaaaaaggagctggtggcagggggagagayttcaaattgagcyagacctcaggcatgaagggaggggagagagggggaaatgtggaggaagggggcgtttgtgcagtgggaagttggagaaagtacaaatgaaagcctctctgcagtgaacctcatgactgctttagagaggtgcttatgtaataactgcagtggtgtcgctttagaaaaagttacagagcttgtctttctagagcaacctcttggcttatcttaattaccagcagtccatagtgagactggagggaagaaaaaaagatgtaagcttttattaaatagaagaaaatcaggggcagaggacagagggtgtgattaggggtctggggtaaccacaaatctgggcaactggaatttattgtaatggtaaattacactaataataatctggggatgaaaacagggcaggcagtgaaacctgaatctcagctggacgatgaatgagttttaatgtaagtgtatcgacgtgctgtactcctaacacattatttgttatctgaaatttagatttccttgggtgtcctgcctttttttttttttttttttttttttgagatggagtttcactcttcttgcccaggctggagtgcaatggcgtgatctcagctcactgcagcctccaccttccaagttcragtgattctcctgcctcagcctcctgagtagctgggataacaggtgcacaccaccatgcccggctagtttttgtatttttagtagagacagggttttgacatgttgccaggctgctctcgaactcctgacctcaggtgatycacctgccttggcctcccaaagtgctgggattacaggtgtgagccaccgcaccyggcccctgcctttttattttgctaaacctgatgacccttgccatagcagaactaaagtgatgatgatgattacagcagatcarttattttgagctctgastttgcatgaggccctttattaagtgcttcacttgtgtgatctgatttaatcttcacaagcaaactgggacagagggactgtgcctattcccatttcacagaggtgaaaactgacacttagttttcacccgggttctccctgtctataaggggaaaagacagggttcacaccaaggcctgtctggatccaaaacccatgctcataatcactaagttatactmcctcttcgagatgctgatttggaaaataactccatgatgaaacatgtcaagggagactgcctgtactccgtaatgcagaaatgcattagagctcaaaaatctatgctgtttaggaaagaaaaatgatatcgctcagaaaatcatttaaaaacttcctggtgaatgcacccagctcgccaatgcatgccagccacagggcctcayagcacatttcaggagcaagacaattcagaccccactcttccccctgaaaaacctccttccagaaccctcttttgcagtgagcagagataagcctctccaatttacatgtttgtcattctctaactttgagagcccaataaaactaagtgcttagtgagaatcagacatggataagctgcttgtaatttatgatttaatgcagcatagtataaaaataggcaatgaaactgaaaggcaatcaaagtctattgtcacaaggaatgggaggaacggggacgtgatctaacatttgctgagatcctgctgtataccgggaacagaacatatatggtttcatttcatcctcccattatcaccgtgaggcctcttccgcttatctattgctgagtaacaaggtgtacccctcaatttactggcgtaaaacgacaacagttttattacatctcatgattttctgggtcaggactctggatagggtttggctggttgagtctcctcttgcagtggctgttgatggaggtcatttagtggaatccagttggcaggagagctggccttggagggtctaggatggcttttgtcacatgtccagggctttgtcaggttagcagggcagggagggctcagctggtctcagctcgtggctgctccagcaccgtggtctcagggtgattggattcttgtagggcagctgtttcagctacacagcagaagtggcacggccttttctgacttagtctcagaaggcagagggtgtcacttccactgcatctttggggaaggcagtcaccactgtatagtcctgagctcactgggattaaggggaagggacacagactccacytctcgatgagaggagaagcgaattgatgggcagattttatcactgtcctggggcctttgctctttgcccttccctttgccaagaaagttccctgtactctgcaatgctgagtacttctcatccttcaggtctactgcaagtgtcacytggccaacacaccatgccttcccagtctctggtgttactstctgcatactgtagaccatcatcttgtttgcatacttgtctgttatctctttatcatccktctacccacatcaggcaattccaagagagaagaccactggttttgtttgatctagtccctgttgagtccctgtgcaccttcagaaccacatctagcaatagaaggcgctgcacggggaattctggaatgaataaaaacgcttggcagtaccgcatggcgagccaktacccgtgaatgctacttcctccaaagagaattcctgggataacagagaatccattcatggctgccaggaggacttggatatttctcattttccattggccctggagtggaggaacagagccgaaaagtacgtggggggcaggcaaagctgcggtcagaggcagaccctgttggtgttggccgtgtcaascagctttgctggtttctattatagccctggtgtggcaaaggacactgtgtgactgtgagctcaggtcagcattgcgatcccttcaggcctctggcttgcaggttcctgttcaaccctcttaaatatgcttttgaagcccgtacgttcggtccacgccaactcctgtttatactggtgcgaagtgatgcctgctcagattctgggcgtttcacgggaaggtattaaatgtgttttgaaaatacttgaaagtccagctgtgtatgctttattttatatttagccttaaattagagactccatatacctcaagtaataaaaaggcacagcaggcacttgggttttccctcagcttgctggggccgtgcacctatgtgagattttattatttgtaattttgggggggttaatttcacagcttaattctggcctttatgcatttagagctcccctcttgtgtttcagaaaggaggagttgttgttttcttttcacttgagtttaataaatgaaaaaggggaagggagagggaargaagaggaaaaagcacaaatgtgcttgtttttggatcagcccctgtactgggcacatggatgcagtcagtcctcagtgtaccccaggaaagaggaaactgagtctccatgtggctttctgtctggcctttctcttttgcttgccttgtgctttgaatgcaggcctgmtgtttgcctgtggacctcaggatttgtaaggccatctccacccacctacagctaagtttcccaagagccgatctccagccgaagtccaaggttccttgatgacccctgggaggagatgcaacacacagtttcctagaatcatttactccccaggctaagcacagtcacagaaatgaggtagctgtagccaaggatgatggcatagcacattcgtttcttaggcgtgccacgtactaggtggcttcastcagcagaactgtaytttcccacagttttggaggctcaaatttgcaagtcgaggtttcggcaaggccatcctctctctgaaaactctatgggggcgtcctctttgcctcttcccggcctgtaggtatttcctggcaacctttggtgtttggggcatgttgtcacctcattgccatctctgcctctgtcttctcaccaccatcttccttgtccatgtctctctrtgtcttcartgttcttcttatarggacaccagtccttggatttagagyccaccctaattcactgtaatcacatcttacctaagtccatctgcaaagaccctatttccaaataaggtcacattctgaggccctgggtggacatgcattttagggaccctttcaggccaccatatatggattccagagtgaccagtagaacatagctcaggccaagagagaaactcaaccttggtgaagttgcatgagaacagaaggcagccctggtccctgggagaaacccatccatactctggttacccactggccattcctggggacaggcggcaggtgtttagtcccctctctgcaaccatttgcggtcacctcttatgtgctaggcctggtgctcagcgctgagtgaacccatatcaacaaggcatggtcactgcgctagggaagtccctggtccagtggggtgagggtggcagtggctggcaacaaagacaatgagcgctgagattgaactacagaaagcagaagatggggtgacaagtttggcctgcggcaggaaagacttcccagtctttaaggataagtggcatttgatgagttgcacaaagaggagacctgtcctgggaatggaggagaagatgtgaagcgcgggaagtccagggacacacagccgtgcagagacccgggggcctcagcaggttagagtgtctgcatggcaccggcagaggatgaagacagggctggggaggggcatggggttagcctaacaagggcatcaggtgccaggttagagtttcggtttctaagctgtagataacaaaaatttcttgaatgcttttagcccctgatctgagttacgctttttttttttccttccattttccatccaacagacatttgtgaggcactgtatttgttttcaattgctgctgtaaccaatgattacaaatgtaccgtcttaaaaacctaaatgtattatctgacagtcccataaggcaggagtccaacacaggtctcactcggctaagatccaggtgtaggtggggctgggctttttctggaggccctagagggcagcttgtacccttgcgtcttccgtttcttagaggttgcccatcttcatggactcagggtccctttcctccatcttcaaagccaacagcacctggctgagtctttctcatgctggcatccttctggctctctcttcagattccctcttccactttaaggacctttgtgatagttttgcacccactggatgacccagaatcatcttcctcttttaagatcagctgattagcaacgtcagttccacccacaatcytcatttccctttgtygcgtaacctaacatattcacaggttctggtgagtgggatgggggtatctctaggggaccattatccagccttccacaggcactttgtcacaggccaggcgctatgccaagcagagaggtcacaatagcaaatgacacagacaagatccttgcacttccaaaacttatgttccagtgagggtgaagggcgttgaagaagtcaacgagaaagtcaagtttttacagtaagtgtaagttgtgtgggtgaaataaaaaaggttctttgctggagaataacaaagggagggacttacataaatagagtaatcaggggagggcccctgagaaactctaaaacatgaggaaagggctcatgatgtgaagaactggaaaggtgttccaggcaaaaggaatggcaaacacagtggccctgagacactcagagaaatcactcaggctgccttcgaaaggatgtattggagaagatgaggccaggggattgttagtaactgttgcaaggatccgggagaaagatgatgaaggccttgtagggcaagctggataagagcacccaaaatatccataaccgaatccccactacataggcatgctactttatatggcaaaagggaatttgcagaagctaagcactttaaaattattatctccttaaacctcactgcagagttataaggaaagcactgttatcagatgaagaagtagatttcatcaagtgactcacccggtatcatatagctgcttagcggcaaaaccaggatgtgaatggagagctctttctcggataccaaagctatttaatatttatcattgactaataatggtagagaaagtaatcatcataacctctgccctttattagtcactcatggtgtcacaagccctttacaaagcactttgcatgcaaatgattcctcataacaaccttgggaggtagttactttcattgtattagctatctcttgctgtgtaagaaattaccacaaatttagtatatttgttatctcatagctccataggttaaaagtcctggttcaggctgggacttctgctcagggtctcwtgaggctgaaatcaaagcgtcagccagggatggggtcttatcagaggcccttggttaytaacagaattcattttcttgtaactgtaggactgaggtgcttgttttcttgctggctgttgactgagggccccttgcagcccctagaggctattctcaggctctcaggccctatccacagatgacctcacaacatgactgttggcttcttcaagactgaaggaggctcccccatgctctgagtcactctcttcagygagggcccagccccttttaagggcctagcgattagatcagtcccacttaggattgaatcccttttgattaatgcaaaaccaactgcgttcaggcctccatgacatctgcgaaattcctccccctttgcttggtagcctaactcactcaggggggcaaattatcccatcatattcacagttgccgcccacactcaagagaggggattctataggaaatggaagtcttgggggccatcttgaatcctgactaccatagtctgtgaaatcccyatttcacagatgttgaaactgagacttagaagcattatgcaccatgccaaaggccatggaaggacagagcttgggcatgcycccgacaccaggtcatactgatgtcactctccctactcccttcactccctccagcacctggccttcacctgaaggtgctgaccttgctgtttgttggtttcagcaaacaaagggagatcacagcacctgtcccaggccttgtcttccagccccacaaacgtgcacctgcagccggagaccagggggccccgatcaggtggcagggcctttaattggagccacgtktgtataatgagcagcgcacacacacaaaggcgagctaaaaatgtctccacccttctaaatatgggatgccttggccaggtattgagtcagctctgtgacgccagtgcarttatcccgattcagcatcagatttattcaccattaaacatgttctaacttgattgcaaacaagccttgtattatttagagggatccacggagctggcagagggggcagaggtgtccgcaggcctcctgcccttccaggcttaatggatgatcatcttccctgctaaaaaggcccattcactaggtgagtgatgtggaactgtttaatgaaagcaggaagatgatgtgaatgccagttcacttgagtgttacaaacggtttgggcactatagccttaaagtttctcctgctctttgcagatgaatgaaggggcgctttctggaatctttgtggctggggctgctgctctgcactgctgtggctcttttycacaaatgcttatggagctctaactgggggcaaggaactgtgctacggttgggaagagaggagtgggcaaaaggagacactggggcttctgtgactttagaggcccatcatcaaattttcttttttttttttagatggactttcgctgtgtcacctaggctggagtgtagtggtgcgatctcggctcacagtaacctctgcctcctgggttcaagcgattctcctgcctcagcccataggcacatgccaccacacctgactaatgtttgtatttttggtaaagacaaggtttccccatgttggccagccttgtcttgaactcctgacctcaggtgatccacccacctcagcttcccaaagtgctgggattacaggtgtgagccaccgctcctggcacccatcaaattttcaaaggaagaaatggaatggtgcaaccatggtacatgggaaggaggagggggacacacaagactgtrcctatcatgggggcttcgacctcatstgggaaggtggttggagagagtgagtcctgacctgagctttggaacttatcaagttgagagagaaatttgataatttgtctattaacgtgtgaccttgggcaagtcattgaccttctctgaacctcagtatcctaggacttcagaagcgaaaggaagaataatgggtcttgagtatgcctagaattgagcaagctgctatscttgcaaaggccttggccagctgctcacccaccatgtccctctgttcccactccaccttactcatgcctagacttcttgctttttaaaaataatccacccatgaaacaagtgtttatttacaaggctggcttccccaggaggctttcacaaatgcttaccgagcatctgctgtgtgccagacaagagtgaggagctggggactcagagaggagcagacgagggagacactcacattagagagtggcgtgtgctgagggaaggtgcctcaggcgacagatgggaccagggcctttaactcagtggcagcttcagagacagatctggaaccccaggactcaaaggacctatgtttgctaatcaagtgaacacggaggacctgccactgggcagggcatccctgaccaatccacaggtgatggcgggacagctccaggccctggggatcccccagggaataagccagattaaagcccctgccctgtgaggtgtggcaaagaaacagacaattcatgaaataaatatatgataaataacatatgagaaggcagggagtggtatgaaacaaatcagggaaggaggagacggagaagttggagaagacagtggattgtttctctgggtggtcaaggaaggcttccaggcagaggaggtttggccatgggtaccaaggggtagagatgggaaccttccaggkacatggacccgatgctgccagcagaggggaaaccatggccctaagggcagagcacactggggcgggggtgggggttcagtgacagtctggtggcctgtgtggtgaggagtgcgggagatgggaacagagagcgagagggcagacggggtcatgttgtgtgggacctcggaggtcctgccatggctttggtttctacttggagagaaatagggaggtttgggcaggctctgagtagaggagtagcacgatctggcttacgatgatttctaacatctcaccatctttacttctgtatataaatatatgataagtatacctttatatatgtgacatgtatctttayatatgatatgtatggttacatatctactcactcacacatccacacacacacacacacacacacacacacacacacaccttttttggaaccattgaaaagttgcagacatcatcacggctcaccctgaaattccttagcaggcatcttctgagaataaggacattcttctatgcaaccatttcacatccacactaagaaaattaacactattacgtagtattatctaatatgccctctacattcaaattttcatgtctccaatcctgccccctttggaacttctgttggtgttcgatctggaatctgagaattcccttgcatttggttttcatcccccatagtcttcctttttttattttttattttatttatttatttatttatttatttatttatttatttatttatttattttttgagacagggtcttaatctgtcccccaggctggagtgcagtgacatggtgatggctcaccacagcctcagcctccctgggctcagtcgatcctcccacttcagcctcccaagtaactgggactactgtsatgtgccaccatagccagctattttttttgcattttttagagatgagtttttgccgtgttgccgaggctggtctcaaactcctgggstcaagctattcacctgctttggcctcccaaagtgctgggattacaggcatgagccaccatgcccggcccccttttttaaaaaacaaaaaaacaaaaaactcttttgtgttttagaaatggggtctcactmtgttcttcaggctagtcttgaactcatggcctccagtgatcctcccgcctcagcctcctgagtcactggaatttcaggcatgagccactgtgcctggcctctgtcaacttccttatctagaactatctttttcctctattgttttgtccctcacttctgaatagttcagggatccctctggctactgtgttgagaataaagtgtcaaagccaacagtggaagcgtggacactgggtaggaggcttttgcagtgctctcggcccgcgctgtccaatagaactttctgcagtgatggatgtcttctatctctgccctgtccagtataaaagccacaagccacatctggctgtgtggcacttggcatgcaactagtatgacatcttaatttttytttttgagatggagcctcgctctgtcacctaggctagagtgcagtggtgcaatctcgactcactgcaacctacacttcctggattcaagtaattctcctacctcagcctcccgagtagctgagattacaggtgtctgccaccacgcccagctaatttttgcatttttagtagagatggggtttcaccacattggccaggctggtctcgaactcctgacctcaaaagtgatttgcccaccttagcctcctaaagtactgggattacagacaagagccactgcgcagacggacatatgaatttttaatttgatatcattgtgatcartttgaagakccacatatggctgagggctactctawtgagtggtgcagctccaaggcagagagatggctgtgattaaccaatgaatgagggaacaaatatccaggcagaatgaatagtctatggaaagggctggaagttccacaaagcaggacgtatacgtgcccttttttcctcccctggtggccagccagcccctgaaacacagcaggtattcggtgcagccttctgttttcttccagatcctttgactcctgccccaccaacatggcccgtggcagactgggctgctgtttgtaagcctggctgaagaaaggcatcacaaagaaaatgccaccagcaggctgggtgtggtggctcatgcctgtattcccagccctttgggaggccgaggcgggtggatcgcctgaggtcaggaagaacctgggagattggaggttgcagtgagctgagatcgtgccactgcatgtcagcctgagcaacagagcaagactccgtttcacaaaaaaaggaaatgctaccagtgagcaggaagttggtggtcctccagaattgccctgttgagggtatctccctgccctggtctgaaagctgccacttgccgcccaccgcacagccccagggctttagctcactgtgcaggaagaggccttcctctgtgcatcstcccacagggtcgagagtgaatgccttgcctttaaaaataaaatgcatacgcctgtcctcatgcgctctgatctgccagcaggctgtgctggggagtggtgagtagtacagggatgtgtctgaccccaggagaactgccccgatccctatcttgtctctgctcagttctgrtaactcttttatcttccctggagttatttttttcccttctttstttctctttttctgtgtgctcttctaagagtaaaacgcatgtccccccatgaagtcactcaaagctcaggcgtgtgcaacagggacagcaaaagcacacacaatgatggccagagacactgctyagtgtactgtcttccaccgggacagcccactcaccaagggttaggtcctgtgctgmctgggtcccgkgtctcctcggaggtcggtttgcatcacgtggatacactaatctacccaagttgacttggagaaccaatctgaaatcagatgggagctccmggaagcaaagcaattgcaggttcatttgttacttttattgtctcatttcttcttatttttttagcccaattgcctcctacatggggaaggttggggtcctctttattctacttttcattctcgctctgccgccctcccaggtgtttgtaatcacatatttttcatttggtttccgggtccagcgacaagaacaccagaaacacctcctccccagagaggaagagaggatgctccgccgcctgtaaggattttttgctctcctccttttgtcagttggcatgcgatatgcttctcaggcagtaatttagagactgtcaattcctgagagccgctggggaactgagcaatcgyctgcatttcgtcgctttarcccgagctgggtctttgagctggcagagaccaagatctttttctgggaagggatggtcctatttaaggaaggccctggattttgtcaagtttgaaaggttttcaacatcttcccgagatggtggtcatgggagtagtggttagggtggttatgacgcatgggacgggagaataccatgcccacccggtgatttataccaaaagatgctttcctggggtggttctgctggcagtcgggcagtgacatgttattaatgttttcctgttttctattgtccccgaatggaaaaacactgtggaacctttaaattttctcaagctgtctatgttttcctggatcgtccctcaattttccgtggtatgaaaaatgtaaatgttgctacattcagttcagggaaatccagccgttgctccagatccttctaagatttttcaattccagagatgttttcacctggaagattccccagatttggcaaaaacaacccaactcctagccactgctttttgagcagctactcagtgcctwagactttgaatagtttattaatcatgtgtcactgcagcaaaggggacatttcggycctgatttcagagatgaaagaaccaaggcatagaaattgagtcactttctggagtgtacacaactagtaagtggattcgagttagttttgctctattccaaggctacttactatgctatttttggtttcctacttttgttcaacttatatttatctgattatctgattctcttttacaagcacttagtgagcatcagctgtttcaatgagcatttatttactgatacctgtggtggcacccaggaaggactaggaatgctctgtgatatgtaggagaaggatgtatccactgggcaaaggtacctgcgagggatcaaagatggaaaggcagaaatccaaggactacgtgtgacatgaaaggggcctttctcctgctgtcatcctgaacctctgtctttcaaatttggatgtgtcgggggccacaggacactactgtgcatttgcctgtgatttgccattgggttggagtacttctcctgagtttctgcagtgttctaggtatggtcttaggccctggarwaagacagtgtaggaaacacagaaggtgcctgatttcctgggcctagctaaggggaaaaagcgagacaatggggtcagakgaagctcagctgaacagatgaagttgagatgaacagaattccagtgccaccatgatttccagccgtgtgaccttccacatgctttttgatttttcttgaactmacttttcctttgtttgcaaaatagtaacaatattttccttccaagtgatggtgaggatttmagagttaacctgagtgtctgctgcatagtaggtgctcaataaactataacstctttatttcttttccttccaatgagaagtcacttcctggagggaagccacctccaggaacagtcctggttcaactcatgaggagggtcactggttgggttccatattcatatctgcaaccagagttggaagcacaccactgtgggattagtcatgtccctagtccctgtctccgtatattttctccttctcttattagtttatcttttccaaaatgggctgtttcgtctctgatcctgatttatttttrttttaattaaataatttatttttctgagacagactgtcgctctgtcgccaaggtggagtgcagcggtgtgatcttggctcactgcaacccccgcctcccgggttcatgtgattgtcctgcctcagactcccgagtagctggtactaaggcatgtgccaccactcacagctaattttagtatttttagtagagacaggatttcgccatgttggccaggatgatcttgatttcttgacctcgtgatctgcccgcctcagcctcccagagcgctgggattacagacgtaagtcaccacgcctggcctgatcctgacttagttacggttacctctctttgtatctctatatgttctcaaattccaacctgtctttgtaatcctctatttaagctatcgattacctccaaaaggccctgaatgtttcagaaagaaaggatctactggcagcttctgaaggcttctgtaataccttgtaccccaatgagtacaatgaaatcattaggggttctttcctctcctttggaatgaaactgctgcttaacttttctcccactgatgagatgcggtgatgctgtcacagttgggtggttgctcctcctgcagtcttcttcccattgcatgttcactctcttccccacttgcccacgagcagcaactcctgtttcttgtttttttccttttctttttcttttcttttgagacagagtctcgctccgtcgcctgggctrgagtgcagtggtgcaatctcagctcactgcaacctctgcctcctgggttcaagcgattctcatgcctcagactcctgagtagctggtattataggcgcacgccaccatgcccacctaatttttgtgtttttagtagagatggggttttgccatgttgctcaggctggtctcaaactcctgacatcaggtgatccacctgcatcggcttcccaaagtgctgggattacatgcatgagccatcgcgcctggctaggaactcctgtttctgtttttatcctcttcccaagtctgcaggccccgcctggcccacccagtccttcttagaagatgatgacctcaactactgctttttaaagaagactgacgtcgtgttaactgagtttcgataacgcccctctgtgtattttctcatcgtcttattatgttttccaaaataggacctggggtcgaactcctgacctcaggtgatccgaccacctcgacctcgagaagtgctggcattatggatgtgagccactgcccctgccctagatggtatcaccttcaaagcttaattaggaagaataatatgagcactgagtgtaactccaggtcgggtatattatgtccctctgtgttctctagctagttatctatccatccatctcttgccttgtccacagaagttacaggtaggctgccgggcgcagtggctcacgcctgtaatcacagcactttgggaggccaaggcgggcggatcacgaggtcagaagttggagaccatcctggctaacacagtgaaaccccatatctcctaaaaatacaaaaaattagccaggcatggtggtgggcacctgtagtcccagctactcgggaggctgaagcaggagaatagcgtgaacccgggaggcggagcttgcagtgaaccgtgatcgcttcactgcactccagcctgggcaacagagcgagaatccatctcaaaaaaaaaaaaaaaaaaaaaaaaaaaaaaaargaaagaaagaaattacaggtaggctagagcacggatgagcaaactgtttttataaaggaccagagagtatatatttcaggctttgcaggccctatgacgtctgtcacaattcacttctgcctttctactgcaaaaacagccatggacaattcataaattaatgtgcatggccgtgttctgataaaagtttatttatagacactgaaatttgaattccatatgtcatgaaattatatttttttgattttttttttcataaaaccagtctaaaaaagccatgggttattttgtcatggcacgttttgatatgaatatttccacccccattatttgcataacaaaktacagattatccagaacaggtgggctgtacataaacaggctggtgggctggatttgtcctgtggactgtastttgctgacatccaggctagatccttaatatacaatgaagtagtaaaacacatgtaaaagtaaaaagcaggcgwaatagaataaaatasacatttgcacaccacagtatccaaaaaggttatgtactggggctaaagatttggcttggagtttcctggtagtcaaggcaaaaaagggaaacaaaactagttacagagtttctcggacctatgagcaaaaggatktccatttctaatcggaggcagaggtatcatggccttcaagaatcttccggttaaacacggtactgaaatttgattttattgtctatcgttgagtccctagttattttgcctttaccaaggctagttgcagagtatttgttctagtatgtaaaatcagcaatcagccattttctggtcattgtaatggtgtaaattatatctgacagttgttaattaaatacctactcatgctttggagccaaagccaaatagtgctctgtaaacattatgatttgtcagtaatcaatgtgatttgtataatttgtgagcaatcagatactttatccaaaagcrgattattgacctctgtgcccatcttgggagaaattgccacttggtctgtgtctacacagacccaagaggagaagggatttgacaatggtctgattaattgaatcagtggtttgggggagtgggctgtctgtattgatccaattaaatagataattgtcagaatcgaggtcatgtctataagacaccaccatttcaaagccaaagagattgtttcaaacatatcatgctcaccccaatcaatgtgggccgcctcctccacatgaaatcaaccagaaagtgattgattctgcagagccataaaccagggtctttcctattttcggcaagtggttctgtgctaaatacagtgctttgaaatttttgttccccatagacccaaggatgatgattcattatgcaaataatggggatagaaatatacaaattgaatgttagggctgggcgtggtggctcacccatgtaatcccaacactttgggaggataaggtgggcggatcgcttgagctcaggagttggagacaagcctgggcaacatggcaaaaccccatctctacaaaaaattttaaaaatttagccgggcaggcatggtggctcatgcctgtagtttcagctattccggaagctgaggtaaggaggatcgcttgaacctaggaggcagaggttgctgtgaggcaagatcacaccactgccttctagcctgggcagcagagtgcgaccttgtctcaaaaaaaaaaaaaaaaaaaaaaaaaaaagaaaaagaaaaaaaaagttggaatgacatcagactcaaaatgtgtcacttcgcagtggggatgcaattctgagaaatgcatggttaggtggtttcatcattgtggaacatcatggagtgcacgtacacaaacctagatggtgccgtctactacacacacacttaggctgtatggtctagcctcttggtcttagcctacaaagctatgcaacgtgtgattgggctgcgtactgtaggcagttgtaacagtggtatgtgtatatctcaacatatctaaacatagaaatagtacagtaaaaatatgatattataatctttgggacmgccatcatatatgyagtctgtcattgactgaaagttgtcatgtagcccatgactgtcgtctcttttaggggaaaaaacaaaagcagaaagcaagcaagctggtatcctgcgtatctgtgagctcaggaagcagctgcatgtgcatactggataagcaagggagactccaaccccgggctctctaagggtgtaattgttgcaggcacactgaggggcagacctctgggtcttggttagtggtccagagagggaagagagcaaaggtagaaggcttgagtttaatttctgcatcagactcaaaacccagctaatcttttctagctggtcatttcaacctagctggtgatttcaggctagttaagcaacccctcggatcctcaatgttcttttccctctaatgggggtaaatatacttaattcactgggtgactgcatccataccaagcacacagccgtgatcagttagcctctcacttctctactaatccccactgtggggaagagctcatcaytaacatgccttatctgacatgtggcaataacttctgcctttcttatgtcatctgcatggttgcagtggatagtcactggacaattgatgaacamctactacatgctaratctctccctggggagagtgcttgtctttgaaacagtcaaaggaggaaggaagaaaagagaggcagaacaattataataaagcaacttaacccattgagagacataaggatgctgcaaggcgcagtgctggatggagaggacagtgcctggggcagtcatggaagacttcttagggaggtgactttttaaggggttttgtgatcaaaactatggagtcttaagtccaaccagtggttatgaattccggctctgccacttgctataatagctgtatcaccatgagcgataacttaacctctttgtgsctcagtttcttcatatataaaatggggatcatgatagtctctgtcccaggggagttaggaggattaaatgcaacagtaatccaaccacagtatgaaaagacaggctagcacatacaacacaatctataaatgtttgctattattgtcatcctttttattagtatatcatggtacaagtttgctgggtagaaagatggcgatggggaaggggacatttcaggccaatgtgataataaaatcaacagacaaaagaagggagagtgtggtgagtaggataaagctctgtacagatgcaaggggaagggtgttgatgtcaacacgcatgcagcttcccacacgtcgtgtggattcttttctgtgctctccattacggaatctccctgaaaataagtggtcactttgaggtttgatggtttaattctaccacaaaagtataaaaagcaggcagcctgctgtttatagatttttttttaagtgagggagtatgttaatgagcttagattgtcagggagctaaggggattcttgacatcaaattgtgggtagctaaataggtcaccccaagttattcagcatgggtggaagaccaagaggatacacaagcttcaaaaagttttcagggagagcaagagatgttcatttacctcattcaaaatggaatctttaatgctagtccagtgcttggccagtacaaggccattatatatttgttgaatgaatgaattcgtgaatatgtttataaagacaaggaaacgccattctgcaaatctacrtgcagtaaaatagtttttcagtcactttgccttcatttgtttgacattcttggaatatttgggctctacaaggtgctagggtaaggcacgcaggatgcaagrttagcgagatattgtctctactctcaagaaactcgctttctttgggaatcatcacctgtttttgtgtcayggaccccttgggcatttggtgccctttgcasaataatggttttgaatacataaaacgcacgggatcacagaggaaaccaatcatattaaaatacagttgtcaaaatattaactcatgggatctagtaacaaatgttcttccttcttaacccattaaagaacacagctcatggtcggtccattaactactaattatcaaaacagtgggtgaaaacgatgtttggaaatagctgcgactctcgcgtgatasgaaaatatctgtgatttcgattgcgacaaacacacagatgcttctcacacgatcgcagtgcattgcctaaatgacagtaatgctaaactccagtcagatgttagtgaaaaataaagatgtaacattttggccatctgtgtacaccccctctttctagggttccagccacagaccctcagattaaggagtctgcactagcttgtagcttgttcaatcacacatacacacaaaaagtgccagttataaaggagcaggaggttttctggagccaggatgagctgggaccaacaccagcaactgtatcacccagttcactgagagttaaaatcacccatgtgacgttctctctgcaggcacatagtaagtgctggataaatgatagggattgatattgaccagctttgacacatgaataggagagggttaggcaaagacaaagagagatggggatgccaagtaccctctgggcagaggaaaccatgagtgcagaggcacgtaggcctgaaacaggccagaaagcaccaagcaatttgcttttgctggtgaaggaggtataaaaggtagagttgcaaagactggggatggagctttaggctgggatcagcgcccaatgggctgggatgacaagtgcttggggcacattggcagctgcgaaaagctcgctctgatgcctgtgtggggacagattttgggggcaagaggactctccagcaatctgtggcaaaaaaaaaaaaaaaaaaaaaagtcccgcttgttatcaagcctactggcttatctgttatttcttggacatgccccagtcgctagtaaataaagctgtctactttacattttgtctctgtgcccttttacagccttttctcggaggagctgagtcccattatattccgaaagcatatgttcccgatgattgctcattctctttccaataatatctttgcaggacaaagaggaatggggaagggaacatacttttaggatgtcagtcccagttttaattacaagtgttcctggttgtggcattcatgtaattgggggctgatttatgccaaatgatatgcactgatgtaaggggctggagcccaagagggaggggaggccaagaagaggcagtggccccccaccaagcccggaactgaggtggcacatgtcagcggctttgctcagaagcacccagggatgatggaaaaggcaaccgaaagggctcagcttctgcagatagagtctgtgctttgcrctttctggctttgtgacctttctgcaggttacttctctcccctgagcatcagtttactcagctgaaaaatgcatctgctaataatacctatggcatagggtttggggaggattaaataagataatgtaaatagagtttagcrtggtactgtgtatatagccagcactcactgctgttggcttattgaaaaaamaaaaataatacctacaataaccacaatatagcaacagcaatcatgttcaagtctgtatttggtttaaggagggggaatgtgacccgggggctctgtcattagatatatgcacacacttgacctaatggaaagcttgaaagcaattggatgggaaaacagtccatcttgttggaaggctgtcaagctgtgtaatamaagaattactgttctccctttgcatttatgcattgcatgtctctgttgaattcagagtgctttatagacctctgatcagcttccagcatcctcttggtatgagttctagggggagatgaggaatgtgcctaattcccttgagtgatttacttggtgttaccctggagttgtgaggacaaaaggatggggctgactgagactggggatgttcatcacaaagtgttcaggttacatccaggctgattactggccaggagactaggcattcatagtggggcgtcctttaaggtctgaagaggacagtgaccatccaccacaggcaaacatgtgtgtgttaaaaaggaatgrcgttttggtctgtgctacaactgggatgaacctcaaacattacgctggacgtggtggcttacacctgtaatcccagcactttgggaggctgaggcaggtagatcacctgaggtctcagaagttcgagaccagcctggctggtggtgataccccatctctactaaaatatggtgataccccatctctactaaaaatacaaaaaaaaaaaaaaattagccagacatggtggtgcaggcctgtaatcccagctactcgggaggctgaggcaggagaatcacttaaagtcaggaggcagaggttgcagtgagacaagattgtgccactgcactccagcctggatgacagcaagactccatctcaaaaaacaaacaaacaaaaaaaacattatattaagtgaaagaaaccagatgcaaaagatgacctaacatgtgaatctgtgtatacaaagtacctagaataggcacctccaaagagacagaaagcaagctagtgattgcagggggctgggaaagaggggactagagaatgactgctaaagcattcaaggtttcttttggggttggttaaatggtctagaattagatcgtgttgatggttgtacaaccttgtaaatatactaaaaaccactgaactgtacactttaagtgggtgaattttattttatgtcttatttatttattcttttagggacagggccttacgctgctgcgtaggttgtggtgcagtggcacagtcacagctcactgcagcctcaaactcctaaggtgaasagaccctcccaccttagcctcctcagtagctgagactacaggtgcgtgctaccgtgcccagctgatttttaaatttttttttctttgttttgagacggagttttgctctgttgcccaggctggagtgcagtggtgctatctcagctcactgcaagctccgcctcccaggttcacgccattctcctgcctcagcctcccgagtagctgggactacaggcacccaccaccatgcctggctaattttttgtatttttttagtagagacggggtttcaccatgttagccaggatggtcttcatctcctgacctcgcgatctgcccacctcggcctcccaaagtgctgggattacaggcatgagccaccaygcctggccctgatttttaaatttttcatggagacagggtctcaccttgttttccaagctgatctcaaaatcctggcctcaagcaatcctctcctctgcctcagaaagtgctgggattacaggcgtgagccaccacacctggccgctggaaatacatttctaaagaggaatgggagtcaggctggtgaagaaacacgtgagtgtgggatgaggatggggacacagagtgatgtgaggcctacacaacaggagttcaatcctaggacctgagctgatgtaaatgaagcaccgccaggcccagttggggaggaccttgtgttcctgctggagagtgagagtccctccctccccattccactcccaagagcagtgaagagycaggaaggtgggcttgttttgttttgttwtgttttgttttgcttgttgagcaagggaatgcggttcccctgtgtcggacttgtttcagaaagacaatgtcactgaggctggggcagggagattagstgagaggctcttgcagttatctgggaaggagctgtccataaaggcctgagttaagacagtagccctttgggttcgatttagtggtggctccccaaaagatatgttcactggaacctagacatttgagaaaaagggtctttgcagataagttcagttgaggatctcaaaacgaggtcatcttgggtggaccctaaatccaatgacaggtgttttcagcagagacagaagtgaagaaggcacagaagagaaggcggtgtgaaggtagagactgagatcggagtgattcccccacaagccagggagcactgagggctgctggcacccccagataccaggagaggggcacaaataggttctcctcagagcccccagaaggaactaagccttctcacacctagactttagacttctggcctccagaatactaagaaaataaatttctattgttttaagctaccacacagatgcaggaaactaatataccctttaatgattttctccatggcctttctgataatcctttcatccttcatctcccctgtygccsttttctttgctttgcttgcttgcttgttttttttttttttttgagacggagttttgctcttgtcgcctaggctggagtgcaacggcacaatcttggttcactgcagcctccgcctcctgggttcaagtgattctcctgcctcaccctcccgagtagctgggataataggtgcctatcaccacgccgagctaatgtttttggatttttagtagagatgggttttmgccatgttgtgcaggctggtctcaaattcctggtcccaggcgatctgcctgtcttggcctcccaaaatgctgggattacaggcatgagtccccatgcccagcccctgttgcccttttcaaaacactaagtgcatcatgttaaccttccactcgcttctttaagtttcctcactccttttaggtgaacaacccaaaccctcatatgccctagaggcccttttcagccctgttgacacttcccttctctgtgctttagtcaccctaccctcggtcaactcctaactcctgcctgccacagggcctttgcacatcctctgccggggaggctctcccttcaccttcattaggttatcagatctcagctcacacatcacatcttctgagataccttccagactcccctggccacggtcacttcctttgctgtggactctctgggaactgtgtccccttccttctcacatcagcttgcagttctgtacttgttcatgtgatcattgatcagggtccattttctgctccagacaatgatctctatctagaaagaatcatgcctgcttttctgcactctcctgcctctaggggagagaacacagagcctggcatgtggtagactctttttttttttttttttttttgagatggagtctccctctgtcgcctaggctgcagtgcagtggcgcgatctcagctcactgcaacctccgcctcccgggttcacaccattttcctgcctcagcstcccaagtagctgggagtacaggcgactgccaccacgcccggctaatttttttttttttttttttggtatttttaatagagacggggtttcaccatgttagccaggatggtctcaatctcctgaccttgtgatctgcccacctcagcctcccaaagtgctgggattacaggtgtgagccaccacgcctgggcggcacgtggtagactcttaatgaatttttgctgaatactgagtaaataaagaaaagttaacacagtggagtccaggtacagtggctcatgcctgtaatcccagcactttgggaggtcaaggcaggagratcacgtgagcccagcagttcaagaccagccttggcaacatggtgagaccccatctctacaaaaaataaaataattagctgggcatggtggtacatgcctgtagtcccagctactcaggaggctgaagtgggataatcagctgagctggggaggttgaggctgcagtgggctgtgatcatgccactgcacttcagcctgggtgacagagaaagactccatctcaaaaaaaaaaaaaaaggtagagatggtggagtggtgacatttggtagataatatagctctgcagaamttttcattgcaaaatgaaaattcttcattgttattataattacttcaaggagcaaggccattttgtgtaagctatcctgggcctccctgcctcccattttacaccctgtttattgatastaagaagagcctccaactgaataagaactaatgacttctgcctgccatcattttggaatgtccaattccccrttctggagagcctttgattataacatcagcctgtcatttggacctctgacctgaattatatgaatctgaaaaatctcttcctttcctatcgtgarttcggtcattgttataagccaagctttgcaaaggtggaacaccttggagatacttatctcctccttactctmcccaagtaatgactcatccttttatacagaatgtctcttttttgatttagatgtctttttttgatatagatgtctcttgatatagaagcatttctcgggatggtttttgtggttgcctagtgtcttctaaagacccctgaacatagcatagaaacagcacgtgtcttaggcttggaatgagataatgtctcagtgtttgagtagaattagggagtttgctttattttcctttgtttttcttttttgttgttgtttgtttgtttttgagacggagtgtcgctctgtcgcctaggctggagtgcagtggtgcaatctcagctcactgccagctctgcctcctgggttcacgccattctcctgctctgcctcccgagtagctgagactacaggcacctgccacgacgcctggctaatttttgtattttcagcagagacggggtttcaccgtgttasccaggatggtctcgatctcctgacctcatgatccacctgccttggcctcccaaagtgctgggattacaggcgtgagccaccrcgcccgrctgctttattttcctttgtgttcctaatacctggcccagtgtctggcaaatggaaagttcccctggatgtagttgggtgacactatgagtgtatcgttaggcatgttcaaaatatagctaaattcagtccagacattctacctatgttttcacagaaacatgaggcagtgtacagcgcttatctgtggcatttgattaggacattttactgaagagttgataaaaaagcacaaattgtaggctgcaaatctatcatttttctttcctccttcttcctctccctccctcccatcctttcttgctttcttccctcctctctccttccttccctccctttccagcttaactaaaattttctgatacttttttcctgaattagggtatgttttggggggaaaaaacgcttcagtgcgtgtttctttcgacattacacataagcccccatggaaagcaaattgaataaatttactctctaaacttctttccacaagagtaggtttataatttattttctttacattatctggataattacatttggtttgcttacatagatggaggcgaatggttttccratcttcaaaccaacctatatcacaaaagcattctgaaaactgggaagagatcacttcacagtttcctgaaccactagaaaaaaaaaatgttcataaatttatagccgctgacattgaagttggagaaaagagcatatctagyacctatgctatgtggagaacactctccatgtctttgaaaaataagcacaatacaaattatatttgaggatgacctgccaaagggttgattatcctggaaacatgttttctcaatggtccatttgggcaaacaggccagctgaggtatctcaggatagcaacaggataagcagaatcgattgatgaaggagggagcctacctctggaggccccaggctgggactttgggtacagatgcacaggagacctttgccccaccccgtcacggctgggcctactcagttccacgtctttgagktttcacgcggaaactggatgtttcttacatcctcagctgcaggcatggggaagagacgcacatcagccattaagaaaaaggtatgcagtctacatgcctsttaatttcctccacatacacagtaaacccatcatgtccatcagcaccattgtcaaaacatstgtgcaccagtaaagggttctgatgtgtgataaatttatttagctattactcatctgaagttatactattttaggatcttggggcagtgaggaytttggaaatggaacaggatgctcctttaagttagggtaaaatgaagtctataaaaactgtttttctatatcctcctcctaccccacaaagaaagttagggtaatatattcttatataaaattgacatttttaactttaatgagaaattgcttgtcctttaaactttaggcattgatgcgcttaattatgcttttcaacaagattttgcatttttaatatttccttttagagcttccaggaatctcaattattaattgtaccstggatttattggtctttggactctcccgctagtataaagactgtagattcatcaaacattgtttactgtcttcaaacttcaacagtgttttaactatcaaatagaaaatcgaaaggaagcataaacgcayatggtcactttactggtataataggggccaagagccgttgtgttttataatttcttgatgatcctggtggtaggtaagccaaccgctatgaactctgatgagctctggtttaccccatagtccaaataaagaatggtttctgacattgtatgaccaaaaaaaatagcatctgcccaaaagatgctatttataaaactgttacaaatggagcttattgttcaccagaattttatgaataagtaatgaagtctaattttccgttatcatagccattggttaaaaatgcatgtctgttaggacattgtaattattttgtattacttaggaaaacttttatgattctactcttttaatttttttaataattactttatgacttcttcattagggwttctctcctccagtgcgtacgcagatcttctgaaaaggaatctgacaaatttagttgctgcatttttctaaattgctttcaagactacccagcacttcagatacttttcatggcccttttttcccaaagtgttctccaggatgccttttgatctgcacgggcaatcccattagcagtgatggcttaaggttcccacagaaactctgccacagaggcactgacaccagaccaggcgtgatccctaacagcttgctgtaccgactcatatgagggctgtcttggtccgtctcatttaaggtttggcttctccaaagattagacacccttgttttcgttcaacctttgtttggctttgaagcatcatgcacttgggtcttgaaatcttgggctcaccgctgcttgtaccagtatcttctaccctccggttgtttgtggccattatcaaacaaacaccatgccaactaggtgtaaatgcagactgatattctgaagaatccaggaagggctgggcatggtgcctcattcctgtaattctagcactttgggaggctgaggcaggaggatcgcttgagcccaggagcttaagaccagcttagggaacatagtgagacccctgtctctacaaaaagtaaaaaataaaataaattggctgggtatggtggcacatgcctgtagtcccacccactcgagaggctgtgatgggagaatcacccgaggctggggaggttgaggccgcagtgagccgagatcgagtcactgcactccagcctggacaacagagtgagaccctgtctcaaaaaaaaaaaaaaaaatccagtaggaaactatataaacactagggttgctttaaaatgtcaaggccaactcttatgatatgcggaagccttcgcccccttcttgagggtgtttagggattagatgagtgtcccatctgggtttcccatccctgcagagcccacgtgtggggtgctgagrggtacgtggtgggtgactccctggggagcactgtttggtactgatcactgtcccatcctggcactgcagtcctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaaggaagggaaaagctacacccccctgtggatgtgtatgctaaacttgattgatctgggcatatgtggaatttttacctttgttttgtctttatttatttttaaaattgaggtaaatttacttaatttaaaatttatcatttaataccatcttttttgaatggttaaatagtggatgtattttttctagtttttttgttttgcttaataggctctctctctgtctctttctttctatatatatatataatatatagaaagatatrtaatctatatattgatatctatataatatatataatctatatatgatatatatatcttattatatattatatatatagatagatatctatatacagatatctrtatacagatatctatatatatagatatctatatatatagatatctgtatacagatatctgtatatatatatagaaagagagggaactgaacgggatgctttttattttgggctgttattaggtagactctcctgggacattctacacagctcctgcctccttctgtatgtaayatatatattatatatatataaaatatatattakgtatagataatttatatataaatatgtgtatatatatatttgttagggtaaaacaaagtctataaaaactgttttcctttgtcattgcccccaccaaatatttatatatatgtrtatacacatatgtatatatgtatgtatagagagtctattatatatattacatatacataatatatacataatatataatagactctataatatagactctaatatgtagtctatatattatattataatgtatgtaatatataatatattctatgtaatatataatatattctatgtaatatatattaatatgtagggaatatgttacatattatgttgagagtgtatatrttatatatgggtttctatatattataataaacccatatataatatacataatagactatacacatatacagctaatatatatacacaatagtctagtatatattatacatgtaatatactttccatacatacatatataatttggggggcaaaaacatatatataatgaatataattatataattcatataatatatgtaatagagcgtgtatattatttacatatgtatatatatatatatacacacacacacacacatttcaactttcttgaactcctgaaccagccttagattgcctagtaccagggttcttctttttttaaaaaatttatattttattttaagttcaggggtccatgtgcaggtttgttatataggtaaactggcgtgatgggggtttgttgtacagatgatttcatcacccaggtattaagcmtagtgcccattagttatttttcctgctcttctccctcctgccaccctccaccctttggtaggccccagtgtcttttgttcccctctttgtgtctatgtgctctcatcatttagttcccacttataagtgagaacatatggtatttgcattttctgttattgaattaatttgctaaggataatggcctccagctccatccatgttcctgcaaaggacatgatctcattattttttaaggctgcatagtattccacggtgtagatgtaatatatatataatatatatataaaatatatattatgtatagataatttatatataaatatgtgtatatatatatttgttagggtaaaacaaagtctataaaaactgttttcctttgttattgcccccaccaaatatttatatatatatacacacctatgtatatatgtatgtatagagagtctattatatatattacatatacataatatatacataatatataatagactctataatatagactctaataattattttttaaggctgcatagtattccatggtgtagatgtaccacattttctttatccagaataaactattttttatactggttttaggctcacagcaaaatcgagtggaaggtacagggattttccagatttcccctggccctcactaccacatgcgtagccacccctttatcaacatcatgttaactattttaaagtggacagttgagtggctttaagggcattcatattgttgtgctaacatcatgaccatccatctccagaatgattttcatcgtgcaaaactgaaacgctgtacccacagaacactggctcctcatcacctccccaagcccagcccctggcarccaccattctcccctactttgtctatgaattcgactactcttggtacctyatataagtggaatcacacagtgtgtgatgtgttcttttgtggctgacttmtttatgatactggattctcagcatcatgggagttaggactgtctgtcgcaccatcaaacaggcatagctggctggctagaccatgtcacagggatgttggaactgggtggcactgactggcccagccaaggggtcaygcaggggactcctgattcattcctggggaaagtagttatgtcaggaagcacaggctatggctcacggctgtggctgtgcccacgtggtctgtgtgggctggtggtaatgggccagggaactgaatgggatgccttttattatgcactcttgacattttttatattaatctgttttcttctccatctataacatttcccacatgctacactgaagggatattttaagcattaattctcctaaaaagcctcatgcccaatgtaaaaatagttcactgtctcagaaaaaggcactctctataaatgaaaagcaccattattagtaatgtcaataactttcctgacatccatttgggcattgtatatgttttgataggattacataaataatgaaattgtatgcaaagcatcagaatgcaaaaggtgttttctccaaggtgtayacactgcctgggccttgtactctggccctcaattttcttaaacagctgcatcttttgggggctctgttaagacatgctactgtctttagtattttgccccctcaccgaatgatcaggagactggcttccccaatgccctgggcttaattcccagatatttattctgttgtggagtgattatctgttcctggattgtctcaaaggcattaatctttttggtatccaacatcttgaatgcttctgtgtcattttcctttctttttttttttcaaagcacttaattatttaaaaacaaaaatmcttctctgatcagagcatacctgccgtgctcaaagcacttgcttacttggaatgccataaattacatgaaggaattattcattgtatcacgaaacataccttccagtctcccgagtagtstattaggctaagtatggtcttttaaattattactttaaaaataaaagataatggaattatagcattaartacattttgcaaatgatcttctagtaggattattgaaagacagtaaaggcaagtataaatcagaagcaaaatcattgtcctctaattcattaatggttaataatattgctgactcttttaacttgtcaacatttcctacattcaacattgtactctaatatccagtaaagtgaaacaaacaaacaaataaatacacttttttcaagaaaaaataaatatctgtgatctcatcrtttgaccgtcagtattttcatttttgcatgtgccactttaatttccctaggcaacactagctagtggcccacaataagacgtagaaaacaagaccacgtaccttccagaatcattggccctggctctactcctggaaacccagtccatctctaatccctttgatttccaatgggaggcaaatccaggggagttctagactgtckagaatattgtaccaagaacaaaaggccaaccccattagacagtggccaagggaggtgaactaaagttggtgctgtgaacagggctaatggtttgtgatttacccataagtggaaggtrtactccggctgctcctttaatattttatgattagcagtagaggtgtgtctgggggaaagagtcagcttattttatttatttattaattttttgagatggagtctcactctatcatccaggctggagtgtggtaggtgggatcttggctcactgcaacctcgtctcccgggttcaagtgattctcctgcctcagcctcccaagtagctgggagtacaagtgtgcaccaccatgcctggctaatgtttgtatttttagtagggacggggtttcgccatgttggccaggctggtgtcaaactcctgayctcaggtgtwccaagaacaaaaggccaaccccattagacggtggccaagttggtgctgtgaacagggatcctgcctctgcctcccaaagtgatgggattacaggcgtgagccactacacccagccaagaattcagcttcttaaaggagctgcctcagactgtctcaagatcttagaaggccatgcctacattgccaccagcatcccttggctttttgcttggcttaagaatctrtcttttccgttcctccttccagcatactcagcacagtccacctctgtggtctctctgtggttttctttctgttttcctgctctctccatttctcattcaccacaccctgggctatctttcactctctatgaaataccttggatttaggaattggagatttccttgggtcaggtttcaccctcttcaagtagcgtctcaaacagtatacccactacagctttctccccastctgtcaaccatgccatggggcctactttttgccctgactcccaccagataatgcccatcagatggcacctcttttggctgaaaaatcgaaaactcatcactcttcctgcattcattagacagtaccctttatgttcaactttgtaatttaagtcccattcttgcctcatagaattattgcccgttgacctccatataagtatctgcatttgctgcatcattcatgacatgtgaggcctttgacaaaccctcctatggtgcagcttcctccgagcagstcctaaggaagtgccagagtcagggctttcctctgcctgaattatcggagctcttggcttaatgtgggagaagagatgaatgatctgtccttctatgaaaggcttaccaactccattcaattcacagtggctctctgaagctctgtttttggaaggactgtgaggctgtacctgcacttgattgaacgagtgctgggattgattagtgatgtctgcagtgagcgaaggattgggaagagtaaacaggcatgctgcatatctgtcatcatggctctgagtgtatcctgtttcagaagagatgaactgtgctgtagagatgttagcatcaggtattttagacacatgaagagaggatcagattcagtggaagtgccaaagggattctttcagatgggcaataagtggttctgaagatacgtatttctcagtgtgttatcttggctccatttagccacacaaaaggaatatgggtatagtgatgggtctctcatggctcacgtattaactgtatttgttgttactgcttctcaggcactctgttaagaatgcagggctcttcctcagactcagsgcggggcctgggctttacagcaatggttttcagtttgtaatctctctcaaggaagggagaggagcacaaagctgccttgactgccagcaccatcagaaaagtgacagcagtcttggccctgtaattgccaacagtaattcatttgttcgttctctctctctcgctcctgctcctgactctgggggatgcttcttttcctaccctgcctggaaagtgctggggcatgggtgaaaccagaatggttttgattctcaagtctttttgtagagaggaagaatggatattcctagggtcagttgattgagggtgtgttgggggaatgtgattatcgatgatgctgtatgctgggtactagactgggggttcgttacatcaagttgtggggtctgtggaaaggaagttgtcataggagtctaggactcagcagctgtcaccttcccaaagtcacactgctgatgagtgacagagaccacatttaaatctgtgtgtttacaaggtctacaactgcaycctgctacctcccagaagctgaggcaggatgggcaggttgccacaccctcccaacctcctgcaaccttagttgttagtgaaaggttattaaataggcctcacaatcgcaagccaggtaaatatgtcattggagaggttggttttgtttgcatttctggtgaagttgagttgtttttatcccctacaaggtcatctagacatttttatccccaaggtcaggagatctttctgccagaggtcagcattccatccagctcctgcctgctctctgggtggccgactgtgccagtagaaatgccagctgcagccaaaggacaggctttccatccgagaaaagcactcacactcgcatttcttttctggttctgttcctcccctacataaccagaaaaagctcgttaacacatgatggcaaccaggctccaatatctgccagttcccctgtacagattcctctttagcattctctcggcttccctcctcaacaattaattcagatgagcmgttgggagagtgcaggatccagttcaaaaggatctgtccccccgtgaaccccaggacagggtgagaggccacctgcacactttttttttgtcasctcacaccctgttggccctttgcaaatatttgtctttcctcatgcacgtgkttattcccagaaagatccagtgaattgtctcctgaagawaaaatacataaaagggcgtttcaaagtataaacagtgattttaatgaaaaataagaagaaaatgcttatgatacaacattaggtggaaaacgaaggaagaaaaattctgtgagtctaattatggaaaaaattactaagatatgttttaacatgccctagacatgcacagaaaaaaaagactggaaggaaatttattgagatgttattgtttatgagtgttctaattatgatttttaacaatatattatcagagttttctgacaaagaattaactttttattttttttgagacagagtttctctcttgtcacacaggctggagtgcaatggtgcaatctcagctcactgcaatgtctgcctcccagattcaagcaattttcctgcctcaggctcccaagtagctgggattrcaggcacccaccaccacacccaactaatttttgtgtttttagtagagacagggtttcaccatattggccagactgctcttgaattcctaacttcaggtgacccacctgcctcagcctcccaaagtgctgggattacaagcatgagccactgtgcccagcctagraataacttttaaatcagaaaaatacattttttaaaaagatgtaaagcatacatagaggataacttacaaatctgcatttcatgaccacatatatctattgagttgcccctaggatcatttttttcaaagctaatgtctgccacaaatgggagttttaataggttataattcatatgacttagtgttaaacctctacgttggkattcttaaatttaacatggataaactgaacttgatttcctgcattaaaaaaaattaaagaaatgaaagttctgactgttttattgtagctggggaattctttttgcaggtgaygctcatgttacggttttgaacccaggactttgcgttgcagttttgttcaggggttgcagaataccgatctgactttgcaggaatgactgtcttggtgcataagccattaacctctctgcgcccttggattgcctcctctcctgccagcagaagccaagtcacctcatctgtaagggagtttcattgaggactaagtgggaccaggccgaaaacgacccccttcccccataggaagtcacagaacagccaagccctggaacaggaggagcagcttcctcctgggcacagctgtgcagaaccagaggcgacgcatttgcccatcgtaaaggctgattagaaacagttgggtcccaagcagaatccttttgcccatgactgtgtccatggtcgaggtgtccattgtcactgttgccagatgccagcactggcgagggttttgccttcctaccgtaggcttcttgacccggcacctcggaaagtaactcctgtccattgttccttgtgccatctttcttaagaaaacatgaggaggagcagggtgatgctagatggaagcaggagagcctggggtcttagtttcagtggctctgacttcagttttctcacctcgaaatctcccttctctgaacctttttgcgtgctcttctgtctgtctgatattcatcatctgactcatctctaccagtcaggagttgcttcttccaggaagccacattccatggactgatacgctgggctccatgccatcctggggttctcttgagtacatctggaggggtgtagtgtgttgtaaatgcatacgatcatgctggtacatttcatcaaaggtggcagttacactaccagttgtgtgcccttgggcaattagcatcaccctgctgtgcctcagtgtttccatctataaactgggtataataatcattcctaccccataggttgctgtgaagattggctcacatcagtmatgtacttggaatggatcctggcataaaaagagcccttggaaaatgatagcgttcatccttggtatgacctccaagttctttgaacctcaaagagccaagtcccacatctcaggtacatttcagttcattctttctgagttgatttttttttttttttttgagacaaggtctcattctgttgcccagactggagtgcggtggtgcgatctcagctcactgccacctctgcctcccaggcccaagcgatcctsctgcctcagcctcatgagcagctgggaccacaggatgcaccaccatggccagataattgttttgcatctttggtagagacaagscttcactatgttgcccaggctggtctcgaactcctgagctcaggtgatctacctaccttggccccacaaagtgctgggcttacaggtatsagccactgggcctggcctgagttgataatttttrtcatttmtttctyacttttctcaggaaaatcatgactgtaaaacagatcagttttgctttagttcccaccctcatcatcaacccctccccagctaccctgcaaaagagtcacagatcattgggataactagaaccacagagatccccctagacttgtcagccagggaacctgacactcttagaccttcttctgagtgctttgtccttgtccggagagctcggggaggagcaaggttgtactgggatttttttccgatcacagaaagtaacttagctagctgttgcccagccaatttgcccaagggagaggttgctcctgggttgcaggacgcatccatggatggagcatgggttttgggctgtggggggacaatgaggtggttcctgaaatccctagttactagcagacaagtgcatcagacaagtgcatttcaccgttctgagcttcagtctcttatccaagcagaaacatggccagaatgcaatgtcctaatacatgtaattcattacgtgtgttgtcatgtaatgtaacacacctattggcagtctctgacacaatacagatattgaccccatggtcttgccccaacttaaataaaaataaaaacgaatgcaaaagaggaatcttctttgcactcgtgtgatgtctgttaattcttggctttcttccttcataaggttaatcatctccctgtcacccctcccgcttgtcccccagcctctgtgtgtcaccttctctctgagctcaccctctctaggaagccttccttgctggaatgcccattccctgatataaggattccacccaccacgccccttgcrgttccttgccggtgtcctgtcctgggcagacataagccctgtgggttccagtttctcattaggaacctggatgatggagcagggatcatgctcattaagtccgcagaactcatcagctgcttagcagggggccaaggagggctgagcctatgacgggtgaataagtctggttggcctctgggagtacgggatcagaattccaagtgactggggtcagtagcaggccaccaagagccatcccacctcagaaagacagaagccatcactgcaaatggcaagggcatgaggcagtttgaaactggcaaaactggasctttcatggaatccagggcttgagctttaatgctttacacttttgttttttcattccatacgcttttgctttagcttcctggcaaaattcagacaaacctagaagggataataacttacattcaacctctgcttgctctgtcctttctcacacgtgtttagagaaactggaggagcccgggaactgctttctcctctctaagagtcttggtggtttcttgtgtggaaatgaatgggaagttcaccctggttctgcaaaatggktgcgaaatgtaaaatgtatataccttctatcctactctttatgttccacaaattttggagggaaactgattaactctctagctaccatgttccaggtgcctgcacctgcttgctcttggttaacctgcacccacgttcccccgcctgtctctgaagtattcacaggtggaggctcagatgcacacagtgattgagtgccctagctggggttggaaactctgtccatgaactccaaagcccacgctctcttacaccctcccaaaagctgaggcttcctcactgtcttttgcattatgtcatgggtggaaacatgcaccttccctgaccttttggcttggaacatggaagttcattgactttgttgcctagcagggcctggagctgggtttcttgcctgatcaatgtatatcattttgccaagagacagagtctgtgctggagagattgattccctggttatttatcttcctctgcccagtgtaaattggtcagcctgatcctattcgcatgataaaaatcataatgtctcaaattacttactcaataaaatgtgggtttgtctattattagtgattattagggttataatgcagcrtggaaatttggagcaaattaactatacatgcaagctgttgggctcaagtgcagttaatcatacgcatacagtgccagtgggcagaaggttttgcaagaatagcttcaggaagactttgtgggaagacagatgaatactcagggttttttttttttttttttttcttctaayttgtcctccttgatcaggatttctcaaatgcacatttgtctaatatactgttgaaccrtgcaagtaccaaaacaaaacaagaaacccagaattatagctcaaatttaattaaaatagcttttattgcttctattcatgtgtccctggattttaagtgatgcrtcagaatttcatgatgagcaaatgcctrtggatgccctcatttctcatccttcttgactgtctgctaagattcactcttggtcttgtctttgagcttttctgttcagtgatgtaatgggacaggctctcctgtcatcaagagttcccatcatacctgggcactgccatttcctctgtggtagatgcttcctggacacgtgggcaggtgagaggtgctgactttgcctacttgcagctgaagagaagagagatgtagctttgaatggccacatgagtgtttttttaaatgaaaaaaaaatctatgtataacttgtttcctgtgagggtgccaggaaactttacaatgarcttcgtgaattaaacctctaccagatgaatagaggtggtggcatggtagcagaaattaggrttaaaaaaatggtttttgatttatgaaaaatttttctgcaggaaattttgatttgttctttgtggattctgaggataaaattaagaccaacattgaggatgagagacagaactgaactcaacttaaaatagcttcagggaggaaaagcaagtgcattagataagtaagtgggaagtccaggggtagacgtgagttcaggcatagctggatccaggatccgacagcttgcatgtgtagttaatttgttccaaatttccatmctgcattataaccctaatgtttgctaataacacacaaacccacattttattaagtaagtartttgagacatgatgatttttgtcatgtaaataggatcaggctgaccagtatagactgggcagaggaagattcataaccagggaattaatctctggatccaggctgaaatgatattatcagacacctttctttctctggtcctcagttttgatctcttctctgctagctttattctaagacaggcttagatgggatgtagagagcaaactctggaagtggagtacctctggcctccaaggccagtagttgtagcaaaagtccagggctgccgctcattcactctgctcggacctttctggtcacttgtcttctgtggtttggtccttgtggccagggacaatgaaactctcattgattaggcctgagttatgtgctctctcctagagccaggaagaggcttcggccctgcccagacccggtggcctgagagtcacagtgaggcgcagctcccaaagggagactgaaatataagcaaaagaaaaggaacacgtactgggaatcccaaacagcaaatgttcactgtgttcagggaggagtcttcaggcccacagtgtaggcattcaacaaacgctcttcagggagaaggaaagttaccatcaaaatccgtcgttgaaagtattgaagttccagctggyggtctgatayagcttagatgttgtccctgcccaaagctcatgtcaaaaggtaatctgcagcgttggaggtggggcatggtgggaggtgattgggtcatgggggtggatttctcatgaatggtttaccaccatcctcttggtactgtcctcamgatagtgagtgagttgttgggggagctggtcatttaaaaatgtgtggcacagccccccaccctgtctcttgctcctgccctggccacatgacgtgcctgctccgccttctccttctgccatgattgtaagcttcttgagacttcccccagaagccaggcagctgccagtatcatgtttcctgtacagcctgtggaactatgagccaattaaacctcttttctttataaattacccagtctcaggtaattctttatagcaatgcaagaatggcctaatacatggtctctsagcaggattattgtagaggggactgatgttgaagaatggaaaagaaggcagtgtcagagaatgctgaagagtgtggatcttaaagtccaacctcaaggcccagcgctgccacttaacagctctgtgaccctgtaaagtcactcagcctcattgagtcccccatcctcccctgtgyagaatgaggctaatgctagtgctcatttcatagagttgctacaataatcaatgagataatgtgcataaagatttacatacataataactgctcaataaagggtagatgttaaaattagcatcagcgagctctagaagatgctaagttctctggaaagatcagctctgctcctgtcaatctctccaaatgttagattttgcctcaaattttaggcattcgttcattcatttattctttcgtaaattctatcgcattaacctttacaagtgttaaattaaatcttttccccaaattatgcattagaaccaagttcttatgtggtggatgtacctcatttcagcaagagctttctaagggtacagaattaaatatgcagcctctgggattcagtgatagctcatgggacatttgacctacatggaaatgcaggctggagttgcattttaattggcaaggatcagcccagttgtccagcttgtagcttggagtgtggcctggctcccactccagagagatgtacatcatgatctgcgtgggtgagaggatactctcaggaaatgggcaaagttgccagctgacctctccagaaagagagactatgttgttagtttcccttacttggatgagaaatttctccattcctagtctcattttcccaatagaacacggaggcagaatttaaagcctcaaaacaatctgatgcacatcagctatcaatgaaaaggaccagcttggaggcagaggcacctgagttttgcatcttggctcaatcacttactaactgcattgtgggttaacacagtgtgtgtgtgtgcacttactaactgtgcaactgtgggcaagtgatgtaatctctctggagctcgtytttccttttttcttttcctttttttttttttttttttttttttttttttttgagatggagtctcactctgttgcccaggctggagtgcagtggcrcaatctcagctcactgcaacctctgcctcccgggttcaagtgattctcctgcctcagcctcccaagtagctgggactacaggtgcacaccaccatggctggctaatttttgtatttttagtagagacgggctttcaccatgttggccaggctggcctcgagctcctgacctcagatgatctgtctgccttgccctcccaaagtgctagaattacaggcataagccactgcacccggccacagttttcttttctatattgtagggataataatcctcccttgcaggactgtgctcagcacatgttcattgctcaagagaagtagccactgttattattattgtcagtatgtatccaagtgtttagttcattttctctgcatttgtctaactcccttttttcccttgaactgtaaagctctcagcccagggatatagtagcaccagcacatagtagatgatcaagaaaaattagtcattctctctggttcttcctttcctgtatcctgttgtctttatcagttcaggctgctgtgacaaaagtatcacagactggatggccttaaccacaattgttttacatggttctggagactgggaagtctaagattaaggcagtggaaggttcactgtctggtgaaggctgggctcctgattcatagatgtctgcccttcttgtgcatcttcacatggtgggaagagggtgagagagctcaccggggagtgtttctcccagttcctccccagtacacagaaaaacaaagctttctgtctcaccaggaggactccacggtgagcatagcttggctcmgcccagcaggagattttgaaccgactctggtagattcttcctgcagccattcagctcccacctctttctctcaaaaagaaatccagggctgggtgtgtgtgggcaacttcaccctgctctctttgtcccccaggcctgcactacaacaaatgtctctttgtgtccaactcttcttccatttctagtccttcttttctcttcttctcgtacttcccatattcctaatacgattggttactcaaattcttaaacaactcacaactcattatctcccttccatgtaaaagtaacccccagcctgagctacctgaccccgtggtttaaacaataaagcaactgaccttttatcagaaatttgcaaagccatttaatttacatatgtccttggcatccacaaatattgcttctcctttcaaccagcatgccacccttccagccattcacatatgtattcattcattcattcatttattctttcattcagtcaataaatatttattgagtagtaagcacatgcaaggcattgagggtggggagggaaaragacacaaattgtccttaccctcatggattcaccatstatttaamggccacaaatacttgtgtgagaagcaagtcttaatagtctgaagtrttttcttagattcccttgagccgcaatgctgaaaagcttatggtggttttgctaatgaatttgacaaggccagaaatagaccagatgaagattgatccattggttaattgattaattgattgatcgactgaggaatgtcagcctggtctaccaaggtttatgaaagcctggcatatagaaatgatgtcgttaatgcacaaatacctgcatcctgtcttgaactccctctaggggccaccatgtgtatcagtgtcctgtggctgctgtaacagattactacaaattttgtggcataaaataacacaaatcgattcccttacagttctggatgtcagaactgggtgactttctcctgagactgtcctgattttttttttttttttttttttttttttttgcttgtcagtttgttttgggtgatgcagatggaaggtaacgtcacagggcagctgtattccaggtacttggtgactcttggttgcgatctgatgactggctcacagtaggaccatgacgtgagcagatttgtagtcctgcatraatgaaggaaagaaagaaatctgacaactcattgattcagattcacagactctgcattttgaaccagaatacacccgagcaattacctagcacaaaatctcctgtctgcagaggagttgcaggaaggagaattcactatatcctctcctgaaaatatcccttgtggtcaaggtggctatagactggcatccctctgctccctaagatgccagggactcacgtcttctaggatatcaggggaagatacagggcaatgggcctcagatcacagacacggaaaatcattttctatttcatggagcatggagaagcttccttcaaaaagctagccttcgactttctattttttgaactgaagggcaggccaggagggagctgacctgtgtagagcttggaggttgtgttttcagctgagaaaagtgatcctgaacctctccatccttgcaaagctcagatggaagcccaggggccccagccctccagccccacacacatgccggtgcacctggactgccactctacctgtttacaaattacccccattttctgcttggttcagcagcaactgattaccgtcccccgtgatgtaattagggcttcagagttcacgtgtgtctattatgagctctcctgtgctttgtcttggtgcttcgtttctgtagcagtaatcatatatatatataaaaatttggtatcaattgtttggctaaattatgcacagtgggccatcctaacctgccattaacataacgtatgctaaagaatgtgttgtgtttttttsttttctctgataattatactctaaagcatcaattgcttatttgagtaaattaaactttgagttgttcttatttcttcaaactttcaaattgtcttgcctgcagcagatgcagacccagcactccggctgctgccagtggaggcaggagcctcgttaccacctttctgagaaattcaagtgccacacagtggtcaccagcattgtagctgccctgatgttccgggctcagctgcaatatagcacatctctaccaccatccccagagtgacctccagaactgtaagggacccccgcctttggtacagagatgggagttaaacacaggtgtccactggagtcatgattcctctattccctggacaaatatgcaatgagaatccctgagggacaggcactgtgctagatacccgagatacaaaagcgacaaggtttctatcctctgacagtttatactttagtgcagtggtcagcagactgtttctgcaaacagctagatagcaaatattttagactttgtgacccatacagtcaccatcacaactattcagttctgccagtgtaactcaaaagcagccatggctgttacataatgagtggctgtggctgtgtgccaattaaactttatttacaaaaacaagaggagggccagattttgcctttgtcaaggaagtaagcataatagtgcaagcagcacgtgcccgctctttcacactggggcaaacacaggggatttattcggcacaattgagtaatgtggatgaggctgctcagggctggcagttgtaggacgcaaaaccttgaggggcatcgatattctggtacagctgtcacccatttgcagcacagctgggacactccacagagaatgatcaggaaggccaagcccagatggcattgttgaggggctttctcttaagactgcatctgagtggcagggcgcagtagctgacccttgtaatcccagcactttgggaggccgaggtgggtggatcacgaggtcaggagttcaagaccagcctggccatgatggcgaaaccccgtctctactaaaaatacaaaaattagcctggcgtggtggccggcgcctgtaatcccagccacttgggaggctgaggcagagaattgcttgaacctgggaggtggaggttgcagtgagctgagatcatcccaccgcacaccagcctggscgacagagtgagactctgtctcaaaaaaaaaaaaaaaaaaagttacttctgagttaaaatatgaagagtgagcagtacccagccatgcagaaggacatggagtggtaaaagcatgtggttccattaagggaaagactccagggcaagaaaaaaacatgtcatgcttgtacctgagggaaggccagtgtgattgcagagtatggggcaccctggaggtctggaatgggaggagtttaaacaggtcattagagcttcaagatgaagcataggccagtgacttggttgctgctgctgcgtaaccgtgtggcaactgagtggctcacggcaatcagtatttacttctcacgtgtgtgtggggttcagcagaactaggctgggcttggctgccctgccctactggtcctgctggttttggtggggcttccccctgtgtctgtgggtcagcttgttttgctcctgcatctttgcatcagctgggctttctgccctaggctggacatgggtggggcactttagctggggtggttctcctccacatgtstctcatcttcctgggaccagcagggctagaccagacatgactttcttatggcaagggcagaaatgcaagacagcaactcaaaacacataaggactttcaagtctagacccagaactggcatacccattcctctgtcacacactgatgccccaaataaatcacatggctgagctcacggttagagagggaggatactgcagtcccaaagcccggggcatggatccagagaggagggtgaagaatgggcccctgacccaagactgcacttgtatttgagttgcataagaagctgctgakgaattttaagaacaggagtgacatgacttccgttacaattgaaaaaatcaatctggcgaaatgaatggggctacataggttgggggaaggaggtaagagaggaagtgaggagaatagggtgggtcgaacctgttgaaggcccagagcttgcttctcttctgccgcctttaggaaacgagatgaattgttaaacttcttgcactgagctttaccaggtgagctgacagttatcctctgcattcatcaatataagccccataaaaggcaaagtggttgaggagaaaygagaaattacagcccagattagcagccttgagtgctccttgtgaacacaagacactsacccaaatcacacgtcacggctcttcgcccattaacgcttatagcaggattattcccaaggaagctgtagccattatatttgctgccatcacaacagtaaaataaacaggtgtgaytgcagccctactcctcgggttgtttcatgctgatcagttgttaatatatgtgtgacttgaagttggagcctgttgggagaaaaagttgtctttagaggagtaaagtgttgccttgctgtgggaaggggaaactttttcttgggaagtggactcaccaataatttttgcatcatgcgcaggagaccctactaaaacstaagtgtgcaatgctttaaatcagtaagtttgtttttcattaacataaaatccaaaacaggtgctgtgatcagcaagccgctgtcctccaagtggtaattcaggaacccaggctccttccattctgtggcttcaccttgaccaacgaagaccttttgaggttgccacattctccaggccactaacacttatgtcattggctacaactcagtcacatgaccatggctgcctgcaagggaggctgggaaatatagtttgctgtgtgctgggtgggtgggagggagcgtcmacattagtgaacagccaggcagtcgctgcctcamatttctttagkgttatcctttcatkccagcaattgaatttgatttgcactgtttcacttctctacaagggtgtaaaaagtagaggttcctcttgaaagaatttcctccccatctaattaggaataaatagtaacttctcttagaagcaaagttaattcaaagacctgtgctaacattcttaaatatctgctagctgtaatgaagaaatcaatgtactttatgttcttagctcccacagtttagcctaaatatttgccctggcatgcttatactggtccaagcaagcattaggtcatagcctgttcctcttccttatttgaaggtgtttttacctttctcagcattccacaagttacttcgtccttcctttgttctcctctgcctttgcctcttttttctttttttattttaattttttttttttaattatastttaagttttagggtacatgtgcacgttgtgcaggttagttacatatgtatacatgtgccatgctggtgcgctgcacccactaactcgtcatctagcattaggtatatctcccaatgctatccctcccccttccccccaccccaccacagtccccagagtgtgatattccccttcctgtgtccatgtgatctcattgttcagttgtcacctatgagtgagaatatgcgttgtttggtgttttgttcttgcgatagtttactgacagtgatgatttccaatttcatccatgtccctacaaaggacatgaactcatccttttttatggctgcatagtattccatggtgtatatgtgccagccatcccgttactgggtgtatacccaaaggactataaatctttctgctataaagacacatgcacacrtatgtttattgcggcattattcacaatagcaaagacttggaaccaacccaaatgtccaacagtgrtagactggattaagaaaatgtggcctttgcctcttttaaaaagttctaagttgctagccagtcggracaaatacagaatgtgaggtccctttccagccaatggaaaccggacacagcagtagagtacacgygtcaggttataaatgagcctgtctcctttgtccggtgttctctcatggcaaaactgctggcgagtgtaccctttctgcagaaagtaaaaatggccttgctgaggaaattaaattcctgttcgagtgctatttctttatggcactgaggagcaagyatttctaacaatcatattgcttaagaagtggatggcargaagataattactaatatgtctgcaattgatctgaaattgacacagttgatctawctgattcatggggaccctgggagtatgtttgtgtatttgggggttgggatgggggggtgggtggagggtcagagaggtggcaaaagcrggtgggaacagggttacagagcaaagtaattagatgccctttagatgctcttagttaaagaccatgcaaaaaggatgaaatcttttgatcatgttcttyacaatattagaggtaaaacatgaactcaacgcttttaggaaraaacaactggattgcgttttctattttattgacagaaactagatggggaggccagggtgtgttttattattgcacacatacgtaattacaaagtctttgcttttttcccctacataaatttattttgagatttaatttccaccaattagaacccgaatgaagccgttttaatgtgattcctgcatcccagcaacgtggccctgcttcttagtgcgcacgtaaagaaacaatcctggagtgaattttaagtacctaaagttgtgttagactgcaaatgaatatccaattcaatttgtaggaaactttagattaattaggtttataatttgcacagtaaggtaatgtaaatgtgttgctacggcttgactttttgcttaatcctctgagtggatatttaatctttttaatattagaattaaagcaacttggaagatatgaatattaatctaattatattccgatcactttaatttctttaatgttttaaataacaaaacaactttacaaattggtttaggttggggaacgcttttagaggattttgcatctcatcagtaagtgcaatttagaggatgcaggcttgggaagctgtaccttaagtttatagttatgcaaatgaaaaccattaatcctggagcctctgacttgcaaggtgtgcttcagaaatttgcagcttctatttaggyaggaagagtttgccagcccgaaaactccagtaagcaaacagctttatagyaccccagccatagaaagtgagagctttcgaagaatctgtggttagaactaagaggatttttctttctcctttttctgctgttattatctcaaggagagagggaaaaaaaaaatcagagcaggacatgaacagtgcttgcaaattttattacctcattataattgatacctgctctctgagccaataaaagaagctatattcagcactggctgtataagatctttaatgttttaggctgtcaatgttggctgtggttaggctgacataattrtgagctgcatgtaccaatatatagctctttacccacaaaagcatgctgcaacggggaatctttcagagataataaaaggattcatcaagtgtctatacgatagctacttaaatcgctattgttttagttaggcccgcaaaacatatcccccagctatcccggtttcttatctttcttacttgatatttcaggaatttcaagcttttgtacagcttgttcagttgcatcctagaggaggaaaatgcttttggcgtgatttccatttcaagatgacaacagggagaagtctttccaaaatgcgcgtgttgcaatttcagatttaatcaggggaatacattaatttctggaactaattacagattttaaaagagtgatgggtctggtacagtggctcacacctgtaatctccacacttggggcggtcaaggtgggaagatcccttgagtccaggagttcaggaccatcctgggcaacatagtgagaccttgtctctatgaaaaaatgaaaaataattagccaggcgtggtgtcgtgtgtctgtaagtcctagctactcaggaaggtgaggcgagaggattgtttgagcccaggaggtggaggctgctgtgaactgtgatcacaccaccgcactccagcctggatgaaagagtatgacctttgtctcaaaacaaacaaagaaaaatcataaaagggaggcagaaaattaactgaagaaattgtgttataaaaggcagtgttttaagttctagaattaaaagcaattgcagcaaataccaagtgagattttctgtattttgagagtttgtgtgtgcaatggttttccactgactaatcaggctgataaaacaacctgaaaatggctttcccatggagtttatatatttcgtcagagacctaaaatggtataaatgttcaataatagccagtgaatataaaactaaataatccatatgagacaaaacaggtagaagaaaaaaacattcctcctcagatatgcaccttttaattgaataaagcaaacagtaacagtgattaccaggacacttgctgttttctgttattttggtttatattgcttaattagccagcctttctaattaacattacattttgctgagttcacattgtgataaagawgaatatcaattcttttctactcatctcattgagagatagagttgaattcatcttcccttgtatctaggctgcacttattcgtttgcttgaccaatggaatgtggctgagtggccgtgtaaaatgcctgactaccctgagactgccatgttgaaggaagcccagctagccatgtggagaggccttgtggagcgggaaatggccaacctccatccattggaagtcatcccatttgaggccctagatactgaaaatcagaaagaagttacttcccattccccacctcaaggccctgtccaaactgaagattcatgggcagaataaacaattgctattttttaaaggtgtatgtttggggttgtttcctacagagcaatgaataaccagagcaaacacccaagggcaataaattatgaatagtgaatttaatttttctatgtgacctatggaatcagcctattttatggcagtacaaagtatatgtagcaaccaaacagtttcttctttcctaaaactcaaagtgagtcagacttcttaggcttgtagatgttgaggactaagctttgctctttatmttctctttatggatttccctttggaagcagggataagaagagrgaaggtctcccagatgtaaatttctcataaatatttgagctccatttcagtaattcyttcattctctgatctgttgcctaatcttctatttagcaagtactttccatgaaatagaaggctttaattgatagaattactaatttgaatagcttagcacagctcagcttgtaaaaaaaaaggaaaaccactatccccattaaattctcatcttgtaaaaccagccatcagcacctccctgtctttttactaaagtttcccttctttggtctttagtgctaagtaataggctgtcactagaccaaaaaaaaaaaaaaaaaaattcagcatttcttttcattggaggttaccccagaacacttaaactttggagaggaaaatagaacccctgaagaaaagtgaattctcatgacaatttgtacattctttgaagaatgactgtaatacatggaggagttaccttggacccatgtgcagagtagtgtcgtgaatgaggcctgtgccttgtcctgtggtttaaggataggtaaatgtatctggggcagagggttgcctgggacaaaggcattataagcttattcatttaacttgagtacagggtttctcaagctttggcactgccaacatgtggggttggataattttttgttgggatctgccctgtgcattgtaggatgtttagcagcatccctggcctctacccactagatgccagtagcatcccttccccctcttgtcacaaacacaaatgtctccaaacattgccaatccccctccattaagggtcatgtctcttggctgggataagtcttctctaccgtatccctttaactcaagaagtttttcttgctaagtttatgtgatcttgaaaatacggtgagattgaacttgattttctttaaaggacaaatatctgcttcttccaaattgtcataggaatagttcaaagctaaagagcctttcaggcaggctgggcacttcaaacctacaaaacatagtgctaaaattaaggagtgtatagtcgtgtgtttatagggacaggatatttattatctatcacttttgaaaatgtcattggcattatcgttcacttttacaaatacgaaggaaaaatatgaaggagttctagaaaacaccagaagtgattttgccgccatgggcctgaattgaagagcttaacccactaatctgttatgactgcttggggagtgctagcgcaggttctctaacacactgagagtcgtttggagggtagtgtgaagtggcgttatagttctccttttaatggttgagacaagaattgcctggacctcttttaggatacatcaccagtcttccaatggcaaacktatgtttattccagctgattctccccagcatgggggcatgaattgcagtggaaatcagtggactagaatttggatgcaattgcccccaaattatcgaagagaaaagaagaccactgtaattcaccggccatagcatttttaccaactgtttttgctaagcattagtttcktgtgataggttcaattctcaggctccttctcrtyagagtctttctgtaaagaccattattattkctgttatatttcctgtggctgagctgagccgcacttggagatttgatccattttaactctctcattgccttcagagagttggtgattttggggggggcaccagtktgagtcctttgatccttgaatgacaatttggatttgtctcaaggtcctgmtaaatgggaactggaggaactggcctactatggtattacaggctagcacatggtttgcattctgagggagctcagaataggcaaggtagaagacataggtggtcaagaatttagaaagacccggactcgaatcccagctctgatccatctcagctctgccatattgccaagttccgctgagrctccatttactcacctgttgtatcatctgaattatttycatatccataatgtgcaaggatatccttccatgttattagaaatacagatacaccatcattatcastggccaaatcattcaaatcgctgtttgcttcttctcgggctcttattcaagctcacgatgctattctcatagtgattgcgaatctcactgcataaaggtgattttgaaaacatcacttttcctccacactaatgtgtgagcttagccagagtaggagatatatcttacttaaaaaaaaaaamaamaaacaaacaacaaaaaaaaactccttcttcatttgttatagttccaggatagagtgtgtacctgkatagagagagtcaggcagatayaggtgtgccctccttccaagatgtgtgatggtgggcaactttctttgcatctctgagcctctattttctctatataaaatgagagagaaaaaaataattcctagatctagagttggtgtgaggctaaaataagctgcttttagtatcacatttggcaagtagtaaactctggataaatatrcttttgaattgtgtgattattgttgttaccatttattraaagggaatgatgaatgtagtgagagaaggaaggaagagagagagggaagaaggggaaaaagagggatggaaaggaggaaggaaggaaaggagggaggaggcaagtatawtagtcatgatatakggaattgaaaagacattcacrttttgtggtgaatgaaaataacttgacctttatgaagctggcctaatccctggaaggaaaaaatttccttggatatgtgatttatataatcaatcaactagtccttattttggtagagctaaacttctgtctttgggtttactcaccgtatctgtgtgcatcctggcartgtttacgatatacttctactaaaatattattttattctatactaacaaagggatttgttgtgtrtgtaaaattcaaatttcaatgaagattgtgtatttttatttgctaactctggaaaatgtgtttacagaagaaccagagaaggacttactcctctccgtacactttggacatgtcaaaatctagaaatagagatcagtaaaggtaacacatagcaccttaaatctgatttaaaaggaaaacaatgaytattatasagatttatggcttcttgtcaataatactctgatttctggagattgttatcagtcataagctttataggaaatatctcctwttgamaatgacattttaaattaatgtgaaattgtgttttaatttaattcacagggagtcataaacaggtgggagaattatgkaacaataattgtgtttgcaagaaatggatttcatcctaaaactccatgaatatgctattacagtttgttgtcatcctgaaatgctctgtttaaccataaaatacagcgtaaaagacaccctcatgttgaagtccttaatctagtgtgtaattgcttaagtgagcacattaactatatcgtcaactacctgttctcaaacactttaacaatcagctcaccaatatgggtgtgatcttgacattgagatgtagagcttgacacctgcatataaagtagaaactcaacagtgtttgagaatttgccattgcatctcagtcttttttatttatatgttttttctttttttgagatggagtcttgccctgttgccctggctggagtgcaatggcgcgatctcggctcactgcagcctccgccttccgggttcaagtgatgctcctgcctcagcctgcctcccaagtagctgggattataggcgcatgccaccatgcccggctaattttttgtatttttagtagagatggggtttcactatgttggccaggcatctcaatcgttttactaagaaatttggaggccttgagaaatgggtaaacttgaaacatttaaaaaagttgttctgctaattatcctaccacgtgtgtcagagacaacattaccctcttattacttaaaagtaatttggactggttcgcacacacaaaaatagctttattaacaacttgagtaatttatcaagttcagattctttttttcctccagaaatgctgcttttggtacactgagaggtcattcatttaaagtttgtccttggcaattccttattgaatagattccattttattttatttacattttgtacaaagctgataaataactgaaaccaaattagctcaaactggttatatttctgggtacaaaccaggtgtatagttaatccattgttgtttctgtgtcraccaccattgtcctcacctatacttgggcagtgggggtggggaggagaacataaaaacccaccaagcctcatttttcttgctaatttatttccttgaacttggtgagattctatctgcagtgtttccaaaaatagttttggaaattgcaaaaatactacaatgctgttgtgccggccacactgtgagtgctgactgtcatgcattttatagcccatstccctctccagtgaggcttttggccactggccgttaattggtaaggttcttgaaaactgaagtgatggtatcagcatggatgcccgtgctttctgatgccactgaagatggatagaagcttcaagttatgctttgtgcagactgaatttttccaatttgtgcttagtagcatcttattatattagaccagcactgactggtgatgaatagcaagattgctcccttctaagggcttggcaaaccaagaagaatgcagtgacatatgtcttatgtcttcaaaagcaactggacacttgaagagtattttctagtctcattttgtaaacccaattacgagcggagctacaatttttatctttgtttaatgtaaccaatgaggccattgtcactgtatggagaatagctttagtccatattctctgttttttaagactctcagtctccttgcaggtgcctttggagagttaggtgtttgctgtgatttgagggatagtggccaataattttattgaaatgaatattggttaattaaagcttattgtatgccatgggccattctaagaacttccatccacccaaaagcactatgaaatagatgttgttatttcactgatggaaaaacaagcacagagaggctaaggaatatgctgaagcttgcacagctagtaaatggcagaacattcagactggaattcagacttatacactcacattcataccacacagcctctcgaagggacgtgccccttgaacgcaagagaggtacattgggtggccatggtgctcacagtctctcaatcctttatgttgagggagaaatgataaccagatctcattttgtgtgccaacccgaaagcctgacttgactgcctmaaatgttargaaggactctaaagccctatctggattccaaatttatggttggtgcagactggatttttacaatttgtgcttagtagtatcttattatattagcccggcactgactggtgatgaattacaagattactcccgtctaagggcttggcaaaccaagaagaatgcagttccacgatccacttggaatgtgtgcagtgagtgtgggaggactggtataagtagcaaagcacttggcactctgggtgtaaagcattcagatctcttgcaaaatgcaaattttacctgcggggatacccattcaacaattagaagctgctgatttctggacgagagttagtttatttagaaagtaacactcagagacactgggacagagaacagatccattttaaggctgtgtgagcactgatccatgacagtattggttcaggggcaaagaatgggaggaaagaaaaagacaagttatagctgcactgaaaacaaactgggcatgtcctaattttgctcagggctacttctcttagagtcgttaaggttttgagcatattaacagcaatactgatcatagctaatatgcctctatgtcaggctctgtactgggttctttgagtatactcaccacctcctgacaaggttttggcagccttacttggtagacactatgattcccattacatacatggaatgtacagtaactgaggatcactgtgatattgggaaagtgggacttcagacgctagcctccccttgtagtgcctgcattcttttcacagcccctccccaccttagaatcattttcttcaagggagagtatggtttgtgatgcccttatcagcaaaacttcagctagaagatgcaagggtgaaatacacctccccaccccacgtgatctcatagcacagaatgactggccaccccagactgaaggttagggagactgggggccccagactcaaggttggggagactggggagagggaaagcgaggaagaagcgtaagtgtatcttacagtttaaaaccataatgggacatatcattttcttagttctccatttattaataaaatgcccaataccttctggcatgtgctttgaactgcttttaattatcttcagttggatggagaaaaggtaatggggacctcataatagtcgtggagggacaactgggatttatttccatagggaaggcagagactgtttgccagggaaccaaggcctttcaaagttgaggacacttcccggtgccgtgcggtgtaaatcacagtgcaaactatgcgattatcccctgcagaggaatcgastgtgactttatgggattcttcaccaagcacttaggaataatctgatataaaacagcaggggtggagagtaatgacaacttcaaattagtttaatgaatgtttacatttaaaaaaaaaaggcttttctgcaaacctgaaaataagaagtgacagcttcctttcctatttcccttgcaagaggtacctcctggttttcagcctgaggaggaaggtggctttatttaactccttcagccccggaacatcacagggcccttctttgtgcattctgggttctaacagccmcttgaacagtgcttgagagtatttccattataaatgtcgaatcggcattgaaggaacatctgttttaagtcaacttagactcaatccaggaaaaaaaataaatttctggctgtccacctgctcaaaaggtcaattacccacccaaatcagccagagatggctgatgggctacagatgccgaggatatttttagcaggattttggcaggtaccctgcttgttgaatgcagcaaagaagagggaggttgataaaccattatactgtttgaaagttggtgccgcgccaaatctcccaccaaatctggatggtgcttttgagctatttccccacttctgctgaagaaggattcatttcagtagaaggagtgggataggaaatgttcacattgcttgcagtatgtgaaatagacctcgaggtattttggataaaaaagcaacattcgtgttttakatatggttacccagcccaagccgcctctgctctttatagccgtgtttttgaagtgttcttattttttgttccgaaatcggaatatttcctgscgtgcgtatcttggccccatcacatcacaacaggctgaatgctgtccacaggttgccagtctggatatggaatattagtcaaaacgatataaactaacttggtctctgctataggagggacaaaataactacaaaacaaaagcaagaaataaaacaaaaccaaacaaaagcctgcagtgtttgggcccctttcagggatatctggaaaaccaaatggagaattccaggagcggatttggaaacaaggttgggtctactttggcctttaagccatcactagaaacactgactcttgcgcgctagagtgatgtttttccttctcttttggattgacgtgccagcacctcaagaaacctctgtgaaaaatccacaggtcttcaagaaccagaagaaaacagaataaaaatagctcaaaataaaaatgaaaatgaaaatagagcaaacatccatttctgtgggacctaaagagttgggaaacctaaacaaccagatgatgatagctgttgctgctcttcctgaaatcaattttaaagtaggaattgtcaaagataatgagactagtatggagcaaaaactggcaattttcagttaaccagaatgttgcatgaattagaaccccagattttcctggagatgactctagccaggccatttgaggacaagttgccaaatatttgtattttagaagcctcagaagtgtgcacaattttctagttctcaacaaggcactacagcaacatgtctagtgtttatgtaaatgatctttataaatcctctagctgatagagagttttcttccatcacaggcaaaatgtgggtttagatgcaatttgtaatattgttgtacaagagtggggtcctttcactgacatatacgaagtgttgtaatacaaggcaaagaaaatacaaacccatccttagtcatttagaaagacaacctggttgagaatttaagatgatggtttagggcatagcttgtggaattcgatgggttgcactgtaagtttcagtttccttatctgtaaaagtaggaataatatctagacctaaaggttattttgaagattaaatgagataatgcgtgaaaagtgctgactcagcacctgcagaacccatgcgtcgtcatcatcacgtttgttgagggatttgaggcgtgtctaggaacgcagatgtggagacacctggagcatcttcaggagctgtttctgcggattctcatgtggcttatcaagcacaggaaatagttttcctggaaagacatggagcaaagcagttatttagccgtccatccggcactgccaacctcttcgtgttcctgcaaggattaaatgagagatggtgacagtagagagtcagccctgagggaggagtgtacaattcatgggctactattccatgtgtgtgggtcaggagacgcttaaggcattcacagcactgggtgtgaggaaggatgcaaataagcttaacttatttatgaattatctgccctggaatggcattctaatgttgtgttggaagagagacaagaatgtgctgggaggatactcagtttataacggacgttctgatggccagtgcaaatggcgccaggaatctgtgtttatagagatggagcatggatgcccctgagcacctgtgtgtgtgcgaagggtgaatgggttgctgggagttcgtcggttgtttagggaagcacttacgtgtatgcctgtgtgtgtctctaggactcactctccacttcccaccttacttattattagtgttcttgtttctcttcgctatggggaaatgcagataaaccgtaaaaacttgatagagtgaacaaaggcttcggaagcttccttagttcttataattgctcaatgggttcttcttgcctgctgcacaggtaaaacccagttcactgagatgacattatggcaggaaagaaagagtttaattaacacaagtccagccaagcaaaaggacaggagtttattattacccaaatcagcctccccgaaaatttggaggctagtgttcttccaggatagtttagcaggaagggagctagggaatggaaaatgctgattggttggggatgaaatcattgaagtgtggaaaatggtcctcgtgcactgggtcagcctcagttccagttgaatcacaagtcccaggcctaggtggggtcagtgggtcatcaaaatgcaaaagtctgaaaaccattccaaaaaaaccagtcttaggttctacaatagtgatgttatctacaggaataattggggaagttccaaatcttgtgacctcctatgcctacatcttagctgaattcagacccctctcctaatcctaaccttgtggccttttaggagctttacaaaggtggtttcatttcgggaaaggctgttatcattcttgctttaagattaaagtataaactaaattcttcccagtgttactttgccctatgcccagggatgagtgaggactgccagcccgtggggctagaagcaagatggagtcagctatgctgtcatattcctcttatggtcacaatttcacaaaggtggcttcattctcatgaccattgctcccaggcattgttcttgaataccttagaaagtttcattagctcatgtctctcctctttgtaccaccttccaacatttccctactgccttggacattaaagtccaaatccagtctgttcatcatgatctgtggagcctttgataatcgcagcctccagcttctccttcacacctgtctcctgtctcctgctttttctttttgtgcactgcccaagaaccttttcatctactaatctttgagtttgccgtcctctcttcctaaatcactcccctccctccactgttccacgtgggacgttccttccagagaggcctcccttaagcccaccttccatacctcctctggttatcctcagtcatgaggccctgcttcctcccgcacactgagcacaggcagtacctgctttactcatgtacttgtttattatctgtgtcacccagtgggacatagtagactccatcagggctgggaaggaatctgccttcgtcaccattttgacatcattatcaagtgcgcaattaggctcacagttgagctcaacataggatctgtggaaggaaagaaggacagaaggaaggaagggggaagggaagaagggaggaagggagggaaggaaggagggaataatttccaggaagcctcattggatttctttcccccttatttctgaaagctcacctctttacagctggcaaggccagcagaactgaacaatagagccggattaagcaagcattcaggtgcccacttaattcaatcggcgaatttgcatttctcaggctctgtgccatgagagcctgccgcctcaagggaccacctgccttctaccagaaggactttgctccttggagaatttccctctggcaatggtccaggtcaaacgaggtaccatacaaatgtggcttgtcaccattttccagtttaactttctcaagccttggctgcctcgatttcattccagactacagtagcagctgaaaaggtagctaccattgcagtcgaagacactggcagatgggactggcttgttggcagagatggcagagatggcagagatatgaactatctctgaaagggcattctgcatgccacagttaagtgctctgttgaaggacggctctggaagggagcatccgcgaaatgaataagaaggtggttattagtgaggtctccctgaaaggagcatagctggatgcaatccttggaggccctgtctagggcctgtctggggctccagctttcatagggccggccatcccctttgctctgggtgagatctgtctttgcttctggtgattctgatattcactatcgagaacgattgctttaaaacacatcagatcaaagttttctaaaatcagagtaaaagctaaaacctttgcaaggtcctgcatgacttgagtccctgttcctcccttgacatcaaaatggctgttgtctgctctcgctctctctctttctctctctctgcttcagctgtcctgacctccttgacctttcttaaaaactttatgaaaactccacgtttgggcttccctccacctgagatgctcttctcggctcctgtgagggctacccctttaccctttatagtgtctgcccggacatctcctcactagagaccttccctgaccactgccacatggaatagtactaatacttcatgctcatcctctgcctgccctgggtttttaatttgtgcgtgtgggtggggtggggggcgggggggggcacttatcaccacctgcatattatgcttttgtgcatttcaggttggtctttcccgcaagaaggtaaactcatctgcagctgtattcgctgtgcctatggtagtgcctggcaaatgcacagaagtgggtattastgaggactttgtggttcgaatggaatgagtgtgctgctgacagtgttgcgagtcatctgcaaatgaaaagtccttccttctcttcccttctggaaccttccaaagaggctagcctcctgagagggcgtctcctgggaatgcctgtgatccaggcaaggcacctaaatcagccaataaataattagttttgagaaaaaagcctgcacaaaagcagaactcacagattttctcattgatcttcctgcctttgccttggccatggtcagtctttggggctattagctgcatgtacaagtgcacaggggatgggaggggggctccggaagatccctaacccattgtggacacaccatttatgttagtggaatctggtaagagtgattgaggagagagcattgggtgaatgaccctgtaatccttataaaaatagtagcaacggtaactaatgatgtttatgaactgcctaagaatgccatgactgtgtcaagcacttcccataactagctcatgtaaagcctgtaaccatcttgggggtgaggacaattatgtcccattgtgttatgtgtctgtgtttgcaggagttgttcagtggtaaggtgcagtcaggacttaaacccgtgttcctgagagtagctctgtgctgcctgacacactccttcctcctgaatgcacaatcatatgttcacgtgccacatggttttcagaaagcactgcacgtgtaggaagctcaagacagagacgtggctggtcacggtggctcatgcctgtaatctcaacgctttgggaggctgaagcaggaggatcacttgagcctrggagttcgagacctgggcaacatggtgagacccccatctctacaaacaacaacaacaamaaaaaaaattagccaggcgtgggggtgcatgcctgtgctcccagccactcaggaggctgaggtgggaggatggctcgagcccaggaggccaaggctgcagtgagatatgacctcaccactgccctgcagcctgagctatagagccagaacttgtctcaaaaaaacccaataataataataataataataataataataataataataataataataaagaaagcgagagaggaggtagggaatgaatgccgaaagtggttccttgggtctgatgcccacgcttaaccgattcccagccaaacatttcacagttgtcttacgcacaggcgtaagatatgcatctatcttggtgtgcacctgagaagtagttatgtctaagtttccgacttgacttggtagagtcatttgatcagtaaagcgcagagcagatgaactacctggaaagaaagtgccggaactccccacgtgtgacatctcacttcggggaaaggtgggccctgcgctgcgcttggcgaaggtaaatgcacctgggtatcctcttgacctggaatggtggaaaataaagaaaacttcagcatgtagcaagtagttgtgagtacgattaatgctgtttagagttgccagttctcttacgcactcagcgaaggccgtgtggcttcgcattaatcaccaccaagccaacatgagcttccagcaaaagagcccagtgattgggaacaaattcaaaacagctttatttcattgacagacaggacctttttgttaaactgtggtttaaagacctttacatctctgtcttgttcacacgttactgtagtcatttacgtaaacttaggaactaagaaccgacttatttatcacaacctattggcaggaaaagggtcacataaaaaagaatctttattggtaggtttttttttttttttaaagctaataaacagtgctagtggaaagtatgctgttatcaaccattattgaagtaagtgggtttctggactgaaaaaaaataaagaaaacatctaaatgtcagtgtgcaaatagaaagtagcagtcaattaaatgaggcagtgtgtggtcaccatagatggccaatgtctgtgttattagggaaagaagagaagccgggaaggaggaggaggtttctggggttaacctgtgttttgctaactggtgttagttagtctcagataagagctctatgtaaaccaactttggcccaaattgactcattgaaaaacaccttgtttcaaattttttccccctctatgaccaaaaagttacccaaacctttgtgtcacatatttaaggatgttcaaggcaaccaattagtattcaagcatttagaattattttgaaacatcttctgtgaaaaacaatttatttcctattccwaaataaatgcagaatattcctaatatagtttgatagttcctcctcaagacttatcattcaaagattgggcaaattgacttgaaagagaaaagttaagctatttccctaataccaaggcaatgcaggtcagctgcagtgcctaatgtttataaaacttgtaaatgttgaaacccacacttggtctgagagaacatcatgctccagtttgttcttaggaatgtgtttctgatgtgtgtgtgtgtgtgtgtgtgtgtgtgtgtgtgtgtgtgttttccagaaaccaactgggaagggccctaagctgagattactgttgagaagtaaattgtgcttttaaagtgtcctccagcaaaatggtctcctggctgtctttggaaatgacgtatcagtccagatgccctttttcttgatggattgctaggatttttactcaccaccgatggaaaattctcatagtctggaagggtggagcgtctgccttctatcatgattgtacacagatgagcaaagctccttggcaatgagtgaggcagacgggcagtcaggttcggactggtgcagcaggtaggctgctgctagggaggaaggaagaggcacagaagttcagggcgtgagagggtatgcgagagatgtcaacaatccaggagctggcttgcttcttcctttagtcagtggtgcaagcttcaagtggataattcaaatgaatcaatggaaaggcctcttttaacatttgatttgtttcttcaaagaacacagatgaagtttttctcatctctttagattagtgattctatattggtgagggagtggaagagaaatgtgggtgtgttgactatattctccacagaaactttttgaagtagcatcstcactcagcacagaacattttgacaatacacttccagggcaggtggtttcttactatgtccctccctacccccacatactttgggactcagaatgtagggagtgtactctcgagggatgcrgcccatacgtgaatgcatggaggcagcatataaggttgcaaagcactgaccttctctttttatgattcccatttattccatagactgtgaagtctgcctgtacatttccaggctagcagtttttaatcaaatgtatgatcactttcttctgatgaacacagttaaggggctttgttgttcaggtgagtctcacattgtactcctctcctaagagcatttattattacttgctacatacatttttgacaacctgacaatgacttttttgtcttaatttggagaaaacatactctgagcttttgaagttggtgtacttgttaaaggaagccagaaaagcttttcaaccatttgagagggtgtgaaatacagaaggggttgtgcgtttcttcccccctcatctcttagagccctgttacccaagagagttcaccaattacccaaaccaagtttcattttgttttctctctagtttgaaaactgtttttattgcttcaactctccttgtctaggagagctgtttcaggtttttagagtcctaagaaaggcttcactggctctctgccagcctcctgtcccattacacgctcaggcttgtagtcagttactctctgctggttttgctaaaccactcttgggtctttcttggcctcctgccccgcattccccttcacgttgtaaacgtagctttttaagttggtcccttgattgcttcaagtaattgatctgttggcctaaaaatgagtggctctgattcagaggtaggagttaaaccagattctgcctagggacaagtgtgttgggagctctgcttctctggagacaatggtcagcagtgttgcaaccaactccatgtctggtgcaccagatggtctcattgggtggtagggtggccaaaccttgtgtgagctggctcacttgttcattcattcattcgtttactcgttcttttttgtattagcttaaaaatgcttatacgccggccatggtggctcatgcctgtaatcctagcactttggaaggcagaggcgggaggattgcttgagtctaggagtttgagaccagcttggccaaaacagtgagactccatctctacaaaaaaagaaaaataaattagttaggcatggtagagtgtgcctgtagtcctagctactcaggaagctgagatgggaggattgcttgagcctagggggttgaggctgcagtgagctatgatcataccactgcaatctagcctgagtaacagaatgagactgtccccccaaccccccaaaaacagaaaacagtattcctatcatatgcattctcaactctgcagaggtcctgggtcacatttcctgcaaagttgcactgcctcccataggcatgagacctccacatggacagaatttcatgagtgttcaccttggtgttgctactttgcaacatagacttgaagattcagagaggagatgtggtaagagtttatttctggacagagaaaagctacaccattcatctagatctcattaatctgtattcattttgacatgcttttctgcagttgacgtttttatttattaagcgctttacaagatattcagtatcattatcgaagctataattattaatgatcaaagttagcagtacttgttttagctgtcatcttcatcatcaccatcaccatcaccatcgtcatcatcagggccacaacagcctcttcttttctcttaaatcttccagcaattcttcaactttgcctgtatatttatcatacaacataatcctagtatttagtaaatgcttrgtctttgatttcttattttcaaatgcatgtctttagaaccagaatgtgtgtagctgttttctggcctgaatttgggctgagatgatgagaagtttagttgccactttcagctwagtggaagtgttttccccatttggactccgggtcattgacaaacgtcatcactgtttttagttgaaatgtgcttccatgtggctgttcatcagcacacccatatctagacgtgtgctagcctcagtgagagttgcagaatctgtgtattcatttcctttatctagaaatcctcattatggtacataaaagagctttctatcgcttttttacattatagtagttattcgttattattattattattattattattattattattattattatttctgagacaccgttttactctctctttgcccaggctggagtgaaatggcacgatcgcagctcactgcgacctccacctcttgggttcaagtggttcttctgcctcagcttcctgagtagctgggattacaggtgcacgccgccatgcccggctactttttgtatttttagtggagacagggtttcaccatgttggccaggctggtctcaaactcctgacctcaggtgatccacccaactcggcctcccaaagtgctggggtttcaagcatgagccaccgcgcctggctttgttattatagagttatatggatttatcattttaggtggagatttgagtttatgtctcctacagacagccgtagactttgtttcattttaagatcagtgttgcagacgctgctgagtgtctccaaatgtctgttctccctttattacctactaataaaatacctaattttcaacagcctgggaagagactatatttccctgcttgcctttgcagctagagtgatcctttgatgaagttctagtaaatgggacgttagcagaactgtcgtatctcagggcttccgtagggtttataactgatccactgagagataagttgagagcttgagagtcaacctttagaaaagttcgtaactatttgtcaaaattaagcttatgtctgttccaggtagtaattttaaaatgggcttatattttgtatgtcctttttaatttcctttttctagcaattctcaatgtttttttaaaatctcttctggaggagggtacccttcacaaagttatttgccaaaggtctgagaaaaaaaaaagcctttcaccatggttagttcgagaagcacagcaatacagtacttctgctacgagtgtatacaggctgaggatgggtgctttgtggcccttttcttttaccggctgactagaatgttgacgttaaagcagttagagtycgagcaggcaactccgaccccaagttggagctgtgtgttgaagatagaagagcaaatatgtrgaaggaacctggatttctatttttttwaaaaatataataaatcatccagccccaaatgtcaggaacctgggtttctaatgatggttggctgtcacccccatttcccacactttaaatgagagaagtaaacatctgacttcctaaaaccaccgttctcactcaaagccgaatctcatcctgactgaaatgtcactagtccttttttttttttttttttttttttttttttttggtcatattttctccatttggagaggctggctgacccatcaatgggcagtgtgggggaatggagagacctgggattttggggacaacagtgaccatgaggggatctctacactcctacttggaaatggagtagcattctacacttaagtatctccctttataagctaggaatactaagaacctaagagtctccatgaggattagatgaggtaatgtttgtaaagaatctgagatatagtaagttgatcagcawatgttatttatcctcttcttccctctacaaagataactaagctgagatagcctaactcccccagctcagaaaatagcaagttatttgcaaaatcaaatgctgatgtaaccatttccattctgaactcagaaaatggagataaatctcttgcaaggcttttgattttagtttttagatacagaacctttaaaaaaaaagaaaaataaacgttttgccamagtgtagtatatacaacagatgtgagggaaggacattgttttaagtgggaaacgtcagctctctcaacttctacacattcgactattccctactcctcagtgaccccaaagaccccagagaaactcagtatgaaaaatcactatggaagtgcaatagttattactttgtttggaattcactacaacactgtttctcaaaatataattcctgagtcacttggaagattacaaccaactgaattagaatctctggaaggcatcctaagagtctgcatttgtatgaagcttcccaggtggttctgctcagccctaagtttgaaaactactggcagaatagtagcagagttacttattctacattcgttttttaacccattgtaaaaatcatacatgtatgttcaagacaccggcagatcacaggaagggaaaaaaaatcacttatgcttccaccaccttaacctagaaacctttaggacttttcagtacttcctttctgtctttttcccctatacctaagtttttatttacaatatagttgtagccatatgattgttgctttcattgttgcttacatgtgttaaataattttgtctctgtataataacaacctctggcgatttttcctttctctctctctcttttttttttcttttstttagacggagtcttgctctgtcacccaggctggagtttagtggcatgatcttggctcactgcaccctccgccttctgggatcaagtgattctcctgccttagcctcctgagtagctgggactataggtgtacatcaccacacctggctactttttgtatttttagtagagatggggtctcatctggtgatttttcaagtaaggtaatggaagcaagagaggtttacatacatggtgtacatatacctcggcagcctgtttccttcccttataactatctcaaaaaamcatattaagttatttttcagaattatgttttttcctgttgcttttgactgtaaagggcagacttaaatttagttaacatctgctctaaygttggatcatgtgtggagtccccagttttcaacattaaaaataaagtatttgttgaagtggggtttttttcttcttacagtatatgtagaaccattttcttgaaaatgtttcttagaaatttgttacttagaagatttgagccaatgatacattgccgagatttgtaagagtaagaccagcctacgctgagtattattttctcaaaggaatattatgaggcacatcccatcttcatatcagggaacaaactgtcacattttagtgaaatctgtgggttatgtgtgaccacacacagtgtcgtgtttgctccctttacagaaatctaagtaaaagaatcactttttcctagtatctggatgacttgatttcttactatcttgggccttcttggaaaccctgaaatgtagccttttcatcttaattcacaaagtgttcattctcacccttttccttcatgagaattttctgaagctattgtgaatctatggaagactcaaggtagtatctttttcacagcattcaaaaaaatgctgctggctccttgrcttgtccggtgcatcctccgtgccagcccccgctgtcctagaaccatctaagctaactctccgatgagctctggcctctggacctcagcctatccaggccccttcatgacccagtcacagtgattctatctgtacctaccacagctaggtaggcggtatgggaagaccacaaacttgagagtcagacggatcgaacttcgtctttagycccccacttaggtgttatgtgactgtggtcgggttattggtaacatcttcttgctcagcttcctgacctgcagaatgggaataagaatacctagcacatagggttataatgragatgaaactgcttaacgcatgtgaataacaacaatggctaacatgtatcagacgcttgtcttagtgtttattgttttatgcgtattgtcctgtttcatcctcatgcttaccctgagagaaaggtggtattattattcttattttgcaggtgaggcttaaagaggtcaattattaggttgaactgtatgaaatgactgtttttatagggaaaaacagtagccgatcatcaattccctaaggttccacgtaataatttgtccaggtctcatagcaaaaaggtggccggatgaggatttgaacccactgctctccaacccctaagcccgtgctttgtagaattaatcggagctctaaagtacttgaccctgggcctgacaccaatcaggagcttaaaacccattagtttcttttttgttttatttttgcccactattaaaatgtgccaaagtaataagatcaaacagggcccctgcgttttgacaaacatccgaattctgaatttcagcgtggaacagggcatggaaagcaaacacaatggggaaaattgccgtggccggtcccgacaatgtgtggattaaaaaaccacacgcatgcacagagacctgatgtgaatggtatttctgagtggaagctaagtaggagctgaaaatggccttttaaaatacagaacataaggatgcaattcacagagatggtctaaactgtaaacatgcagctgtggggtttgtgaggctcattgcttacataccgacagcatacaaattgtcaagtacttaaagttccattgttgctgaaagggcctccacccaatgtccttaaatggtcccccytttttttttttttttcaaaccacaggatttacatctctcgtagcatctaatgaaataccagcaagaattgtgtgttggtgtaagaaataataatctttccaaatccttttgttttgttatcatttgctaatagagatctttgaaagaaaattcaaagattgaagtttgtattctcctaaactcctgcaaagaagtcctgtgcaaggatcgttcactagtgttctgcatcgttcttcttactcaactctcccgagaggcattgtggacgcctgtggggttggtttttggcacccatccctgaccccttcttctccaggaaactctgttcctacctgctcctcttgtggctaccttgggaggtgccatttttatcaaggttagtgtgtggttaagcaccttgccacaagctcaggggaaaaaaaggtcccctccccagattttttttagaactggaagtttccatttcctggcactgctgaaagctctaggacataaaacttgggagccgatggccttcaggctgcccataatgtgaagagaggtcatttcagacattcagataaagtctgtggctccagtatttttctaggtcttgctccctccctgaccttttcacagtttggtgacacaactcttccttgaattccataggttgacaaattcccctgagtttgggttagggttttgttacttgcaaggcaggcatcacagggctgctcctggccatgcatagctttggaatcacttctctgattctcatggctcgggaaggagaaagtgtcctgtgtgtggagatggcagggtggctggagttgagaggagagtcccttgaatgccacgcaacatttctctctgtaggtgtcctctgcacactgtccaaactccatttttaaccttgactgcatagtaccatgtacattcattaagcatccctcgccataggagaatctgagttcctgggagcatttaacacagttcctggccttgagtaaaaacttcataagcacttgttgaattgaactgaatttgttgtctgtgtttaaaggacttgatggataaagggagatttaacagtttatagccagattggactcaaccatgatgatttctggtccatcttttagaatggcttcacttctcttggcctttatttctccaagtggtgataatgagacctatccctaacggttaaagtgacatggtccatttaaagtgcttaaaccaattgccaggcacataataggtgctcaataaatacttcctttatttccctgttaggcctctcccaaccagagatcaaagatgattggccctgaagttatttttccccccaaatttgatagaaatcagtagagatgctaaaatataatacatttgacctgcattgatcaaggtaggctaactgctataacaactttacaattagtgccttaacataatataaaatgacttcttgttcatgtaacatccaaggtagctgtacctagttgcaatgctctcttccaagtagatatttagggacacgggctccttctatcttctgtcaccaccacctttatttttagcatccgcggtcttagcaacagtagaaggaaagaatggagataagacagtgggtatttaatcaccttagcccataagtgactcacgtcacttctgactaccatatccaatttttgcctctctttttttcttgggttccccccgacaaaaaaaaatatgacagaagtatcacccatccagccagccagccatcaatccggtatccattcatccatccatccatctaggcatcccaggtgactcattcctgtgaccttgggagacagtctttcttcctagaggttgtttgccccaaccccctgttacattcttgaaccatatgtttcccattgtttgcacttcccctagtcacctggtgctttaatttttgcctgtaaccttctgaaactttccttaaatgttcggctttgacctgtcattcactaagtctttcaccatccttcactcatcttacctccttcttctgtggcatttcataaatttaatgattgtaattgtgattacaacataattgtttgtgtctaccccaggctttgcaacagggaactatatcattattttgcagacacaacaaattctgcaagcatgtatctttggaataaaggagagagggttggacacaaatgtgattacaacatatgcttctctgggcatagctttgccccattgcacgaatatagaaaatttggcaggctgaaaataagcggaaagatcctcaagctgttccttccaccccctgggatgctgattaagttaagatttcagattttatttattctacgggtatttgttgaatatttatttcttamgatrccacgcactgctttaggcactgggaatatagcaggatatacaaaacagaaaaatcatggccctcatggattattggttgtgagtaataggaacctttcaatctaacttaggaaaaaasgttagggagccaaggaggaagagtgggtgtgatgatgcatcaggataccagagaatcccgtggaatcccacagtgacacagccaagccttgggaggggtgacactagcgatagagacagaaacccacacaggagtccttttctctgtctctcatctctgcttttctytgtacatctggttcaattattctcttgccacgaatcagctatttgtattcctctgtgcacgtcgcagaagatcaggaatttgcacattatagtcacaaccatacctagaaccaaattgcctaacactgaatcccaaatccaaattcctgggagatagaattcaattcttctcttgccacamatcagctgtttatactcctctttgcacgttgcagaagatcaggaatttgcacattatagccacaaccatacccagaaccagattgtctaacactgaatctcgaatccamattcctggatttggatggactcaatctggacccagtatctacatttggtccagtcatctgtatccggcatcggggtcttgttgaaaaaccatggcttagccgggtacagtggctcatacctgtaatcccagccacttgggaggctgaagtgggaggatcgcttgaagccaggagtttgagaccagcccgggcaacacagggaggcaacatctctaaaagaattttttaaggaataaaaaggaaaagcatggcttttattctaagagcaaaggcattttgtatatttggcaggtatcccaacagatgcatcacccagtctcttaaattaagataataatttatttggcaagtgaattcttctagtgtagttagatagtgatgaaaagatttttatacctccaaacacacacacgcacatgcacacccaccaggctcttctttacttctcactcatagatttgaaaacaactattatattatagaagttttttggtatagctgccaggggtcattgtttccatcccctgtgtggagataagaaaatcgagatccagtggagtgtggggtgctgagagaacaagtctatgttttcttgagacaaagtcttgatctgttgcccaggctcgagtgcagtggcagcatcttgrctcactgcaacttctgcctcccrtgttcaagtgattctcctgtctcagcctcctagggagctgggattacaggtgtgcaccactatgcccagctaatttttatattttcagtagagatggggttttgccgtgttggccaggctggtcttgaattcttgacctcaggtgatccatccactttggcctcccaaagcgctgggattacaggcatgagcctaactatcctcattaagccatctgctttctgcagtcattttcatggcgatgtgttataacaggacagaccttgtactttggaatcaaacattctcaactctgctatctgctctttgtggggccctgaacaaaaatmtttactctctttgagccttcgcttcctcattggtcaagacttttctcactgcattatatttgagtgagacccgtatcaatggattgaaattctcagaaacccaagaccaggaatagcccagtgacaggaatttagaccatgccaagtgtgaaccatggcttgcgggggctcctgtctcacgctggatgctcctgcctggctgcctctggtctccagcagaagacctgtcgtgcttgagtgacaaagcagattgcttcctcccacctctgtgggttaggacccctttttctatcctagtttcactctgatgggcgagttcactcacagtgaaaccgtagcaaaacctcaaggtttggcttaactgcaaaggggtggttgatatcagattcatacgccagaaccagaagaccactcgtgagaaattctgtaagcacaggagtgtggtttrtgtcaaaatcaatctgatggagtgaagccattccttgccaagcgaaaatacagcatcatcaactacatccttgagcctagaacctcttcactcagcaccagctagtgggtaaagcccgggagaggttgtaacaaatctgattccctgacactcacctgaaacaagattcagcaaaattaaaagcaatattaatatatgtcgccttgggaaacagaggcagaggagaacaggaaagagtcagatggactttgatttgagacccgtttctgcttcttcccagggtgtgacctcagyggagttccagagcatccatctcctttgtaagacacagataataccaactgcatggatttgttatgasagttacatcaggggagggtcatgaggtcaccttcccatggccaggagaagcaggtactcaggaatggctacttctctggccactttatagacctatggagatgttgaaagtagcccaaaggaactgtgtgcctcgcatcttggtccatcttcatgggttgatcattgtggttcatatcactgtttcatgaaacacagcccgccagaaagtcccgagtgttttgatttcatcctatacctatagttacaggccatttaagatccacagtctgctcttttagcttctgccagcacatttggacatctgtgcagttcccagggcaggtgaagagttgttcatgtgatgcaaacttttgagaagggacgtgtagggaagatgggagggaggtgatatttattgagtattttctttttgctttcagctttataccttgtgtgtgcttacagaggtcatgaattgtccgctgttgtatgtgtaatccgtggcagatgtgcataataagttcaggaggggctcggttttgggaggccggggatactagaagataaccctaaaatgtggaaatctacatcagagagtggtgtgartggttcccaaaatgcctacctggcactcctaccaaagacacagcagagaacttggggcctcttgtttcagccattttcatcttcactgtaaatctagacaagataatgaatgaagaacctgacacatttaaggaactccatagttgggagcccagtgtgagtcattatggcgagtccctaacactgcggttcccctacttgagggcgcaggtaggggcactttgctgcctcctttgacaataagcattgccattgccatgtgatttgctttgcctaatgaaatgtgagtgacacttccagatggaaatattaagagccagtgtgtggttcaccctgaccccttcctatgccccagcaattaaggaagcaatgttcagatgaaacccatgtcttcctcctgggtccctgagtgaccacagtcaacagagcttccctgttggccattactaatgtcaagaacaaagctgtgtaaagtcactaagattttggaggtatcggctgttgcagtagaacctagcctatctcacctgacacaaacgttttctttctcacaaaacctcacaccagtgttgttttattcatctgcttatgcacgcgtatggctgcaacatccttccaaaatgcattacaggctctaatgcacgataagacagttaggttcgaaggaaaacaaagacaattgcacggcacagagggaatatactgctacggtaaaccgatcactaacayccggccctgaatttgcttcaaagttttcactaaggcacaaagggagccgtgtggagctccggagttcccatctgaggtcttgtctaactccttggcaacttttatgtatttgtataggagactcttttgccagatggttgaaatgttcatcctcctattttgttttaatgcaaactgacatttcttcatcttcctgcggtgggtttcttttatgaggtcgtgctttgcattttcatagaaagaatttctgactcccgatcggagcccacccttgtagtttctgtgggggctgttttggttaaccactcgcatcagttttaagtctccacaggcagaaccagaccatcgtgaacttcttgatttacatggtggtggagagtggctgagaaaccagggagaaacaggaaggagctgattgaggagaccaaaggagggtggggccgcagctctcaggcactcttggtgttcagaaggccagcttgaagaaagatgtgcatatttgcaaatgcatttcttgttcctagtgaagaggtgaggaaggacactgactgtgctagagctgtacaaagagaagtagaactctaaatagagaaaatatgtaaagatcaataaatcacaccaaaaataagtcataagaacaacaaataataccaggaataaataatgtaaaatataaataattcctaaaatggtgataacagcttatgacaagtaatttcttttttttgagatggagtctcgctctgttgcccagggtagagtgcagtggtacagtctcggctcactgcaacctctgcaacccaggttcagtcgattctcctgcctcctgagtagctgggactacaggtgcatgccaccacgcccggctactttttgtattttcagtaaagatggggtttcaccatattggtcagactggtcttggactcctggcctcgtgatgcacccgcatcggcctcccaaagtgctgggattacaggcatgagccaccgcacctggaggacaagtaatttctaagtattatttcttttaatcctcrcagtgactccttgttagggwttgctgcattttatacaaagaagaaaggagtctgtggaagtgacataaagtaggacatgtattcatttactgattcaacctttcatttgtacatatatgtatattttacagacacggtcaccctgtctaggtattaacagttattacaaagatgatataattttgcaatcaaaatacagacacagttgtctgtctcccaggctggagtgcagtggcacaattatagctcaccacagccttgaactactaggcttaagcaatcctcccgcctcagcctcccaaagtgctgggattacaggcatgagtcgccacactcaattatacacttaaatatacatatatatatacaatatacatatgtaaatatatctgcatatacatgtttagggacaaaaacacgggagtaccatttctgtctttgtctctctctctctttctctcacttgactctgttgggagctatattagttgttttctctttccaaaccaccttctggaggtctcttagattttcccaatgatgaaggagctactgtctaggttattacagtagtaatagtggccaagaaaatgatatgaggttgaagtggacagatgatgcttttcactcttctgggaggttcccactgggtggtctgctttgctgagctttgaaaaagagcttttcttcttcccagttcactgggccgatgtgggcacagcctcaggttttggtttttttctcctttgctccttcaccacctagaaaactaatttcctataaagaaaatttctctggaaatgcaactttctcaataggttgagtctactcaaagactgacaggtaaaagtggtccacatagaaaaacctgtttctctattttgttttcaaaattatatcatctttataataactgttagtacctagaaaaatgcatacattttattccttaccaaaaccagttaccctatagtcaaaaggcattcagaagtattagcagaaatgtagtcagtagccaggcatagtggctcacacctgtaatcccagcacttgcggaagctgagactggaggatcacttgaggccaggagttcaagtccagcctgggcaacacagtgagacctcatcactacaaaaaataaaaacaaaaaaattagccaggcttggtggtacatgcctgtagtcccagctactcacctgtagtcccagctacttgggaggctgaggcaggaggatcgcttgcatccaggaggttgaggctgcagtgagccatgactgtgscactgcacttcaacgtgggcaacagtgtgagaccccatctccaaaaaaaaragcagtatagtcagtaagaaagaaaacaaactaacagtcaatattgtggctgctctcaatgttctttaaacggatcacattgccacttttttctctttgtaaaaatgaaaattcccagcacatattacatgctcaataaatgttaattgagcattttctgtctgagaagttcaggcaacttttcatccttccaattgttaagttctagtttcttattacaaattattactgttattattttaatttgattgatatgcaaaagtcaaatttgtgcaaagaaaatgcaagctttgagatgagaaagcgtgtcttctggtatgtttcttgatacattttgagggtattgagctctaatttacttaagatgaccttttgaaaatagattaacttatcaaaacttgtggtggaagcaagactttgtcagtacagtactatccaaattctaaagtaatgaatgcttctctccctctggagttagagacctgactctggggtgtggataaagaatttgtgtcctggccaggtgcagtggctcatgcctgtaattccaacactttgggaggccaaggtgggaaaatcactagagtccaggagtttgagacctgcttgggcaacatagggagactctgtctctacaaaaaataaaaagaaattagccaggcatggtgctgcatgcctgtagtcctagctatgtaggaggctaaggcaggaggactgcttcacgctgggaggtgaaggatgcagtgaactgtgattgtgccactgcgctccagcctgggtgacagagtgagaccctgtcccaaaacaaaataaaacaaagagtttatgtgttcagtaagagctgcagtcacatctctagtacagactctgcagagcactaggaagccccgtgtctgaatgggatatggtgagagaggcagcctagggaatggagatacctgggggtccccatctgctcctgatggacagctcagatgaccccaagaccctctaccaggcactgatggagtaaggatggagatgggaattgcattttagaggtaagaagccaagtggcatgatgaggagagtattcatgaaatttatggaacagtctgggggaaatgccatgatttcaagcccttcacctaaatcttcaaaagtggcatggatcagtgcctctcttccccagccaggagcgtgtgaagcatggggacctccggaatgttctcagaaaatgcttggttcttcctgtgttgagcagggaagaagctgaagctagcatgggcaggggagaagaaagccagttacatatcaaagaatgcttatctccgtagacaccactgtgtttgagagtcacattgggtggtttgtaggcagcttttcattttcacagccagtcaggcaaggcttggaataacttgtctaagaatcctcatcttaaccctgtgctagaacaacaagcttggaaggagccagccaacaggagaaagccagagcaagactctgtgctggacaagaagtcctgagcactggggagttgacttcatattggaggcagagaagaattacctgccgatggctgttggcccatggcaacaccctagatcsttgcatttgtggtcctgctgaaagaggagacttaagttatagagttattggtacttgcaacactttctctggaatttggccatttctctgctcttttagtttagtacgttctcttggttgcgaggaaatcactgaagccacctcacgtaatgtgagcatgtatgctcaaggggaccaggaaatgctgaaagttcaggcctcggaaaggacaggatgtggaaggatgttctggactcaaggaggcctagggacccttggcaggaggcattcatgggtctgtagtccaaggctccactaccatctccttggcttctctcttccattctagcttcttctgcttattcatcacttttgcttcctatgaaattggtgcatcctggtcttggcctctttgagccctctgtatagtgtgagctcatctggtactcttgactctctcaggctcctgaaggagaaccatcagatagaagcatctcatctccccaggccatgccactgggcctcagccaggcttgaactagctaggctcagtccacggggtggccttcaagcagcctagacttggatccctaagcacagcctgtggatgggacgttttaaggtaaagggaggacgcagagcattgcagcccgttggttgttttctccagcacagccatgcaaaatccatgtagcggcaggaattttgcagctggagttgctcccctgagactctgatcagataaagacagggtttgctgaacaccgtaggtctggccctgagccgtgggcagcctgatgagcacaggtgaatggtgcaagggataacctcacagtcatcagcaagtcttatctgggccgctgcaaatatgacggagtcagaaaaatgacaacataaagaaatgcgatgttttctatgggggtttctttttgaaactaaaagaggttttctagactcactccatggagaccactttactttccatttttctcagatgataacatctgcaggggggctccttctgtgggtacatcatttgtcaaatatgtggtccatattgagaaccgcataatacttattaattaccacagttgctacttaccgtgggctgctaagactgctttagatatactgcagatattcaaagagaattcatcgtccacccaacggcaaagtccatagaagcccaggatgcattctgaccctcatcctttaaagcttactgaacatattgatcacctcttttccaaaggatacttcctattggagtgtacttttaaaatctattttttttgtcttaatgtttagtgtaatgagggagtataggatgaactcaatgtaccttgaacatagctgttgtcaggaatgaagccaatttcattttgcctgaattagggccctttggtgtcttttctgtatgcagttaatacagttcgtgtgctgtaccaagggtgcgaatgtgacttttcatcaggaaggccgcatatggtgggcacagggcctagctctgccgttttatagctgcataactggtttcttgaccttttatgagtctctactcatgttttatatggagacattagtcatctcacaagatttttgtaatgattagaatatttgtaaagttcctggcaaaggtttgattataaattagcgtcatcatgaacgttcaaggtggggaccttttttttttttttttgaggcagagtctagctctgtcgcccaggctggaatgcagtggcatgatctcggctcactgcaacctcctcctcctgggttcaagcgattcttctgcctcagcctcccgagtagctgggactacaggcacacgccaccacgcctggctaatttttgtatttttaatacagacagggtttctccatattggtcagggtggtctcgaactcctgacctcatgatctgcccgcctcaaagtcccaacgtgctgggattacaggcatgagccaccacgccctgctaaggtggcaatctttatacataaaaaacaggaatgacttcttcgaattggtgcactagagaaatgttttccagtcgcctaagcgtttaagcatggtaaacagattaccatattagttgcccagaccttgcaaaacttcatagtgtttgtttgtttcccttgggaggctgttctgagaaggaaccttttcattcctcggagttctgatgtgttcattggcccctgttgtcatgctggatatgggggcggttcaaggggggcttgggtgcctgagaaaaagagtgaaaaacccaactgcgaaaacccaagagaaaccgaaagagtgaacactggaaaaaaaaaaaagggggggccggcgagcttcaggacctaagcggttaaggaactggctttgacaggaagtgggcaggaggctgttttcagtatgctcatgggaacccagctggaaagtgctgtggtgagtgtgtgtggaaaaaaggggctttaatcaagctataaatatctgtttctttgaagttttatgaccaacaattaatgttactggaaggcccataaaaagggytgtttcttgacttggtgggtctgagtgggccagggtcgggttaagatgctagcctcgtggggtgccatcctgacagattctactgtgtgcgtgtgtgtgtgtgtgtgtgtgtgtgtgtgtgtgtggatataatgtgttgcattggtgtctaaagccatgctcagtatatagttatatatttcattcattcatccgttcattcagttatctcacgtttctggagggccctctatgtgcaatasctagtgatacagcagtgaacaaaggaaatccctgccctcagggagctttcatkctacttggggaaagagacgtgaaagaaatcaagacatgcaagcaaggataagtgctgtaaagataattcattcctgtttagagggctgaggacaggaagacgatgctgtatggctctagacagggttctgtgatgagtggcctgtggacagattcctgtccgaagaggtgcagggtgcaagggaggaggggacggcaagtatcaaggtcccgagtgaggcacatgctcggcggggcccaggcatgccaccaaggccaggaggagagactgaggaggcttggccatgccctgccttgttggtttttagaaagactctgttttggttattttgtttttctttttttgagacatctggagtgcagcggcatgatctcagctcactgcaacctttgcctcctgggttcaaacaattgtcctgcctcagcctcccaagaagttgggactacaggcattcatgccaccgcacccagctcaaatttttgtattttttgtagataccatgttggccagcctggtctcaacctcctgacctcaggtgatccacccacatcggcctcccaaagtactgggattataggcacaagccaccgctccaggcctagaaagactggattttaccctgattgagcgagggaggctctcgaggttttatttggttctgcccagtgaccagccaccataaccacatccttcccccagactttttcctcttcctataaaacaaaacaaacaatgtgaacaacaaaagcaaaaacaaaaaactaagtagtagttggggcatttttattttaatgctgcttttttttttctcaccttttgctatatgctgatcccagtgcatgaaatttttttgtaatctcattcctgtgttgaagctctttcactgctttcgtgagcacagatgaatttgaaggctgccaggcagtagcaacatataccagcttccccactgggtgttcattctacccaatttttgttcatgtggacttcaggaatctgggatttatgatcttcggatttggctcttggcttgaggcttagcctgtgcagtcatcttggagagagggtttactaagcaaagaacaccccagaacaatctgggggaactgtgccctttgcaagagagcagttttaaagtaccctcgggcaatttagaagctcctactgactcaaggatattcttacctcttcgttaaagcagctcgcctaaggactttgctagataaaagttggttttctcaagagggtttctgcacacacccgaccgcatctttttcttttcttttctttgttttttttttttttttttttgagacggagtctagctctgtcaccaggctggagagcagtggtattatctgggctcactgcaacctccacttcctgggttcaagtgattctcctgcctcagcctcctgagtagctgggaccacaggtgcatgccaccacgcccagctaatttttgtatttttagtagagacggagtttcaccatgttggccaagatggtctcgatctcttgacctcgtgatcttttctcgcctcggcctcccaaagtgctgggattacaggtgtgagccaccgcaccgggcctcacgtttttcttttaaagaaatgtgtaattcagatcagtcttgctttcaggtagtctgaattaggggagtttgcctgtgtgcaagagaaggcttcctacttcattttcttgtgtgcagggagccatttatgactaataggattcattacatgtgtgtttagcccaccgattattaaggctttaacaatattaaaacctaaagagataacagaggggaagcctttgggagctaggaatcaatcrtgctgggtggcttgaaaacagggcagtaaaatggcagccgcctagcctgtggtctttaatattaataaagccagaggcgatatcacttagttgttccaacatgattggttcctcatggatgtgcacccttgctcatcaccatctcaccaccaggctgaccctatacatcttccaggagcccagctctttcccctggaaatggttctctgagtttcagctgcagttcagggaaaaggccagcagccacgttccttgttttgtgtaattggtctttagcctgatctgattcatctggcgaaacccctttttccagtaaaagtcgttggcgaggagtgaattgtgatggaaacagagacagatgtatgtacctttcatggacataatttccccaagactgaacacaaaaatgagggtttttggagatctctctggaattaatgtaaacgttrttgaaaacatattattctatggctccttcataaaccctaggccatcccgaggctgtctcactcaggcccctcagccctcataaccccccagctccataggagtggagtttggatttcaactagataaggcccattttcatggatggacatgtgagttttcatctataatatagaatgctattttctagttaggttggagcaaaagtaatcgcggttttcaccattatattcaatagcaaaaaccgcaattacttttgcaccactactttttacctagcagttcaacagctgtaaagaaagatgctgagctgttggttacgtaactgtggtacagccatttcatagacaagtctacatcaatgaaaagaatgacacttctaaaggaaaaaaaatgggcaaaaattatgtgtttacatctatcagaaaaacaaaacaaatgtcacggtgtggttgggaggaggtggggagagaggcagattttggaggcgaaagatacacagaaacactaaatacctgtctattaatrctgacagtagttgcgtttaggggatgagactctaaatttgtttatttaaattttctcattttaaaaaatgagtcctttcaattatgagatcaaaaagaaatgttcagtggcttattgtgacccaacatttttctgtttgatttagatagagcttttatttgcctaaaaattgtgcttgcaatatatatgatgatttttttttcttttattaaatgaaaaagagtcatttaacagtcacagtggctcagccaccacccgcagcaggcagtgggcccacttcaccttcccagcaggcctccagtgcccggtgcagggtggcccattggcacccacaacaaacatcacgacattacttttaccgcacacttcctgtcgaggcacaggcagtgcttcagcctttttggtaacttgaatgaacatcaaaaggataatcagatattagttaaacttgttcctcttctccaatcattgatacttttctctcttgcttcccctccccctgcccttcgacacagagtgacaggcctgaagtaaaaagggwaaaggggaaccgagtgactcagcccagagtgggcctcaccgcagcttcctggccactttctcgctctctccttccaagagagaaaggggaggaagcccagagccttctatcacttagtaccgtgtcatataccacttccacaaatgctagggaatgaacgaatacatgtatgaatgaatgaatgtccatggggtcactcagaagtagtggcataatttagccagataaagtgcccacctagcactcatcccacctcctcactcctctatcctgtgaatgcagaaatacaattcctcatttacaaacarctgtgcatgtagggttgcttgcaaaagttcgtcgtgtgccgatatttcattaccacttttgccagcgctctcgtctgcatttcctgaggtttttcttttttttttttttttctttttttctttgatacggggtctcgctctgtctcccaggctggagtgcaatggcacgatctcggctcgctgcaaactccaactggttcaagcaattcccctgccttagcctcccaggtagttgggattacaggcgcccgccaccatgtccagctaatttttttgtatttttagtggagactgggtttcaccatgttggccaaactggtccagaactcctgacctcaggcagtctgcccacctcggcctcccaaagtgctgggatgacgggtgtgagccaccgcaccaggccatttcctcagttttaaaaagcaaataasaaacaacaacaaactgcatcagagtaaccgtttcaaaaacccatctcaggtctgttttttcttttttttttaagttagcattttctagaagttttggtataaaatatgtacaaggatacatatataaacttagtgaccatctgaagataaacctggaatgaggaataacaacctctcatttaaaggagttttaaagagacaagagggaggaaacgagaagagaatgacagtgtttctttcattaaaaggagcccaatatttattgagccaacaggtttacactgtgtctaccccagagtgtcatcagcccaaaccagatcagcgtcgtgggcgatttttttcactttactgctgaggggatttgccaatcgcctggtcagcttctgaattcttcgggcacacaggaggggcgacatggttctggcttatttctaagtccctttgaggtgatttctggtccacaaattgaggcaaaataatcctcacaatttcttggatattctctgccccagccccgttctattgcaaaggagscttctctaaaaggcttcccaatgccttagaatctacttaagggtatttttgctggagaaagagctgctgtctttgtccacctgtcgttttcctttctaccccaacagggctttctccctctggctgttttatttagcgggagaagacagaagagatggaaaaatggaccctgcatttatagctgttccttcaaggagctcaaactgctttcaggcatttccttattacctcattaatcctcataatggtcccttggcagaattattcttattttcagaatggagaaattgaggcacggacaaaataaatggcaggtggaaggtcagagagccaggcagcagaagaggtgggggcagcaggatggcttctggtttctgccctggtccatcagtcagaatgtcctcttcagatgaggagatgcagggtgaggcgcgggggagctgacattgcataaataataaaacaaatggagccacatttagttatcactcatctagcggaagtcgatcttcttgggacatgagtaggctctaacctggcaggtttttcaacatggaaccattatttgtcacatgtgttctgtgtgccagggactgagttcttctcaacggagtttacatgtgagaggagcaagggacaaacctcacaaataggaatacagacctcagaaagccgacttcacccttgcatactcctccaggttgccctcgcctcccgcctggatcactgctcaattctctctctctcttttttttttttttttttttttaagacagagtcttgctctgttgtttaggcatgatctagctcactgcaacctctgcctcccaggttcaagtgatgtttcccacctcagcctccctagtagctgggactacaggcatgcgctgccacacccggataatttttttttttttttttttattggtatttttggtaaagatggggtttcaccatgttgtcaaggctggtctaaaactcctgacctcaactgatccgcctgcctcggtctcccaaagtgctgggattacaggcatgagccacagagcctgaccacagtcctttcttttaagggcctcctggcacccagccatgttgggaccctttcagttctttctccacggagaaccagaatctcctttgaaaatatgttagatcacctctttctcctgctccgaactttctgaaggcgtcccctgttactcggagtgcaagccatgctctcgagctggccatggcatcctgcgtcctctcccttcccccattggctctgttcttcctgccagtgctcttccccctgctcactgggttccagctgtgcgggcctccctgctgttcaatggaatgagacccatgcccctcctggttatcccactcagagtgcccttcaacagctacagggctggcccatcctttctctgttaccttcggaggaagccttctctagataccatctttaaaacagcaatcttccttctccatccccagcagcacctctgacccccttcacctsctttatttttctccatattatcattgccatcaatccaagcacaatttccagttacttacccattttgctttctccccgctctttgagaatgctggctccaacagggcaggtatttcacctgttttgtttatgcctgcatccccatcactaggaacctcataggtgcttagcaaatttttgatcttaatacagaaattgactctcacagaataagaagaaggagcttgaagccgaggtttgtgcccagaagatctcactagattctttatactctggggagaagaaaggatcagggtcgggtggggacatctgtgggcatattggggagggggccaggaagaagccaggaagggggcatgctgtcattcgtgggttttgcaactttctgtggcatagaaggcatagaaggatctcttcatttaaaaggtcaggttggattttttttttttaacttcaacaccagttaacttacttgcttccatcataccctgtaggtactcgttatggacaggaatacatgtagggtgaaggctgctctgggtcagtggattcacagagaagtcagaattctcttttataaagagcctgcttttctcaataattgcataatgacgtctttgattcccaggccctcatgcctagctgtttccttaggcatttattcaagatccgagatgccattcgcaatccagcaggatgcatatttgtatctggctccaaaactttttttttttttttttggcccacatcactgcagcccatggcagaagagtctagcaattagcaggaactgaaagtgataatttattgcaaccaacgctgtgatctaatagtcacacattacaaaagcaaaatccatattttgttcgcagtggcaccgcagcgctatcatatgctccacatgctttctaatgtcttttgtttgtattaggaaaaaacataaccctctcctactgagaaccagagagagcccctcaggttctgagaatgacgacattcaacatcgtactccaaagggggttaggtttgtgtgctaggggtgaacgctgtgcaatttaattctgtttccaaaagatctttggaggataaaggatactttctgtcttttatttagggaaggcgatcatgttggcacagggcataagagagtagcggggctgagagtgggaactgaggagattcaagccttttgcccgtcgatcgcagttcagatctgttgattttgaccattgcatcttgcctcacatctgaacttcaggtgaagtttcaaaccaccaggcaacatgcattacaggcaaaatgataagtcaggtcctgccgggtgactaaggcagtgtggcaatgcttcaagcctttaaaaccatatcccagtggccccaaagcattaatatgtctggaacattgcctgtccaatatctagagaggcgcctgcagaatttgattcctaggtacatcaagtttttgagctggaagaaacttgagacgctctttagtccagcaaatttcaaacctgtctgctcatcagaatcacctgggagcttgaaaacacacagatgcctgggcctcaccatccagagagacattcatttgattgcagattgaatccagaagctctaagcagaggcacagtcacatttggggactccttttatttagtagaggaggaaactgagtctcagtgtctgagacagacagtggggattgaacacagacacctgactcccagtgggtggtattttctcctagagtgcatttctgcttcttaaccagcagaagaaagcccattaactaacccctcaggggtcaccatgggcaaaggagtgcatattaagaactgtctggaaagaaaagaaggtcattggaatcttcttcaccccttccctggtactgatggttgcatttcaatggatttctccaaaagcaattatcacagtgttcctgtgtgttgagcaaacttcccttgtaatcaccttagcgttttcttttgttaaagagtaagaagaatggtttcatagtgaatttttcctaaaatgtgcagggtgtagaagaaggaattgcacacaatacatgtctactaggcaggtcaacataaatgagtagaggcaggtaataacccagatacactttgttggaaagtggaatgcatagaaatggtcttcatttctgcaaagaaaaatgtacattctcctttttttccttgcaatatgttgccttctctgtatatcttttaaaatttctacttctgatagagtaaagggtatagttttgtccgttttgtgttgctataacaaaatacctgagactgggtaattcataaagaaaagaagtttgtttgattcacagttctcatgcctggaaagttcaagattaagcatctggggagggcctcaggctgctttcactcctggcagaaggcaaagagaagccagtgtgtgcagagatcacatgggcagagaggaagcaagagagaagggaagtgccaggctcttttaaacaaccagctcccgtgggaaatcacagagggagaactcactcactaccatgaggatggcatgaagcccttcatgagggatccgtccccatgacccagacacctcccggtaggctccatctcctgacatcttcacacaagagatcaaatgtcaacatgagatttggtggggacaggcaaaccagatccaaaccatagtgactatgatatatctttcacatttctctttacaaaaagaaaaacaatgtaaggtcccgtgacaattagccttactgccggggagaccataaggagtggtggagactgtggtaaactgcagcgcgcacactctgttaacagaggaggtcactttccattctagctgactgttgtcatatgaggatacacaactatgctggccagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatgaactttttgcagtgtacaaatctctaatttgagacttctaatgaaaagatatttggttacagtatgagagacaagggactaaaataaggttgtggatcattcagggttaaatcagagcaacagcatgagtaggagatatatagaaacagatttattgcaaggagttggcttatgcaatagtagggttgcctaggcaagtctgaaatccatacagtgggcagtcgagagaggcagacaggaactcttggcatatgctaaagctgctatccacaggcagaatttcttcttctccaggaaaagaaacagttcttctcttaaaatcttccaaatgattgactccgtcacactcagaccatctaagattatctcccttcctaaaaggcagctgaataagggcttcaatcacatctacaaaatactgtcccagcaacaccttgattcatgtttgactggataactggaaactatagcctagccagggtggcaaacaaaatggaccatcccagggtagatgttaaaaaaaagatacccaccaaagataaataagatcaagattagaatgtcttcttttgataggatgtctgatttttctgaatttttgttcctaaaacataagattatttttaaaagcctgagaaacgagacattagtgatccgattcagaaaagaagccctgggtttaagccaatacgagatgggtttgtatctttaagtggcctttattaccacagtaataaacagcaaacgggcccaaatcttacaggcttgtgttggctttgaccaatgaagtagaacaagacctctgaataccccgttagttccaggctgtgctttgatggctctgcacagacagctcttttcctatacaagtcaccagcctcacccgtgtctcttaacaaatgttgttgacaggccgcgttgcaatttttctgcatgttctgacagtttaattcagtacctcctagctaagcactcagcctaagggggtgcttcagcaccttggcgtcaccaggctgcaattaaaataattcagggactggggctgggcttgcagaaataggccttcttccctttggaacatacaatgcattttccagtctccccgtggagcacacgagatccttttagagcagagggcagtggaatgtattaacaagatgtccactggcaagaactagctccatttgtatgttgcacccaacggggttttctccataggggttaggcgtaacgtctttggtaaacttggcacctgtagaaaggtcttgtggtgggcaggggggtgtgaatgggggaatgagaactagggaacccaggacccaggacccaggacgagagttcagcaaagaccatttacagaagctatccttccaaaacggccactcagaaatggtgtcttttattttgcattctgtacaggaaggacaaatggagaaaagtctccagaaattggcctcgtttgaaaggacctcatgcaaagagagatctttggagacatttcagaaaggtttttattcaaacatattcgcagcttgtatgacagtggaatgttttgaaatgagcttgattctgtttacccatccttcttaatccaacaactctgctggtctctctgctgacacaagatcgttcgcaggttatagaaggatttaacacgtcaggtaaggtggaatttggtaaattccccaaatttacaaatagatgaaagttgggtaaattccccaaaattacttgatgacaaagatcatttgggagagattctttcaaaaatgcctactccctattcccatatcccagcctaagggaatgagtttaagtgggtctacagtgggtcctgggaatttgcttcttatctagcatccctggtgaatcttttcattcaagccaatgcaggaagtagtcctctgaaatacatgtccacagaacacgccgtgctttccagaagacgcaacagacagaaactttccaaagggaattacctgggatcatttctcatcctctctctctttctctgtattacttagccttaaaaaaaaaaaaaaaaggactaatacttcctgctttcacatctactttccagatagttttttctagaggtaggaggtacataagagaaacgtgttttatggctgtggttttcaagaagtacagcgttttggagagagtggaaggctttcatgcatgaaacactcagggaggtaggagatccatgagatccaagctaaacaattctggaagagttacctgaagttgacacttaattcaagctgcatcatcttcctcctcccagcagatgaagaccaaaggtggagggtggtgggggtggggggcagggagtaggggggagggggggagggggtgtggggagggtggggcgggggtgggcaggttcagggactgaggccggaagcaaaacaatgtactggagtgcttatagtttttgaggaatcagtgagaaatgtcatctgaatgtctcttctcaatctttctgaaagataacttgcctataaacataaaattaaaagcctgctgtctgcttagttcaggtattgggtcagcgtcttgtgactatggacaagaggtgtttgactctaggactcasctacctcatctgttaaatgggcaaactgggagggtgtttatctgcatgcaacatctccttccatttgaaaacttttatgaatgtatggaatattattgagctggtgtgtgctaatacactgctaggagccattggagatttgaaatgtgagagaatgcctgctgtctgtcgcatttaccaaacatcatgcttttcaagattgttaaaagttgctgaaacccttctttgaaggaaatcatactttgaagctcaatatatagcaaacgggtagaagagttgctaagagtttgaaaatgatctcattaaacaagaaacatatatacagtgcctacctaggaaagagccaggcatataatagccactgcataaagatgtcaagtcttttggacacaatcctaatatctcggaggttctgaagctaaagggtacatgtttaaattttatttgtttcattaaacacctaaagactctttctagctcactcctgccaaaggcagaacttgagagtggcattcttttctggtctttgaagacgacaggtgaagggcagaatgtcctgtgtacttgggcacgcacatgcaaccctggctggtggctcctcctctctgtcctcttcctccctctcttccttctcttccttttcttcctcatcctccttttcctcctcctcttctcctttctcctcatcctcttcttccctcttctttgtgtccttgtttccatttgcttcttgctttgggcaagttctcaccataaccctctggcaaaggcaaatattcacctaagtggttaagtctctgggcatatttgttgatctctgctgagtctctcagcccgttttcatccctcctctgcctctccctagccattagccaaggccttgacctattgactgcagtgttgccgaagcagctggactccgtgtttgaaaggttttctgaagaggcatctattaatttatgtatttaatttctgtatgaagtgactgttctcctcccagcacaggtattaaagtacctttaggggaatccagcagctgaaatcctcagtaaggaaaaatgcttagagtgtcacaaagcaaacgcattagtgggaaatgtttaggggctcaagcacaaccacaaggattcactccttccttggattttgtgcctcttcccctgttcctgaggcccccactgggaacccttagctggagaacacccgtttcattatggaacatggagaaaagggtgattgtcagctccaatttattccatamtatctgattcaatctgtagtttgactttgctaaaggaattaatttttaagatcttaacaaatccagtaacatttaaaatgacctatccagtccatgcatattagctattcataaagggttttaaacattattattaatcctagatatgttacttaaactattaagtccgttcaaggcattcagtttctgagtcctcaaggatggtaaggagagctgcaaatgggctcccttctcaagcaaaggcatcttatgccatcatgcacgtttctacacatctgcctgtagatacactctgtaggacaaaccaggtggctctgtccttcaggcaaagagctccttaattgaaaatgatgtgtgaaatttcaagagagaagtctaggaatggggagatttatgtactatagtcagtaaccaatcctgagcaaaggtaggcacagctatgtggtggtgcccttttttgggggggggggggcgggtggtgggggtacttactaaggaccttgcctaagataatcaacaatttttctttttcagccctgggaggctctaaagctggaatcaaaaagattcacaaccccacaaataggtgaactactctaaagcaatggttttcaaaccttgaaatatcctaacattgaaaaaaaatgtggtaacatagggttgcctgtgtcttattttggtctgtaaggacattaataatgttttggtaaaacctcagttatcatctgctattactgttatttcataagacacatcattttccttcaaaattacaatgaaaactcataagcatacatcaaagttgaaagaattttacagcgaaccaccattaacattttgctataatggctttatcatatatccattcatccgtctatcatatttgtaaaacaaayaatattttaatgccaaacatatacaaaggatagatcagtaatttccgagaaatattagttgacaacttgacatcaaattatgtacggttaagtattgatacaaaaatacgcacgaatattaagtgttgaggcagatagatgcacatatgtatgtcaccatgtacctttgtgtctccttgcatttaaaaatgcaggtcatgatgtgtaatccccgttcctctgttgatcagtgaacacaaatgctgggccccagcatgagtccttttcagagagtcatttggagacctacagaaaaaaatgccaagaatgcacgctgggaattcattaagagatttcaggacgttgaaatactgtgygtacttgcaatccccacttgascaaagstgtccaaacctcgacagacagcggccagagaaggccccatcatagactctgcgcctggctaattactcaggagcaaagcaggtcgttaggggtcagggggagggtgcacctgtccgccaccccaatttcctcatgatactggaaggcagtctccggtcagcacggggctgggtctagagttttcagttyacaaaagtggaaaatgtgatatgacagactggawccagcacagggacgcagcccctcacctgctgggggtctttgggtgggtcctgtagccccagagcctctcgatgasctatgaacaggaacagaaccagcaccccgagtggtgacagtgacaaaagggtcctcagtaacagcagtctgctattgttttgaatcattcaaaggaatttttttattttgatagtgaaaacaatttcttttagatgtagaaagggtagaaaatacagataagcgaaaataacaaaagcagaacggtcatcatctcaaaactcagagaaaagggcaccaactccatattcgtacccatgtacgtattcatacccatatctatacaccttcccttatccctgtccctgtctacacccacacccatacctaaaccaatatccacatttatatctatacctatacccatatcaatatctatatttaaatctgtgtatttagatatttctagaaatgcatatatagctatttttgcttttataaaaaaagtcacagaaacaattatattgtacacagtcctatataatctgctttcttttgtttatagaatactgtgaatgtctttttgttttktttttttttgtttgcgagacagggtctcactctgtcactcaggctggagtgcagtagtgcaatcttggctcactgcaacctccatctcctggatgccagcaatcctcccacctcatcctcccaaatacctgagactacaggcagtcaccaccacacccagctaaatttcttttgtgttgctatttttattagaaacggggtttcacctttttacacaagctggccttgaactcctggactcaagcgatctgcccttcttggcctcccgaagtgttggaattataggcatgagccactgcactgggccaggaatatctttctatgacagtaaatattattttacatcattttcagtgataccatagtatcccattatatgcttttcagtaataagttcgaagccaagttcctggatcagcagcatcagaatcacctgggaatttgttagaaatggaaattcttaggccactccccagacctactgcgtctgggggcagggcccagccgtctatatttcagcaagccttccaagagacttcagtgcctgctaaagtttgatgcctactgccttaaataaacttcttcatcccttgtcaaacttcctaggggagcacattttgaatttttgacctgagacctcaaaacttttacctgtgctcactcagttcaggtgaaagaatctttggcattcagaagcttgtgttcacactcacctacttctcatggcatgattcctcttacctctaaattctactgacttaatcaagattgagggattctgggatgaatctggggacactttttggtccctgaaataaaatacgcaaactttggagtatgagtgcgtatttggggaaagtatacctatcagattttcaagaacttcatgaccctaaaatgactctttcttaaaataatttttttttttttttttttttttttttttttttggagaacggtctggttctgtcacccaggttggaatgcagtgtcaggatcatagctccactgtgtgacctcaaactcttgggctcaagcaactctcctgcctcaagcaactctccagcctcagcctccgagtaactgagactacaggttgtgtgccaccatacccagataatttttttttaactttttttcttttttttttttttttttttgagatggagtcttgttcttatgccgaggctggagtgaagtggcaccatctctgctcactacaacatctgcccccygggttcaagcgattctcctgcctcagcctctcgagtagctgggattctgggtgccccccgcaaccatgtcccacgaatttttgtattgttagtagagttggggtttcaccatggtggccaggctggtctcgatctcctgacctcaggtgatgcacccaccttggtctcccaaagtgctgggattacaggcatgggccaccgctcccagcctttaactttttgtagaggcagaatcttactatgttgcccaggttggtcttcaactcctgagctcaagtgatccgcccttctccgcctcccaaagtgctgggatgacaggcacgaatcaccgcgcccagcccaaaatgactttttatttgttatttttgatctcatccttgctgttctgttttgcccaggttggtcttcaactcctgagctcaagtgatccgcccttctcggcctcccaaagtgctgggatgacaggcacgagtcaccgcgcccagcccaaaatgactttttatttgttatttttgttctcatccttgctgttctgtttttcccagttatatcaataacaaagaaaagaaaagaaatctactcagggtctgttgggcatactgcccaagcacagtgtgaaatgactgccttttcactttttatcttttggatagcccaaagaccagcctgacttagcagcctgatttttctttgctggaggcagatcacactctgcagatctccactgaaaccccaccctcacccttcgtaataggcgacatgcacattttcatgtcacatttaaaaatgaaatttttcttgaaaatgttcacatccttcccccagaaattctagatttataaatttctcccaaggaaatcattaggtgctacctgaaagtttatgtatcaggtaatgatcacaaaattataatcacaaattaaaatagccataatgtctaataattcgacattagtgacagagatgatactacagttataggatgaagtgtcataactggggattttggaaaatgattagggacatggtgaagtcgtcatagaataaaattaagtgaaaagagtcaggttgagtgtagaatatatttattcctattcagcatatgtattacaaaatatctgggataaatgagaactgcatgctgacatttacattttctccttgattgtcttatctattatcaggattttctacaatgaacatttgttggtttataattggggggaaacctaaattcataaaataggcactctgttggtggcaaggaagcccactagtccactgtctaagtgttaaatggattttagcttcataattctggctttgactagaccctcttacaagcaagactatatcctctgcaaaagcatcagcggggtcctgcagtgccttcttgacacacacatcagtgtatacccagagctcttgtttctaaatagctgagctgcgtattaagtatggctaaccacacatccatgcatttttctggtgtctacctgaccacccctccaggggagagataaactcaaaggggagaaaaaggtatgggagcgaaagattgcaaggtgcaggtatgtttgcagatgaagggattgtccaggctgagctgtgcagtcctggatgaaccaccatctgggcacttcatatgccattcatacttaagggtgattggctattttcatcatcaagaaaaacattgctttaaaattttccatagttattcgggcatggtggctcaagcctgtaatcctagcactttgagaggctgaggcaggaggattgcttgagcccaggagtttgagaccagcccgggcaacacagtgagaccccacctctacaaaaaataaaaaattagttaggtgtagtggcgtgtgcctgtaatcctagctacttgggaggctgtggcctgaggactgcttgagtcctggaggtcgagactgcagtgagccatgatcatgccgctgcactccagcatacgtgacagagcaagaccttgtctcaaaaaatttaaaaaaaaaagttttttttttttaatcgccataatcttgtgtgaaatacttggtcatctgagcaacattatccttcttctccccatcagcctggcatgagcttggcagatgcaagctcagatcatcacctgtgtgagtgtgttgtctttgtgtccgtgagcatgtgtgtgtgccctgggttcctctcccaggtactccagagctcttgacaataaatgagaacaatatagaggcagggggcacttttcatctcaggccagttccaggactctgtgtaaactgtactaagccgaaacgtattcctttgtcccttttgccgctgtcctcctaatccacatctgggcagtgtgcactgtggctgggagttgacacagatccttgtctcccagacccccagtttctatcgagctactgtaactttaaaaagatttaacaaagactmcctccactagctaagctgaaataagaatgtctccggagtttaatggatcaagtagcggtgataggttttatggctcttttttactttagggcatagggaagagagagccgggcaggttggttttaaattcaaggatttatgttgttaatcctccgggctaattataatttatgggatcttggcaaattaatatgcagttgctattcaaaagtggagagcaatgtaaggcaggcataaacaagccttgttcatttttaatttatttccaccaatggagaatattaaataaaatgaacactggggtatttcgctccaagtttggtgttcattatttatctctaaattatgatattcatagaacaactccttgctttttcacsaagaatctagaatctagaattatctgagcgttcgcatcagataactaggaagaaatcagagtcattttctctctaaggcaggctcgatgatacctgcacagaagcagaggtttcccaagcatgcatgttactgcagtacaagatttggcattctgcatgttggggttgtttagaaacagaaactttggagtagtatgtgagcttaaaatgtcagttgcatggaaatgaaagtgccaaccctccaaatcaagagtccagcccgttatgtcgcaagggctttgggaaatctcaatttattgctagcctggtagatattgagcagggtgtgatcctgttattgggctttcagactttmgcttagcaacctcattgcacccaggacccccatttaatcagcgactcctatggctgtttgggggctctctttcaaataattcttctcacccatgaacatctgtcagaaaactttcactgattggcaaccaccaggcaggtaggtttgactcatgtgataattggttgcaccactagaaatgagaatgcccctcctacttccccgccacctcttctcctcttacctttttctccccgacatgcccctgccaacctccccccatcattccagctgggagaggccatcaaatgtagcttggagagctatagaaaccttgagctctgagcccaaggagcaagttggagtcctgcctccagctgtgtagctcagataacagctggagcagagaacatgctgttctctctgctagaatatctgacccaattctgactagtaaagagagttaatagtttgtacctcaagtcattcttgtccctgtgtgaaggaagagaagcagtcatttccctccacctccaacacacactccgtccccactctgtctctcttggctgtttttctcttcattgttgttaaactcacgttcatttctcttgtagtcagggaaatgaagagccactttcaacaattctgaagaagaaatatgggatgttttgcttcgggatggaggctggagcaggagtttctggagtctgccagtacccagtttgaatcccagctctgccttttatcagctgggtgttgggcaagttagctgacttttgtgagttttctcatcattaaaatgagaacactgttattggtctttcgggattgttttgagaaatgagatatcgagacatgcctggcacaaggccttaattcttcttcatggtmaagaaatggcagattttcccccttccattcccacccttgcacatagtaggttctcagcaagtatttgtagatgtaatcgaccagcagagatcatttgtacccttaacacccacagagagtcacagatgctttcactgaaggagggtgtcccaagactcaatggcagggaataaaaatgccaagtcatgtaagtattccacaaagttagaggggaggagtaagtatctcttattcgtgcatctttatggtatgaccaagggctcatgatttgtaagcagttcaggcactgagacccgggacacaggtgacactgtatctgcagattcctttttctcattgtttctctgtcatgtttaatttttggttttgaaaacagcagaaaatccaaccagtgtgttcacaggacttctggctttgcagcaattcctttttctggggtcttttgcctaatcgtttactggtttggagacactgttttctgtattgtttaggactgaaaatgtagacctaactgaaatcaagcackcgagtatcctaattattttaaattcataatgaatagtcatcatggtttcactttttttatgtactcttttgaaagagtacgatgggggaataaaagccagaaagttaaaaaataaaaatagaaaagagctgcaattgtcaagagaccaaaaagtcttgtaaaaagggcagtaggtaattctggaggcaaatcagcatgggtaatgtctaggcaaacaggatagaaaaagatcaggaggtcacagtgacaaaagtatttaggctcatcatattagaatttcatccaaagaacaattgattatgatttatagaccacaccatcccatgagcccagatgtgtgtccactgggcctggcaggggacaaatttatgtaacagactccatcctgaattccagtcctcaagctttgagggtaataaactcaagctttgcaactgggtcaagatcaggcctgtctccttcttgatgatgagttgtctcataggaccctgttaagcaccatccccaaactccattctttttggtgaatatcccaacaaactccccagccatacctcaatgtccagacttgcctgatccccagggctggacacagaacaggctcattctgagaatcttctctctctccctccttcccattttgctcctcctaccaacatgagaagctagggggtctcatctttaaataattaattcttctttctttgtaagtattatacatgccaaacagactcttggtttgtgtctactgacccaacaaaagggctgtccacttgacggacaggcaacagatcatcttgataagtacatgaggcactcagatgtcaagtcaccaaaccttcattctgaatatttttgaggctcatgacagaccaaaagagccagagagttggggaacataatttcctttgctcataccctggaccaagaactgttgccaggaatatccatccatctgggggcttccagcttccccagatgcctgcgtgccttttgacccttctccttcccccaccctgcgagttcttcaacaaatactcttctaaaccaacatccccggcaaacgggagcaagacaccagcttttcactgatgcagatatttctgatcttttcatctcggttttatttctcactctcccactgcataaaagattaagaaagcactcgcatgaatgtttgcacatcatttaaatattcattttcattaatttattcatagtcgtaaagtttattgcctagaatatagagtcgtagaattttagagctggaagacaggagagaaatcatctagtttcgccgcctcgttttacagatgaggaaactgaggtgaagacagctcaggagaccgtccaaggtcagattctgaagtgagccaagtgagacccaaactcaagtcttggacagtctagcctctgtgcagcgcagctcagcacagctgaaaaccacttttgctctctgctggcatagatggctgtgctttggttcattttcttgctcatcttcatgatctagcaagttcttgttgagtgccagcccagtgcyaggtgctgaagaacaatggtgaacggcacagtcatggtaccagaactcggtctggtggaacagagagattaagcaatcagaaaaacatatgtgtgtgtaattacacgttgtgataagggttttgtggggaatatacaagctcaatgtggagactagtggtgggagggcagaggcattttcccaggaagtggagaaagggaaggggaagcaaaagccatcccagggtgcgttagggagcaggtactgctgtggatgacgggtgaagaattcacctgggaaacttggggagaccatgtggaacatgccgtctctgagttatgccccatcagggggcaaagaaactggagtacttacccaccagatcctcatctgtcgttggttgaggactgctctcaggacattcacatccaggcacttctggtccacaccttggtacaatatttgcaatattagggacatgctaatacaattattcattgtatatgttaattcaaattaaatggaatgtcctatattttatagggcaaacttaggcttacgcctgggtggaatgagcaatccctgtcgccaaagaaggtccccagcatagcagttggctggagaaggaagggctgaccataagttgcactaaactgctctcagcagggtgacctggaagatcttggagtgtagatgtcaattaaggcaagtcctgagggctcggatggagccaacttttcacccgaggaggggaagagggagggttaaggagggcaaaggagagatttccaggcaaagtgcacattaaacaccagatgcgaagagctagacccccttaatgacaatttgctttctgtaatcttgaaccagggtctctcagtgtgtggaaggaatgtttgaatcggagtagcagggctgagtggcagtcctaaggcccagccacaacgtgttcttgacaagccatgtctatgtctggcgatgtgctcgcatggcacatgatcctgtttgacttcctgacagccccaggtgctggcctaaggccttccaaatgaggaaggaaggctggaagaagttaagtcatttgctagtaagggttagagccaggatttgaacccagatgactacagagttcatgcttttaattgctgcttgttaagtgcatctattatgggttgaattgcatccccccagaagatatgttgaagtcccatcctgttacctgtgaatgtaacctcatttggaagtagggtctttgcagatgtcatcaaattaatgtgagatctggctggattaagatggagcctcaatccagtgactggtgtctttattagagaaaagagagggagatttggagagacacacgtgtgtgcacacacatatctacgtatctacatgtatgcacatacctacatgcatgcacatacctacatgcacacacgtgtgcacacacacaagcagaaggccatgtgaagatggaggcagatactggagcgatgctgccataagccagggaacagcaagcattgccatccaccaccaggagctggaagtggcaaggatatgttctgccctagagccttcggagggagcgcagcgccagagacaccttgaattcagactctttgagttcctgaataaagagagaataaacttgtattgtttcaagccacctagtttgtggcactttgttatggcagccccaggaaaggaacacagcatcccctgtcaacaaaccaaggggagctaaagatataccctttagccaagtaaaccagctgccccgagcaggagcacagcttccagatcactcatcaaggggccgtgggtgacagggctggcctgctgctgcctttaatgggcgtagatgttgttgttcatgtttcccagcccattggtgatgacacagaggcaggagccggggctgcagactaaattatatacatctcaagggcagttagacaactagctcgcccacaggaacattgcaataagcacagtatctgctttcccagcaaagccaagtgcaagttcctgcctgctctgatgacctcttgtgcctccagtgtgggaagggaccaggtccctcaatgctgccgcctcccaccctgtgctgccacgtggatttaactccttcgtgttccccatgttcttagtcagtatggttgttgtgccatggattcaaatggggttgcttgatttgatttgccctttacttggctggaattctctctaacaatcaatggaaacacagctcatagggatgcatgtagcctgtctcatatgtgaaaaagaaactttcaatgtatacttcatctcattccaacaagaattggaaacagcaacatcaggacttatatggtgcagggtggtcagtaagtaggaaagaaactcggggcatggaagtgaacaggaagcccagagtgaagccaggacccaaaacccacaggtgctgctcttgttataagccagccacacatttgtctttgagccttttagcagctgccacaaactgggagaaaccatcagttatgcagtttacaatatctctaaactcaaaacaagccagtaattcagaaaaagcccagttcttctcacaaagaaagatctaagtgtgatatgagagtatatgcatggagaatattttctgagctggtgatgagctgcagggggcctctcccagcccccgcactggttgcacttttaaataagagaaaaaaacagtgataggactgacctgcgtgtagaagtttcaagttacaagaaaaacacttcacaggatccaaatccttaaagtcctgaaggaaacagagagcatatacaccagctttcgccacccaattcggatgtgttagaatgaagagtctcttattttttaatgaatttttctctatttaaaagtacagggatacctcagagatattgcagatcccgttccagaccaccacaataaagcaaatatctcaataaggcaagtcacatgaattttggagtttcccagtgcatacaaaagttgcttacacgatataatagactcttaagtgtacaatagcattgtaagaaaacaatgtacataccttaattttaaaatatttcattactaaaaaatgctaatgatcatctgagccttcagcaagttgtcatctttttgctggtggagggtcttgccttgatgttgatggctgctgatggatcaagttggcggttgctgaaggttggggtggctgtggcaatttcttaaaataagacaaggataaagcttgctgcatggattgactcttccttttacaaaaggattctctgtagcatgcactgccgtttgacatcattttactcacagcagaatttatctcaaaagtggaatcagttctctcaaactcgccactgctttatcagttaagtttatggaatattctaaatcctctgttgtcatttcaacaacattcatgacgttgttcatgacaatgttcagtgttcgccttcaggaagagcaagttccattgcaagaaatcactttctttgctcatctctaagaagcaagtgctcatccattcaagttttctcatgagattgcagcaatttagtcacatcatcaggctctacttctaactcgagttctcttgctatttctaccacatatgagtcttgaaggggctcaagacttacttcctccactaacttttgaacccctcagagtcacccaagaaggtggaataaacttcttccaaactcttgttattattaatttttgatcctttgccatgaatcacgaatgttcttaatggcatctagaatgctgaatcctttctagaagattttcaatttacttagcccagatccatcagaagaatacagtatctgtggcacctgtaggcttctaaaatgtatttctttaataataatacttgatagttgaaattactctttgatacataggctgcagactgggcattgtattagcaggcatggaaactacattaatcttgtacatctccatcagagctcttaggtacgaggtacattgtcaacaagtggaatatttttattttttttattgttattgttttgagacagcctggtctggaatgcactggcatgactgcagctcaaattatcctcctactccagccttcccagtagctgggactacaggcacatgccactaggctgggctatttttgtatttttagtagagacacaatttcaccgtgttgcccaggctggtcttgaacttgtggtgaatcaatctgcccaaatcagcctcccacagtgccacaattacaggtgtgagccaccacactggaccaagcagaatatttttaaaggaatacaaattttttcccaacagtaggtctcgacagtgggcataaattattcagtaaatcatgccataaatagacgtggtctcatccagggtttgttattccatttatagagcacagggagagtaggtttagcataattcttaaggaccctaggattttgggaatggtaaatgagcttggcttcaacttgaagtcaccagcagggaagagagtcagcctgtgcttcgcagctttgaagccaggcattgccttctcctccctagctctcaaagtcctagacagcatcttcttccaacagaaagctgttttgtctacattgaaaatctgttagtgtagccaccttagtggtcttatctagatcttctggaaaacttgctgcagcttctgcatcagcacttgctgcttcatgttgcacttttttgttatggagacggctttcttccttaaacctcatgaaccgacctctgctagcttccaagttttcttctgcagcttcctcacccctctcagccttcacacaattatagagagtgagggccttgctctggattagattttggcttcagggaatgttgtggctggtttgatcctgtatccaaaccactcaaacattcttcatatgggtgataacgctgttttggtttctatcatttgtgtgttcactagaatagcacttttaatttccttcaagaactttttctttgcattcacaacttgcctgtttggcacgagatctggctttcagcctatgtcagttttcgacatggctttctcgttaagcttaatcacttctagcttttgatttaaagtgagagacatgcaactctgactttctcttgggcactgaaaagccattgaagggttgtaagtttgcctaatttcaatactgttgtgtctcaggtaatagggaggcccaaggagggggaaagagaaggagaacagcaggttgctggagccagtgtggtattcataaatataacatttatcaattaagtttgccatctgatatgggtgcagtttgtggtgccccaaaaaatgacaatggggacatcaaagatcactgatcacagatcaccaaaactgatataataataatttaaaagcttgaaatattgtaagaattatcaaaatgtgatacagagacatgaagtgagcaggtaccattggaaaaatggtgccgatagtcttccttaatgcaaagttgccagaaaccttcgatttgtaaaaaacacagtatttgcaaagtgcaataaaaggaaatgcaataaaatgaggtatgccgataatacatacagctcagtgaagaatatcttaaaaatatttaaaaagaaggaagaaaatcactcataattctgctgcccatggcaaccacaattaacccatgcctgccttccagtctttttaccacgtgttgtgttgtgtggtgtttgtcccacatagagatcattgccatacgsccatttggcacattgcttatttttccctgtctttatacatttcatcatgttgttctaaatgcttcttaactgcaattcttagtggttgtgatagtccacagaggggaagcattgctgtttatttatccatttctatgttgttggtcatttatatggttttaaatacttttggtgtcataaggagtgttgtgataaacatctctgtgcataaagcagtttctatagttcccattatgtctttaggatagattcccagaaatggaattactaggtcaaaggttgggcacattttttaaaggtttgtgagacatattgccaaattgctctccaaaaggtttgtagcaatttaaatgatcagaagcagcactgaagtccagtttcgtctaaccagtattgagtgctcattaaaaaaaaaaaaaatcattactaatatgataaacaaacaaatggtgtgttattgttgggttgaaagaagcaaatttggagaatccagagaaacacagcggaaattcaatttatgggctacattaacccagcattttggattggagggtttctaaagaggtttcgttatattaatggrtgacaagtggatacttaagaaaaagtgtattttggagaaagttgcaataatacctactagagattgtgtcctccctcaaaatcggagtgccatccgcgctccatgagtctgacactttgtaggtgctttataaatatggattgaagcaaatgagtgacgttcatatgatgttttgcagttttttcaaagtgggttttacattgagaatctcatttttccaacaaggcaactaaggcatggattcaataatgtgccagcggcacacacatagcaaatggtccagccacgaagagaacgggactgtccagccgggaggacagtatgcttttcacctccctctgtacccttctctgagaactgtttggtttgaatcatgatggcagtggctggcttctccacgatgctgttgtgctgaaccctattaacctcatagggaagacactaggatcaagaggccagagaagagacccagagccagcaaacaagacatagggttttattaggggtttacctacaaaggagagagtttagtggcagtgggctgggcaggagaactgccttatgtacagaaatggttcaggggccgtggaatggacaagactccactttcctacagtccagtgtcagtggctggacaacataaccacacagcccagtggccgtggcctgggcagggaaaccgcaactgcctgcaggaagagtgcagtttatttagataacattttcacttaacaycctgccrttaatgacctccacctggcaacctttatttaatccaaaactcagggactggattttccatacggcctgtgaggccagggggctcagttgttcctcatagacagggaatgtatctcctgattggccactcccagattccctagctaggaacagacattcaggtacatatacccttcagagagtcattctcaaggtatgctcaagctattgctgtcaggcgcatttaccctacagagctgaactaccatttcctcaaaagtaggtacagatggggtaacagtgggcaatgtggccctttctgcacttccacagtacccgaagtttaggcgcccctcctgccaagagcccccattagcagcaaaatatatctcacatggtgcccagagcaaaggaccctgtgctagttttttgtggctgctgtaataacggcaaactgagtgacgtaaaacagcagagatacatttgctcacggtgttggagcccagacgtctgaaattgacactgcttctggggacactagaggagactttgttcttcgcccttcccggcttcaggtcgcggtaagcattccttaactggtggtcacattactctatctgtgcctccatggtcacttggacttcccttctgtctgtctgaaatttccctctgcgtttattttttgttgttgtttgtttctgagacacagtctcactctgttgccccggctggagtgcagtggcatgatcttggctcactgcatcctccatctcccaggcttaagtaattctcctgccgcagcctcctgagtagatgggattacaggcgtgcgccaccatgcccggtcaatttttgtatttttagtagagacgaggtttcaccatgttggccaggctggtttcgaactcgtgacctcaggtgatccacctgccttggcctcccaaagtgctgggattacaggcgtgagtcaccatgcctggctatctgcgtttcttctgtaaggatacttgtctttaaatgtaggacccacttggaatatccagaactatcgtatcaaaaaatgtttactcacacctgcgtataccctgtttccaaatagagtcacagttacaggttccggggagttgacatgggtatcctctggggcagggggcacttttctgcctaccacagatactgaggtgcattgctaattacatgagtacagcatttgtgaaaactcgctcatgatatcttctccatagtcgcagtcagtaccagctgctgtggaaaaaattttacgcattgtgtttacaacagaatatataacatggcttagagacaaagtgttttacttatggccagtagatggaattctaaggtccgatgtcggtttgccatgacttgggcattggtttctgttcggctctgtttacggggctgtgggatgggtacatagacactcgtctacttgaacttccagggactcgggaggcctgcagttgaataacaagagaccgtgctggtgagaggtggagtttgcagtaggatttcaaagactccatggagtccaaaaggtgggaggtgtgttttggggcatgcgccaagggaagctgggctttgggaagagaaaagaatccgaactggtggcttcccacaattgctgggagtctgagatagattcaattgggaaaactaggttagtgccagataaggtccattactctttaaaagtggccactcatccctaataataaataaaccaaacattgggatattaaaacaattygttctcagcatcagaaaagaggtcgtgtgtgtgtttgtgtttttttaatatcccatccagcccccagccccagtaaccctaagattgaacaaaaccctacttacgtgctwcggatttaatatagcgtcaggctcctctaggtacaataaaataccaagttaagagyattaattccttacaaccctgatgggtcccagctgtgcacacgcatgtagggtgtgagggtgtgtgctcagcgggcacaggtgctgacggggctgttccacctcggagcgcgtgggccgggaacacagctgtttctcaaatcatccgccacttgcttctaaacctctgtgaagttgtaccgcctctgggcacaattaaaagctgtatactacatttcatcaggtagtgttagaaatttaggctgagccaaaaaagaaaagggaggaggtgggagggaggaagcaacgagtcccttgttcaggcggyattaacccccttaccctggctattggaacaatagcgcttctaaaagccgcacaaaatcctccaatattaagaacggagaaaaggagtgtggaaaaggtgtgggcaagcacggcatctcttctttctttttcttctttttctgtttctttccttctcttgctatttcctttctttctttttccttcccttccttccttccttctctctatccttcctttttgtcccttccttcccctcattctttctttccctctctctttctccgtctttctttcctccctcccatactctctacttttcttcttcccttccctttgttttcacgctaattccttaatttgtttttgggtctgctcgcaggaaataaccgtaagctaggataactgaggtaaaatttgtacagctaagctgaatggtgaaaggcccagatttagttctcattgtaggaaaaagggccagaataccttgcccatttttgccttgggaagtgagctcaatgaaatacatcttcatatgcccrttttacagaagcagcaactgagggctgttgtactgaggcttgcaatggccacctcaacttttaggtctctgaggcagcaatgggacccttgccggggcctcgccatccacatggtcattgcctcaaaatttgggattccagttgcccttttccttcttctctcttgaacaatgtgaacgcaakgtgaggatgggccttctccgccttcaaaagttgctgccttccaaggggaaaaggtctggtcttgtaatttctggtctgtgcgtgctgtataaggaagaaggtttgggtagggaagcaacagastacccactagtgagagggaggacaccgctggtctgtgctcaacagccaggccagcaccacatgaataaagcatgatggcaattgcctgactctgtcctcggtggggacaggagagctgagcataaggatctaagtttagacgccctcctaggattaccaacgtaggcrtgatcaggcccataaaatactgcacatcttggcatcttacctataaaaataatgcagatacattcgtaactccccaggttttcgggagtggaaatgagggcagytggggagtgaatctgtcgtttgttgagrctctttttcctgcttgccagacactgatctaggctcattcatacaccagttcattcatcctcataacagttctgtgcctgagtagattcttgtccttatgtaaggattaaggacgttgagacccagargggtctcatctaacaggcagtagtagagccagcagtcaaaatagtttgaccccaaggctccaggctttttccctatttctttctcacccacagccaattgcaatctggaccctttacctgtcagctgtaggaacatgaaataatgtgagtggggtgaaataatgccatttaaaagcaggcacattataaagaattatgtcaacctgatttcttgaatcccaggacaattcatatccccgtgccatccgattagtgaatcaagagaaactgattgatatacagcaacaatagttaagaaacaggcagcatcgatggaggtttgattaaaccgataccctgggtctcctgctgtatcaaatcatgggcgaattggtaccattaggataaattactacaagaggcactgcaaagccaagctaaataaactctgccttctcgagcccctgattgtcttattaaataatttctttgcctcttaagtgtggactcggagcactcgtgctctgaaagccctcctgattaactatagccttggcctcaagttgattttataaacttcggatggtgccccagagggtgaagcttcctgttgtcaattctgcccgttgctatagataccaaactccacaatcagtaattagagcgtgccccctgccccagaactggtcaaacggtgcagagcgctcggcaaatggtcttaaaagcrtccgcgcttgcatggaaatgcatttccaatggtgacggggtttgttttattcatggactttttgaaaaaaaaatcactggtttattggaaaccatagagaagtataagtaattattatgctttttaaaatacaaccgaggttcctcatcatgatacgttaagggaaaggaagacagggcaggagggtggtgtggcacaaaggcggctctgtctgacctgtcacgttaggactgagttcattcttgttcagattcagcatcttttgttacacccgaagtgcattccatggccctgtcccagccatagaaagaaatgcctttatttttaagcgagacttcttgtggaatgatgaatatgttcagggaggctgttggtggcaagaaaagaagggtgatgggttgggcttatattgtttagtggagcaaaagagatgtgaaacatttgtgtcttaaagtgttttggtcargagaaactaaattggttagaaagtgtgcaattttgcaagctttataaaaatataaaccaatgagtctggactctgttccctaaaggggatgaggaatgaaaatgaaggtttgcaaagacatcttgccagacccttacatattttaatttaaggtggtattactgtcctcattttcargctgaagaaccaagctctgagagagttaatgattttctccagatcattcacattcatttctgttacacagctgggattataatccatgcctgtctgactctgaaacctattttcccatttttttttttttttagggataaatttctcccaaactatatgcagatcctgctagagactgcccatccctctatccatttctcagtttgaaaagaaatcctggaattcagaatgatgaatattcattttaacatcatcttaaaatgtccttatagatgtatattacagctgtagtctgccaggccaagaattcgattggcatttccagagtactgttgattgtattttagaatcttccaaacctccgtaattgtcttgttgatttcaaacaccctgagaacatttcctaaatgctcatagcgtccaatagcatgggaaagtaaatggtttatgaggagaatttgggatgtgcaaaataagcctttgaagagagtgcattatctgaagcctgacattgtaacagcttcttaattacgctttctttcatgtggcatttttatgggatccagtacgcccaggctcaaatgatagacatttcaactcctacatccaagtgtagggagtcccaactttttgaatccatccgtgtggcaaatgtagctggacccttgggatgaagacccttcctgcatcctcccaaggagacaagttctggrccataactctagagcaaccccaacccccaggccatggaccaagtgtcaacaatgttgacattgtgaatccctgatctggaggaacatagctttggggcagtgccaggatttaatatgggttctttggacttcagagccccttgtgctaaattgaaacattatggtgttgctttgagcaaacaattagcatttttgccatagctttttacttctccatgttgaaattatcaaagattatcgtcgaaggcgtggtttctttactatctgtcttctccaggagactgtcatctctgtgagtgcaggaatccggctggtggtgtttttactctaacacctctttcagtacatacatacagtaggtgcttagtagatgtttactgaatgaatggataaacatgtacaaaattatgatmccttgtgttaaatatggtagggaagcaacataatgtgccctggagtttcacagaagaaggggctttcttccagcttggggatggaggtgagctgtcattctggatgatgtgatggggaaagaggatgtgagctgaggcttggaaccaagcagagcttgggctttggggtgctgggaggacagaatgctggaaacagaggtaagaagggtaagcacctagtcaacatgagtgatttagctttgggagctgatcaagtgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtggtaagtttcctgaggcctccccagtcatgtgaaacggtgagtcaattaaacctctttcctttataaactacccagtctcaggtatttctgtgtagcagtgtaagaacagactaatacagcaagggagcagtgatggagcacaggctggaaaactgagttgaggggtcagtggtggaccctgaaggttagactaagaaatttagactccagcctacataaatgtagactccatgcagaatgactggatgtcctataggacatgcaaagccacagggaattttggaacaggaaattgtgctcaaagctgaattttgaggaggtaaatacagcctctgtgtgtaagacagagaaaaggagagagtgggaagtaatttatgtatcacagttgcctagagaagacagaaaataggtgcctggcttatgtggccactgctttttttttaaacttatttctttaattttatttttttttaaattaggattaaaaaatgtacatatacacataaaatatttatttttgaataggtaatacttttatatggttcaaaaatcaaaagtagaagataaaaacaaggtgtatatgtatatatatttatatacctatgtgcatatataaaatccttgtatacatatacacacacacacctatgtttttctttatgtgtgttaaaatctccctctacccctttcctttagcacctaattcctcttctgaaccgatgttatttcctggtgcatccttctagacattattatgcatttacaaggcaatatgtttgtatattcttctgccctccccttcactttgctatacacaccttgctctttttgcttgacaatatatcttagagatggttctaaatcagcatataaattatttcttcattttttaacaactgctgagtattacactgtgtggatgtttcataattcattgaaccaattccctattgatagacatttgggttgttcccagccttttgctattgcaaattgtgccgcaacgtgtaaccttgcaccgacatcgcttcccacgtgcatgcatgtatttgcaggattgagtcttagaaatmgcagcatcggctgagagagtatgcactccggtcgttttcatagatattgccaaattgccctctacggaggttgttctgatttacattcccactaagcaacatacgacagttagggtggcatttcctgactccatgctttgtagctgggtggaggggtggactgagagtacatgtggatgggaaggtgcaagtgaatgctctcaaaatgtgctttaaggagaaatattttgttgggacacagaagttagactgcaagaaggagaagattggattcagggcaggaaatcagtacaacttgcagtagtccacrtgacagttacgcaaaggcctggtctgatagaggaacaagagagagagaaagtgcatggcaaagacccatcattgatgagtgactggatgtgaggaatggagcaggggagatgctgatgatttggttacccscttctccatcccccaccacccactgatgttattatccagtaaggaccaggagagaagaagagatttaagaagaagacaatggctgtggtttgatgaagataaaacgccctgccagaatcatttgagcaaaagcttaatgttgtttgtggcaatgtcacttactcctgatcccattggagaaatctttcctatcacttccaatccacgtgtgttcagacaaacactaattttgttagtacaacgtcccctaatagctaagagttaaaaaaaaaataggtcttagaagtgtgaaaaacaaaaaacaaaaaacaaaaaaaaaaacactaaaccccaaatttgtccttttaacactttcagcaaccctgtaaagtcattatcatccccctgttacaggtaagaaaattaaggctcagagaggttaaataacttggccaaggtcacacagctattaaggaatggtaccatgtcttggacccaggttaactttaaatcctgagctttataacggtttgatttcagtagcaaatgcagtggcacagaagggtctgggcatttatttccaaagaatgatttcactcaactgaggaattctaatgttttaacagcatcctacttatttctaaagtgttggggtgaatttgccaaggtttgaaaagtgcatttgtaagccagtaggattcaatctgaagtcagggataacagagccgggggcggaggctaggtctccttacatattttgttcacaatgggactagaacactctgcagagtatgaaggttgtgattcagttgcccaagcagtaaggcctgactggtgtcacgatcccacaacccgcacaaaggcgccattgttgcccagtgtgaagggagctgaggcatcaccaaagggggccaagcgtcccttctctgggttagaaatgttgttttccatttgctggtaaacaacagtccaagttcattgtcctgacacagaactctgtttcttcttttatgctgagagtttgcaagtatggatcttgataggaatgcttgcaaacaacggtagttataaaatgttgcctcctgtatctcagtaggcactgttcaagcatttgaacttcatcaagtatcaagacaagtctaagagaaggtggggagagaccatcaggrcctaggattgsaaaacctccaacgcaaaatagagatgtagttttagcgtgctgcccaatattaaaagattgtataaatgaggggggcacacttcctgatatgttcgttatgcacatagtcacacacctctcagtgccttaaaatttgttatgatgcagtctatctcgtatggaacgatcttgatgtatctatcaaacacgggagaaaaaccacttaaaatgtgtaaaaagtttattaataaaggagtacatgattgtgttttaaaagctacatacattaggtttaagctgcagaaaatggcggtttattccgaaagactgctgtatttatgcttaaataattaggattacctctacctggtatatttgcagggacaagcaaagcatacactgaaaataaattctcaaatgaaattcatttcacattagttgcatcccaacattcctttatggactgcattccatgcctggcactgtgcctatgatttattaaaatctaaagccattaataaataaattattcaatccatgcattgaattatctagctcwttcaaagacagtcacagtccatccctcaaagagctcatggaccagtcgaaggagggtgacagcctgggtcaaattggtgctgagcacacaggcaggggtcaggctccctggagtgaagtgtaagcgtcgctgttcactggctgagtcatctttggtaggtccctttaccactttgccactttaagtctccgtttcctcatctgtaaaatagaggtaataaaaacagctaatatttacagagagcttactccttgttagcagttttcattaattaatgggtgtatttattggaataaccgtgtaaggttgccatttttatttccatctgtgtgttacagatgagatgtgtaatagaaagggaatttgcccaagctcacagtcacaggctggtggagttgggatttcaaacccagagtgtctgattcctgaacctgtgctcttgtctcttccttcagtaccacatacaacagaggggacaaaataatttctatataaagtgcttagcatagtgcctgccacttagacctcaaaatatattgttttcattggataattaaatataaaataacatacagcatgatgrttaatacaactaataaatagtgcattagtattataggcacaaaagacagtatgaagtacagcacagatcatgaggagggtagggtcagttctacrtaaaaacagggttagtaaaggcctcagagagaagatgtcctttgagctgagtcttgagactccagagatcaggactcaaggactgtggaacctgtacattcacrtcctggtaatcttacattgctcagaagactccagggacattgaggttgcccccatggagttgaaactcctatgctgatcacttaggaagccaagaacaaattaacccagggcaacaagaaacaatgactaattagaccctaatgaagtgctgcggtactggcgtccttccagatttgacttgtaatcgmcacaatgtattacagatgcagagtcttcatcttgttgggctgtgatcaagtacatatgctccccagcagttctttgagatttccatgttctccgcacagtgcggagctactgcrggtgtgtgagccaagggggccctgtgacccttgaaatagaaaagggggaaatggctgcatgccarccgaagagaccactgcattgttggccataartgaaactagtgagatgtgtgggatatcataaaaagaacattgacataatccttttttggatgaagttatatcacaaccagaacacacaatgaccagcaggcttctctttttttgtttgatttcactcctgaaaagtgggctttctgtgagagttggacagactccatgctgcccctgcctcccgggccttccttcccaagcagggatgagctctcctctgcatgtaacaagcaaggtgattcagcaagaagactgctggtctctcccttcctccagggccatttgtgagagtgagacacaaaatattagaagcaaaagaagaagctgtactcccaagaggcatggatccttgagtgagttatgtgcttggaaaaaattagtttgcacatgaggacacaaagagagcctgaaaagcaggaggctttgaggtctttttttccctcctgattcggagggaaaaaaaatgttgtttgtgttcatttatggaaattagatctatcacatactcttakgcaatttatgaaatgttaagcaatacccctgaatgtcctagtcccaggaaagttgagagttgagtgcaagacggggacacccaggagccagtaaatcaactcttgaatgatggtgtattaagtgataaccttgtcatagttaaagtcacactggaaggatatatattgaggctttatctctgccatggtgtcagcatcagtgaattaacacagggtgtcttaacttttcaaaaacaggrcatgggtgatcaagcagcagtatatctctttactccttgtattagtccattttcacactgcttgataaaaacataccstagcctgggaagaaaaatcggtttaatggacttacagttccatattgctggggaagccttacaatcatggtggaaggcaaggaggagcaagtcacgtcttacacggatggcagcaggcaaagagagtgagcttgttcagggaaacccctgtttttaaaaccatcagatctcacgagacttattcactatcatgagaatagtacaggaaagacccacccccatgattcagttgtctccctccaggtcccttccataacacatgggaattatgggagatacaagatgagatttgggtggggacacagagtcaaaccgtatcactctcccacccaacacttgcagaaacacacacacacacacacacacacacaccccttcctacgtcctacatccctgtacttggaaagcaatcatatttaaatcattgctgctggaactttagttgactttataagttacattttacataaaaaggcagcagtggtgaagctggaagagggcacctagrctttgatttcaggcaagattttgttaggtcccagtattggracttccggttggtggattttgctcaagaatagttttctctttgtctaacgcttcatgagagacaacctaaataaagccacagccagtgttacagaaatagtgtttcgtgattaaaataatggtacttatttgggagagttacttgccacgtttcagatgattkggaggtagtcttttcaggaatattctgagtttgtttcttgatctcgatagcagcaacctttccatttgctctctgtctggtttctctgtgtctctctttttccctcaaacatcgcttttctttttttaaaacaagaataaatcccttaggaccttgctaagttattacttatattgtcgcttaaaaaaaactttggaaagaggctctggcatactttaaaaaagttaagcacactcaagcctctttaattctaaattcagttttgaatatgcttgtactgatgtcaatgacttttcaaaagagagtgtcccaattatttaggtggccaagagaaacagctttaattctttatcacataaatatgcttcaaaccacgatttaaaccagatggatggagcactggattagtggtggggcttcttggctgatctgagtttcgcctcctcgatcttgcctgggtctgttctgtcacttggatcttaccagtcctggcaggcacacagctctgtgagattttccttctggctttgcatgaagcttttgaaaagaaaacacatacatgcaagtgacctttctagggttgtttctagtttcttcgtcttacataaagcccctgctaatttagcatggtgtgtgcccgagtttattttctttttaacaactttatttatgtaattaagcgagtgaagtcatacattttattgatctaatgaaacgcatttcatggttcctcctgcccttcatcttctgaccttccccttcagatcacagccctttactttcgtcaatgagacgccacttaacaattttccaccttgccaaatttgaggtccccctcaacattaacggggaacccaatatcagttccttaaatgggagcaaagattgatgtcaatataaactaggacacacattcatattgcagaaagggtaagaaatccttacacagaacgagtacggtctctaacagtaaagtacagaacaggtggttctcattttagtatatttaaacttcaggtccttaaatgttcttttctttttccttcattctgtttctttattattttaatggagtgcaaggtgcagtctttttgaagatgtagaatgtggccttataaaagctaagtgctactttatatttctrctgtccttgccsgtggcctgcactggggagttgtatattgtatcagtaattttaaaagccagcaagtgttctaccagctgaagaagttttcctaatggtggctggtcaaacgtattacttaactaggcgtatagaattgaggggaaatgcaggatgtaatgaaatgacattggtcaatcctcagtaaatgtttttttcaaaggcttggcacaaaaaatgtgcaaaatcttggaggtagatttttttgggggcatttgtcagggaagagattaatataatactcagtgaattcaggcaagtcctcaagaagaaaaatttaaggagcaaatatgtgagccaggatctcatgctggactatctaagcaagcatgtaggaagagtttgtttcttcctgctrtggccatagaggtttggttgtcactatgaagaatgggcctgtgtttttttttaaaaatatgctgatctgggtgaggtcacattttgctattctcagtggagggaataattgggattatcttatgatttttttttctctttaattttcttacaaaggaaaaagaaagaatccaatttgttataaataactgctgagggcagtacatgttgcaggtagtcactatctgggactggtggcacaggcagtaaaggattcaccaagacagttgtaggtaaagaaaggtggatttattggagaagataagaaagtacactgtaaggttgcaacaggcagcccagcatggaaggggctgtctgcaaagaggcaggggctggagggactgaagttatacagggtcctgttggagggagctatgtgcagaatgaggtcgaggtcattgtgcctgcggattgtttgttgttcttccctacccggggcccactcctacctggggcctcttcctcattgctgcttacttattagaactccacagtagattttttataaatgcagacacatacagacacccacacccacacatacagacacacacagaaacatatacacatttaggtcgcgatttcttcacaaggacattcttatagacatgtcatgaagggacttggggctcagagaaatgaagtaactcagctaagtctgtacagtacttagccaggggatttagaaatccacccagggatggctccagttgcmtgtttcttttcatttgacacgggatggcctaatgggtccccaccaggggtggcttggaaaggagaaagcaactgcattcccactggaaggtgttctgtagcaaagtggagtgaatgccaccaataatgagttccaaacagggtatgtgtttgcagacaggagctacatacatttgaaaattaggatgatttgaaattgaaatgagggcttatgctgttcattggattaatttttctctcttataaataaaaaatatatacaaataatacataaacattgtttttcactgtggcttgaattttctaacaatttttttcttcttctcaggaaatgttttcttcttatacctccaaaataaccactgttgacagtgtattgttaaccttgctagaaaaaaatatttatttttgatccatacacgtaaatatgcatactcataaatatgcattcatattttgtgtatgagtacacttgttaatttacatgtatgtcttgatttatatacattgttctatacctttccttttcccataattttatggattacatttattttcatttctgtatatttagttaattcttttaaaaggctgcctgttatcccattgtctgtcttcaccatcatttacttaygtaataaatctgttaaataattttaatataaatctattcatctatccatctattaaaagagatttaagttatttctaatctttgcrtattataagttgcatttcagcttataccttgactttctttgacatatacatcaataggtagagtatattcctagaaattcaattgtggaccaatgagatgtacttcaaatttttaacagatatttcagtattgacctcccaaaatgtattcacacacccaccaaatctaagtgtctgtgtaacacacagatgctgatttggagtattaccattttaaaaaaataatatagctatcagtcgtgtaaaaaaaatcctcaccattatttcttaattttacattgtaattgtgagtgatgttgggtagatttttgtacttttattgaccattcacatttcttcttttctgaactgcctttccatattctcggtccagctttctataagattgctctcatttactggtgakagctctgtgtaaattaaggaaaccatcaccaccttcgaatggctgactattgtaaatattttaatgtttgtcgtttgtttgcaaccttgtaattttttcctgtgcagcaattttaactttctatattcaaatatactctgaatgcacagtgartttggcagaataccatttaagtcttgtattttccaaagytagtcaacrtccaactgccaatgttgcctgaacaggaaatatttatacctgaaagcgtccaggtgagagtcaggaaagccatgaaggtgcaactggcatactgatgtcacttcttctttttttttttttttaagacggagtcttgctcttttgccaggctggagtgcagtggtgcaatctcggctcactgcaacatttgactccctggttcaagcgattctcctgcctccgcctcccaagtagctgggattacaggcatgcaccatcacacccagctaatttttgtatttttagtagagacgggattttaccatgttggccaggatggtcttgatctcctgacctcatgatccacccgcctcggcctcccaaagtgctgggattacaggcgtgagctaccatgcctggccctgatgtcacttcttaggctaatttctgtgaaattgtgattgggaggaaaaagtgaacaggaacttaaagccagcagaggaaagctacctgcccttsactggtggtcagtgcatggattccagagacagggtgggcaccagttcctcaccgggtcctttctagttgcatgacctggggcaggtgactttatgtggctaagcctcagcttcctgacatatggcaggagtaataatatcccttgaagccaacaaaattcaataggcacatgccatgtacatgcctgtgttatgccgggaacttcttaacatttccagaatatgtgtaatcatatttgttacatgcaatatgaaattatgtgtaaactgtccaacctgcaggaggcagtagatcaatcaattacatgtgattaatcctccccctatcttacagagaataggagagaaaatagagctccaaggtggaggaaaagacaactgagaggaggctattgtgatgttttattaccataaactgccaagggttagycgtagccctccatctgccagctaattccggtttcattaatatgaatattctcacgcttccagaaggaaattcttggaatgttatggatctctgtagcaggcacatgcaacgtccagtgcttccctgctggtaatgtggcggttttattatgcatgccatacccatgctctctatttcctcgatagrccttatagaaatcaccatgcttccttttagaagaaaatgatggtatcacatggagaacgagctgaggagcttgacaatcttggcaaggcttatcaaaagaaaattcatgtgttagccttaagttaacactacttttattaaattcagtttttatcacagctgataacttggagatgtaagcatttagagacagaattcacttatgaatgttctaaaatgtcagaaagtttaggattctcttcaggtagtttcctttctctcacttggagtgacatgttggacccgtggcattgtcccgaggcaacgttgtggaatttttagagagtgtttgtctgttagctgtttgttttgaacatgttcacctttggctctgacctgccatcatggaaaaaaagtgtcaatgtgttgggaaagaaatgggctgcttctcttttctcctccctcctccgtctccttcccccgaccctcctccatccccttcctgcccccactcctcctgctctccagcctggcctctgtcccctctgtgttcctccccttcttccttgtatccttaatgacttccaggtgtgcctgctgggtcaggcttctggccccgtcctggggaggctgggtctgtgcctccacaaacacaagaccaaagttagggggtgggggactccagaagtacaacatcagaggaagaaaaaaaaaactttgaagttttgaggatgaaattggtaaaaataattctagatgaagatagacccgtttacattccaaggaagggaaatgttttacccaaactgtttccatggaccctgtgggttcttgttaatrctgttcaaccttgtgattgaaagcccaagccctgtgatccacagcaggggccacagccagaaataattccccgagaatactgcgtgtgccttcaaatggtccttgatcrtttttcttggatgccccactttccaaaggccagaaattgtttcagggagtcattccagttggggaaggttttatgttctaagagcaaggtgctgtactcataggaaaatgtgtaattcgtcatgatccttttgtgtggagaggatggcggtggtccacttctcaacttgggagtcccttagtgactcatgatgtatccttcagtacgctgcccagtgccttccccatttgacttagattttctgccacagtttaagtatcacctcctctatgaagtcttgccagacacattcctcgtctctttcctgttggaacaactgcctcactcctgtggccccactgtgccatagacaggttagagaacatgggccctggcatcagacctggcaggcagtcttgattaggcccsttattagggtgctctgggcaagtaagtttacctgtgccagggatgcacctttttaacccaacacttagaggggtcctccatgtacagccatgatcacaactctctaacgtggtcacttgcttgcacacacttgtttagatgtctctgccctgctgttaattagactgtgagcctccagagggtgagactgacatctcatttctctttkcagtcacagcagagatgcaggcccacagtagggactcaccagatgtggcagggtgagggaattgtccatagatgccttaaagatatgctatccacaggagcagagagcacagcaggctggatgccaaggagaattcgaccagggtaaggcttacaggcaatccattcagtgcagagtcttcccccatccacacatataactccctttagtattgatgacctttctctcctgaaatattacagaaactgccctgaacgaagatagatggtcccccctcagcgttcacacatggttccgtctcatccaccagcttccccggccccattccctctgtctcaggaaagtaataatagtaactcataataatagttcaaaataataataatcatacctgggatttatatttcagcgtgcctcctaagagggcaaataaaccattttacacaatgcagagagaaggacagattttctttgtgctgctgctgatcacgttaagccaggagagatttacagtcaaattccagctacagaagcaaagtgttggtgccccgttggcatgtggggatccactttaatgttgttctcttggttttgcttaaactgccaagtgaattactgtaacacactttgcctgcagttaatttgacatctagtgccagagagctgctttatatttttcaaggcaagccagggtgaaatttttgcaaaaagatttgtccatcatttttactgatgtccaaacacgatgtctttagcttctttggaatcgagctgtggaagtcacgtgggctttttcttttttcttttctttttctttctttctttcttttctttttttaaggatcacagaagaaaagcaggccgatcttgttgaaatgtttttaaaatctccaaataataaaataggtttagggtgtttgcttatgaaagctgactttcaccagaatgatttatatgcatcatgggcagaggggcagtccaataaaagaggcagaaagggctcttgaaaaatgtccctgggcacttgcccgaatgactttagtgacagtatctactaaaactgataytaattctgttacgtgttatggcgcatacccaagaccctccccataaactatttgaaagaagcaaagttgtaattctccaaatacggacttgtacatttctgatcattttagcaccaacattggttcaaactctggcagccgaccacagttccagctgagctttgctgcgctgtcagcaccatggggcctgataaagcatttttggatttttcctactcacagtgcccccatggtctcaatgctgttgagaacattaagctccttacctgtgttttgtggttgttgttattgtttttctttctggtaaaggactttatctgcagtcctaacaaattgacttacgttaacattctaactcgtggctaaaccaaaaataaacttgcagaccctgccctgaaatgcacgctctgagcagtctattggatgcggtggtgtggccgatttcttggacttgctacattcttaggcaagtgacatctcccttcatttgtacagagggagttagaattgaatcgaacttccaccgcagcatccgccagctcttataatcacttgccctttgctgatggtgagtttttagctgctttctctcctaccatacagcactgacacctgagaagtccagtccttttggagttcagtagattccttgtctctggaaaatcagcagaaaacaatgcagcctcctcttgatctcccctgaactttgcaaacctctctcagcattgaccgcatgaagggtgggtgccctgaggcaggcaagccaccaggtggtaattaagaagcaagaagcgctgctcccaattctctagatctggatttagaggccagttggcttcagaaaacatctcattcacacaaaatgggacatggtcttttgtctgttaaacataagctttcaaggtgagttgtgcagaggcaagtctgcttgtttcatcaagctgacgtttatacttctgagtaagtagggggatccggagagtcttcttgtcactcaaacagtttccgtacgtcagtttcacacctctgttctgcatgtctctgttgggaaggatgctgatgtctgggatttgaaatagagatggttggacctctgactttcaacaggaggaaatcaaaattaaaggaagaatataggcgtacgcttagaaaggacctgtgaaaggaagataaatcttgggcccccaaatcactaagctaaagggaaaagtcaagctgggaactgcttagggccaacctgcctcccattctactcgaagtcacccctctgttcactgagataaatacatatcggattgcctcctttggagaggctattcagaaactcaaaagaatgcaaacatttgtctcttatctacctatgacctggaagccccctcctcatttcaagtcttcctacctttgctctgagttgtcccacctttccagaccgaacgagtgttcatcttgcatatgttgattgatgkctcatgtctccctagaatgtgtacaaccaaactgtgctctgaccactttgggcatgtgtcatcaggccctcctgaggctgtgtcacaggtgcacatcctcaaccttggcaaaataaactttctaaattagctgagacctggctcagattttcagggttcacagacctgtcaacatgaactgtcagtggtgatagcacccgttttcaagtctcattttaatcggaaggaagttttaccagctctttggctttgtagaaggtcgagttctccaaatttaagagattcaaaaatgtcctccaaagaagtttggggtgaaaacacatgacagtttcttgttcatatttggccagaaggaagcagtgtccattaggttgactctccagtgcttcttggtgttgtgataagcccgtctagcayggagggccagaaggaagcagtgtccattaggatgactctccattgcttcttggtgttgtgataagcccgtctagcacggagggccagaaggaagcagtgtccattaggatgactcttcagtgcttcttggcgttgtgattagcccgtctaacagggcgggccagaaggaagcagtgtccgttagtatgactctccagtgcttcttggctattgtgataagcccgtctagcagggaggagatgtctacacggtgttctccaaactgctcagaaaagagcagtaaggacaggatggggcccagttaagaggtatatatcttaccttctctttttctccttcttctccatctcctgcccttacttcttcctgcctgtcatttatttattcttttcacagatatttagtgagtccttgctctgtgtcaggccacagtgtagatattccagggatggaggtgaccaagcagacatggccatagtgacaggctaaggaagcacaaatcacaaatacagaagataattcctggtagtgacgggtgcctccaagcatataaaacagggtagtgagatgggaagttagagtagaaatggctcaattttgtgctggaactggctgcaccagcaggagccaatgattacccatctcccatgtttagtgacatcatgttgatagcttgatttcagccatagtgagaatattttcaccacggaaattggcacatgctacacatcagggctccctcctccccaccaaagctgatcattaaacattttctagaacatacctggaaggcatctgggaagaggtaacattgatcttaattgttattagagagaattttcaatttcagttgtagcatgaaaaatcacagagtccatttatttctcctcttygagtcagtatatctcaaaacattttttcaacgttaatagaaatataagaagtgcctggatcagtttttgkttttgttttgtttctttttgagatagggtctcattccgttccctaggcgggactgcagtggcaccattatggtttactgcagccttgacctcccaggcccaactgatcctcctgcctcagtctcccaagtagctgggactacagggacacaccatcatgctgagctaatttttatatatatttttttacagagacaagttctcgccttattgcccaggctgatcttgaactcctgggctcaagccaccagcctgcctcagcctcccaaagagcagagattacaggcgtgagctaccacacccagccatttatctgttttttaaatagcattttggagatgacagaaaaaaaaataaaggaaagagaacgctcatagaagtttaaggttcagaagtatttggctttgaaaaaaaagtttaagggactgtttgtcatggggtctggtcttccaaatttaatgcctcattccaggtagctgcagattttatagtttctctcaaagaatgtcaatcctattgtctttccctgcttccccctcctggatgaagtctttctctacactcttttttgggaagttcccaaatctgtcagtatatattacaaaaactgttaccgcctaacacattaaatgtatttaaattatttgttctattaaaatgtcagtgtmtttcttgaattttaactgtgcctgaagatcartcattgtaacagctgcagggaaggctttatgacttacctgaacggtggtgtattctgtggctcggctaagtggattcttcgactttaatagattttactagctaggacaaaccatttgagtggcttctgttggagttttattcttgatacataccaatgatttactcagatccgttagaaaaaatagttttagggatgataaaaattatgataataatattgacaataaatagagtattcgccaatatgtatagagtgcccattatgtttcacaccctatgtcttgtgtgtggtgactcatttgaaccttatagcagccctgagggataggtgccggtttgtctctatgcgcccatgggaaactggggcacagaggtgttaagtaagtgacccaagaacacacagctggtaggagttttagccaatattccagtctcgatctgctgatatgaagccgatgcagctagccaccatgttatacccacccatagtcatgaaaataagatgagcttaatttttttcttttgagactgggtcttgctatgttaccctgggtggagtgcagtggcacagtcatagctcactgcaatcttgaactcctgggctccagtgattttcagcttactgagtagctgtgactacaggcacaggcctccatacccagctaagtttattattttttggtagagatggagtattgctatgttgcccaggcttgtcttgaactcctggcctcaaagcgatcctcctgtctcagcctcccaaagtgtggagattacaggcatgagccactgcacacagccaaggtcagctttttcactycagcacaccaggattttcatcccagctctccaatcccccagctgtgtgggcctggtcaacctgtttagcctgtcaagacttcagtcccttcaactgatagatgggagaaattaatagcacctgcctgagaaggccagctttttgggggacccaggagttacgaatgcccagcacttctcaggtgatagctgctgcttatctccttgtacagagagaactggaacattctgaagatgaaatgggataataatgtccatgaaaagacctggcttcacgcttgcctcctgctagttccttttctactctatttcagcttcctgtttgtaacatgatttaagcactaagctattgaattttggagtgcattaaaaaaaatatcgagtggaaaaaggaatatttcttagggaggaaaaaccckacttttgactttataatattaagttcgttcatatctctcttagattcttatataaattttattgacctaatgttctgtacagtagtccttawttacagttttggtttccaaggtttcagttatacattgtcamctgtggtacaaatatattacttacaataygatattttgagagagagagaccacatttatgtaacttttattacaatttattgttataattgttctattattgttgctcatctcttactgtgcctaatttataagtatactttattgtaggtatgtatgtataggaagaaatgaaatatatgtagggtttggaaccatctgaggctttaggcatctactgggggwcttggagtatatcccctgtgcagaagcggaggctactgtayatacatttgcctgtaagtgagcgcgttcttggattttgttgaatggtgccactgattatgggtcagagcttgttgaaagggtattaatccattatttactaaaactaattaaattttcatgtcatttctttacttattgtttttattctctatcagtgtaatttattacagcaaccaattaaagaacaattttatggttctatcagtgatgccaaaaaagcatttgctcaaattcagaagtcgtgataaagccaaccaaccaacgaaacagcaatacttgtaactaaaattgggagaaaggaaaacactttcagtagagtcaaggatttttttgttaattatttttatttttagagatggtctcactatgttgcccaggctggtctcgatctcctaggctcaagcagtcctcccatctcaacctcccaaagtgttgagattacagttatgagccaccgcatccagcccacaagtattattccaaactgtaaaatcgtgaaatgttttgcattagaatcagaaactagacaagaatattcatgatagctgtcaattgtcacattattttagaagttttaacaaatacagtaagacaaaaaaagtcttaagtaatgggatgaaaccaaaatgttctttgttttaaacttctgtaattataatcctagagaagctaaaatattcagtaaaaattactagcaatgaaataatttgaagagttggctagatgtaaggtaaatatacacaaattagctggtatatactagttataatttaagatggagatagaaaaaaaccccattcaaaatattaacacaactatcagatatttaagaataaatgtataagagtgatcaaatacctgtattaaaattatataatttattgaaaggaattttttgaaagtcacccataaaatgatataattttaccataaaatatcagctaaaaagggggcagtcagcaaaagctcagctgtgaattaagattattttctaacccttagttctttgataacataaataccggtagaacttggaatatttcaagtaaagtaacatgctgtgttttatctgtattcctggtaacttgcatttttcaaggaaggaagtgtatgatatgaagtaggcttataatttagtcagatgagctcttggattatgttaccttgaatataatgcagaggagaaaacaaaaagagtcttttgcatttttatttcttatcaataggtccctttttcttggaatgtcagcctgaccctgaaggtattctcctaccagcagagccttctttgatgccccgtcttcaacctgccatgttttcccatctstgaggcttctattttagagacttttcctccagaactggcttatatcatcctgtgttgctgcatccgatcacaggtctgtggctgacctgggcagcgtagtagaagggtcttgagatttggagtcgtaacgagttttcaaaactcataactatattacagtttgcgcaagtcatttaacctatctgaaccttcatttcctctcccacacaggataaaataaggataataacagccattttagagttcgtattaatatttaagtgggagaatgcagccagtaccctgagaattaaggttcattcactcagcaagtgcttactaagcatctggtttatattatgggaagttttgagaattaggtggtcagaaaggtgtggtcctcgccttcaaggagcttacattctaggaagcgaagactactgaacaagagattttagtgctaggattggagaccccagcagaagtagcaaatactgtgtgaggtttaaggaggttggaggcaccttcgcttgtacttctacatgtgtcccttcatgtctagttcactgattttttaattgaaattttaattgaagactcacatgtagttgtaagaaataatatacaatgattcctcatattcttagctcagtttcccccagtgatagcttttgcaaaacaattgtgcaatatcacagtgttgacacttacagaatctatggatcttattcagatttctcattttacctgtactcaagtgtgtatatgtgtgtctgtgtctacatatgtagttttatacagtgtcatcaaatgtgtagcttcctttatacacaactacatcaagacagtgaacagtgcatcaccacaaaattcccttgcgttgccttgcaaaccacacccaccttccttctgcgcctgcctcatccctgacccctggcaaccactaaactgttctccacttttaaaatgttgttttttcaaaattattatataagcagaatagcatagtatgtaatcttttggggactgacttttttcactcggtacaattccgtggagattcttcccagttgttgcacgtgtcggtagcttgtttaatttcattgctcagtagtattccatggtattgtacatataagtgatcgtatgtttaatcactctcccgctgaaggaaatctagtcttggctattgaaagtaatgctattataaacatttgtacacaagtgtttgtgtaaatagaagttttcttttctctgggataaatgcccatgaatgcaattggtgggttgtagggtaatgacatgattagtttgtataagaaactgtcaagctgtttccatgctattttacatttccaccagcatttggtgatctagtttcactatatcttcaccagcatttggtggtgttgcagttttttattttagccattctggtaaacatgtagtgatatttcactgtggttttaattaaattgccctgatagctaataattttaaacatattttcatttgtttgtcatctatatatcctcttcggtgaaatgtctattaatgtttttttctcattttctatttgaattgttgtattattgttgcattttgaaaattctttatatattctagttattggttctttgttggatatgtggtttgcaaatatcttctctcaatctacagcttgtcttttcatcatctttacatggacatttgcaaaataaaagtatttagttttaatgaggtccaatttatcaatttttcctttcatcaactgagcttttgttgccaaatctaataattctttgggtaaccatatatcccaaataatttctaatatttttttcctaaaagtcatatatttttgcattttgcatgtatgcccatgataaattttgagttaatttttgtataagatgtgaggttaaggtcaagtctaataaattttgcctaggaacatctcattgttttagcaccatttgctgaaaatgatcttcctccagagaatttttttacctttattcaaaatgaattgagcatgtttgtgtrggtatctttctggcttctttattccactgatctatgtgtctgtctctctgacaattatacgctgtcttcattactatagctatgtagtaagcctcatgycaggtagagtgattcttctcactgtattcttttttattaagattattttagcttcctaagacctgtgctttttcatataaattgtacaatatggttgtctatgtctaccagaagccttgctgcagttttaatggggtttaaatctataggtctaacattaaacctatagatcaattcgggagaattgacatctttactatgttgagtcttccagtttgtggacatggtatgtaattctatttatttagtataaacccactggagtgtgtacctaagcatttcattttctttggagcgattgtaaatggcattgtgtttttaattccaacttctacatatatctagaaatatgattgagttttgtgtgttgatcttgatcctatgascttgctgattgcatttattataaagttccaggagttttttatttttgtttgtatttgttagtttttttgagatttcttgggattttctatctagcctgtcatgtcatatgcaaatagagaattttatttcttcytttrtaatatgtgtgccctttttttattgccttattgtagtggctagaacttcctgtgctatgttgaacaagagtagtgagaacatccttgccttgctcctgatcttagggagggggaagttatttaccatttcaccactaaatttgatgctagctgtaaattttttgtagatgttctttatcaagttgaagtgattcttctcaattcctaaattactaagaaacttttgaaaatgataatgggtgtgtactttttatcaactgctttttgtatgccaatctatatgatcatawgattttcctttagctttttgrtatggtggactatattgattttaaatattgaaccagccttgaagacctggaataaatcccacttgstcatggcatatatgtttttttatacattgttggatacagtttgctaacattttgtggatagctcaccaacttttattcagaaaacatccgtctcagtttagtgcccaacaaggaaagcatactgtttgttgggtgggttccatttttgtggttaggagaagaatatagctcccttcctagggacggtctcaaatgagtccccatcagccaccagggagctcagctttagttgcataagaaccaatgagcatttagtttcatgtctcataaataatctgcctgcttatattttcatctgtacttctctcagctggcattctgccacagactacatttaggaccgcagccagtgggttacagcaggagaccagactccaagttctggcctcacgttgcttggtatacatcactcagttctgttggcatggatgctcctcctataccccatcagccatcttgcagwatgggtttggtggatcacacagggattcagataagagggttcagatccttctatccatcaacccacccatccacatcactgaaaaagggactctcagatgccgatgaccagtaagaccacatctgtgggcacaaaagagcccatttatgttttttatgggaacctaagaaggaaatgcttttctggtcaaatacgttcttctctgattaggcctctcattttaaggcagttgagaagactcacagatgtgattcactggcaatggctctggttcaccaagcttagctctgctcagtctacctttagcagaagattaaaaatgaaaactcttcttgttagaggtagaagagatcctttcccaaaccatagattcatggaactgtcaaagagcagcactgaactttgtactcaatgccttaatttttccagttgaggataattcacactaaacawgggatttcacctctctgactcatgcatcaggaacttggagataaagccctgttaataattcataattatatagcatagcatagggcagtttcagatgcttcaactaccaggtaggtagaataaaggaatgaagttgctgtgtatasgatgataaatggtgctaaatctatgtccccaatatagggaagacaggagaaagtgccaaagatagtgtgcatgcctcatctctaaggggcagccattattgacgtccagctgartgttgccacgtggaaattagctataaacttgccagaacctccartttttctggagagattagattagaaattcatatatttttaaatattaaatcatccctttttcttgagatggtgtcacgtcgttgcccaggccaccgtttatgttgtccaggccaccctggaactcctggactcaagtgactttacccctttggcctcctgggtagccgggactacaggcgtgtgtcactgcatccagcttaagttatccgatttgtaaatggtggcaatgaaatcattgcgtaggccagttggagtgagccaaataaaatacatctgcagtccagattcaacctgcaggccatcattctgctgtcattggtgtagaagactttttcagcctagtttattctaggctcttttcatttctccctgatttgaggctttgtaggacgttgcacaggaattatttcccttttaaacgttagttttcattttaccagtgcaactctgctattggcacatctatgaaatacgtaaagctatcattttaatactaaagaggaaacacaaatttgactcatttccccagaaaattcccctcctgctttccatatgttatatagttaactgtaaaagtggcaccacctcttaaacagccagctattctgatcatttgaaatctggaacattctttcctacggtggttgacttttcactgcctttgaggttctttccaagtaaaggcgttatyctttgtggtgtgctcctggaggtcactaacaaaacgtctccagcaggtgttgtgtggattcccccaaatcygtaggctcttatttcctagacatgaagagtatgtgcgccttctttttggttaccctggaccagacattcctcagcactggcttgcattggcaggaggtggcagagggagaggacagtaaccaataycgctccttctacatgatcagtgttcaggttgaagacaaacagggctccaattatgttgtgatttagaaggygacaragctgagacctcaccctctgcttatgggctgcatgcctttctcagtgaaataacgcagaatgcagaggccatgcctgcagatcaggggtgctagaggataggcaagaagtaaagtggccaccctatctcgtgttgagagcatgctagtctcygaacggcctgccagggtgcctgacagccagagccacctaatgggcctatttgatcctggagttgctgtaatggcaagaaaaaccatggcctccagccccagtgttgaagttttgacgctaatgtgatgataattctcttttctttgastggggacttgcctttgtttatctttttttgttgttttagccatgaaatatcacatgtaaatagccgaggatatctgggctctgagtctttaaaaggcaacagaaaggtctctgttacgaagggggaactagttttcattgtcactgtattaagcagaagttgggaatcatagaagaccttgatgttaccatatcccttgttaaatttcctctaatactattgagaagtttatcctctactttttcctgtagagtaaaagatatcgattttgtttctgtcggcactgccttggaacttgcttgcatccctcccccacgcgaggcgaggccctgaggagcgggattcgctgacccatgctggcagaacgggtgatggatgaggcagagaagggtacaggctggctggaccatgcgatggggaatgcaggyggaacaggcttcctcctgaatcaggagtggaagaggagtctggggtgaagccaaggggaagacagttaagctttaaaaaaccaactgcccagccgggcgcagtgtctcatgcctgtaatcccagcactttgggacgatgaggcgggcggatcacgaggtcaagagatccagatcattctggccaacatggtgaaaccctgtctctactaaaaaatacaaaaattagctgggcgtggtggcgtgttcctgtagtctcagctactcgggaggttgaggcaggagaatcgcttgaacccgggaggcagaggttgcagtgagccgagatcacgccactgcactccagcttggcgacagagtgagtctccatctcaaagaaaaaaaamaaaaaacaaaaacctgccctgcccagccatgcccaaacagagtggccagcagtcagcttagtgtgggcagagctcagggaattattctgcagtgcagctaacatctagcaccttctttgtgtcaggtgggccagcactggggtggaggccgagacagcttgtgagctcactccctgggagatagaacggagtacccagttgcactgagggaagagcagggatagaagtgggctccgggtctaggagacggtggaaagagaggactgctcctagcgtgagagtgtcagggaagcttgctgggggaaayacaaggaaggaagagaatgcaggcagctcaaaagagccsggcaaggagacctgcagagcgagcggaggcctggtttctgtgaagcacagggcaggaaaatccaaactcacttgagtacacgctcagggtcatgggcttgctatatttttcattcaaccgccaagaaatcttgagaggcagctttatcatctccatgtgaggaggaggagattcaggcccagcgtagtggcttgcgaaaagattccagcactaaagtttgaccccagtcctacctgacttcctttctccagctgtgagactcccctgtacaatttttctggagggtctagagtcacatgagtcacgccaagccgccctttcagtgcgaaggaatccaagcagagccctcctctgctgtgggtacttacttagggaactgtggaggtgtcctcaggtagccactggtgtgtggggtcataccaagtcatttggtttacatcgggaatgccttttgtcgttatgtctagacccctggagaacagcccacggcaatgcacttstggaaattcggactgtgrattacactgagtaacaatcctaataatacctgcacacaatcagttgcctgtccaaaaagcaataaagaacctctagattttgtggtcaccatattaatcataaattggggatcatagaaggccttaatctcattgtacatacttttctattcctcccagtaccatttaaaggttagtgaaagcaacctttagtatcatctgttttttgggggggkttttttgttgttgttgtttagctgtttatgggtaggagaatgcgtgctcttttagggacatctcttcaaataagaacaggttgtaacctacactcaaaagagatgctcttggcaaggtatggcccctaaggtttgaaagcgttttccaggcctgctgtcaggccaggctggactgtccacaatttcttgtcctgcctcccgtgatgctagccatggatgcaccccagaagcatttagaatttgggagaaaaaggagcaaggcatactgcccaaatccaaaacaactttggctccctttggcctccattctaacatgctgagtggatgcatcatggatagtcttttaaaaacaagttctcatctattcaatgtcagagccctaaatggtatgaaaaataggcaacttgggtcatgccactacagatcgacacccactaaatccttttaatttagtctagtgcaacaagkatttgtgtaagtgtcctctgccctggacaccrgtgaggtcaccgtgggaatggctgggcaggaacaaagccttttgtttccagctgagtttccttttctgaagattgcctgtcctagacaccagttctctgttctctgtgactctgattcctgtctcctcttctttcactctcatccattttcaatactggcccctcatttcacttcctcagctaaatctacctctcaaagatagacatggacatataaataattttttaaaatcctcttttgcaaaaaaaaaaaaaaaaagaggtgaatttagttgaaaggatatagccaywcttttctgaagtgatggggatattcgatggcaattttgtgttttcttcacttggaaaaactaaaaagtttgcaacatttaaaaaaaatacaacccttaygctgatggatgtacactgtaaaacaaccacgtttggtaaactgttaatcactttcatagtgtatgtggatggagccagttaaaccagttttcatgtcttttgggtccttttgagtctgaagataaccattttttaggtcctcatgaacctctgagcatgaaccatgaaattcctattacacctgtgcttttataaacttgatccaaggtttaggctctcagtgcctgtttcctgtttaatacatatcatggttttggaaaaaatgaaagaaagaaagaagaggaagagctgtcattcctctgacaagtattttcagtggaattagggtcatgatgtcatgcttatttcaaaagatagcttcatctgtgccttcacccagacttagggttctagattcttctagattctacagcaggcactggcaagcttttgcttaagaaggcaagccgggaatggtggctcacgcctgtaatcccagcactttgggaggccgaggcaggcagatcatgaagtcaagagatggaaaccattctggccaacatggtgaaaccccatctctcctaaaaatacaaaaattagctgggcatggtggcgtgtgcctgtagttccagctactcgggaggccgaggcaggagaatcacttgaaccagggaggaagaggttgcagtgagctgagatcacgccattgcactccagcctggcgacagagggagactctgtttcaacaacaacaacaaaaaaggtgggggggtgggcagagagtaaaatattttagactttgaagtctaagagacaaaattgaggttattatgtaggtattcatatagcatttaaaatgtaatcattttaaaatgtagaaatcacttttagatcgtagaccataaaaaaacagcaggaaaaactacatggttggctggatttggccaagttgacatagagagccaatccctcatctccagcagggcttttactcaatgatacagtgygcatgaattgcttgggggattgtgtacaaagtgcagatttggttataggaggtcagggaggggcctcaattctacattcctaagaagctcctaacaggctgataatccatggatcgcattttgaatagaaaggattatgcaaaaagccagagtttttttttcccttgycttataccagtggtgcctagcatggtgtcaggtttatagaggactaatacatataagaaggagaaagggagggaggargaattccagttgttttttttttaatctaggtacaagtctctctgttgatttctaaacatcgaatgaagatgaaggaaatacttaaagcacctaagcactcataactcacttagtcatttcactattaaaagagaaaaatagttagtttacaatttccaggaaatcagacaggtcaccaccacctcttcaacgactggaatttgcrcagtctcactactcataggcccatctgttactactaacagtgctaatgtgattgtctgtaggtctagcaattggaggttgttcgtttctttgagacaaggtctcactctgttgcccaggctggagtgcagtggtacaatttcagctcactgcaacctttgcatcctgggctcaagcaatcctcccacgtcaacctccagaatagctaagacccaggtgcgcaccaacacacttggctaatttttgtgcattttgtagagatggggttttgccatgctgctcaagctattctcgaactcctgacctcaagtgattcacccgcctcagcctcccaaagtgctgggataacaggcgtgagccaccgctcccagcaacaattgcagtttttaaaggcagaaaatattacacaggtgggttcaaatttgccacaccaagtagaaggtgttggaaggaaaattaggaattcttaagcttcagaagattagtagtcagagttaaaaaccagacaattaacaagttaaaaaaaaattgtgaagcacacacagctgttatcttccagaaacactgcttacagaggtaattgctcacagattttagggtttacagcaggtatcacaggatttcaaatttaaraggggggtgggggcctgtgttcaaagtcttaagaatatccaagggatgtatgatgtatgcataattacctgaaattgaaactactgtagtttaaacacttgctgaaagaagaccttttatttcatcttctctacaggctgaaggaaagaaaaaacaaaactaacaactaacagaaaaacttttcatgtcgaatatgtagatttacaatatgtgaattatcatcagaagaatgaggttctttgatgattgttgcagataccctgaagaactggcccttgttgtagaagaatggcacagggcacatggtaaaatggccctggccattcctttagacattttgtttgtacttatattaacttgagagaaagtattaggaaaaacagagtaattctgtagaaatattcctgatgatacactaggcaaagcagggagaagagaaaaagtgagcaagaaattgtgactatgaattccaaaccagtttggctggatgagccaaaaagacaaaacaagagcattcaagagtctgtcaggaagtggtggcctttagttcattttagtagcaagaaaactgatctttttctgattttaagaactataccatctctattctgggcttcactcttagctctcacagttagaaaacagtgagccttggtcaagtctcataaactgtgtctcagttttttcatttatacaatggccaaaaaaaaaaaaaagaaagaaascacaaaaccataccttctttgcagggttgtgtaaaggaaggttgaactagaataggttgaagtcaatcacatctctaaggcatttggcatgtagtggaacctcagtaatcagtagtttttattatttggtgcacgatgaaactggctatctggagatgttttaaaatacaggttttattattatttaggtatgctaagaccagcagatcaggagacaatgaccactgaaaagacagtttgtgagagttgtgatgattgtgatctgtgtcctttacagtttgcaagggaaggggacatgctatgtcagagtggagggacatggggaggcaccaggactggtcaagaggcagagggagagggtcaaaccgtgggttctgtggggaggamtgaacgaggcagggtaagtagactagggtttgagtaagttcagcaggctctggggaagaggggctgtccctatttttctggtacctggccctgggtgattagaaagggtggatggtggcctggggcatgagaaataaaggaggtggtggggtgtaagttctggattggttgggttgcattcaaaaggggtgcccccaagtgagttgtttgctgcctctaggaatttattgaccctgggaggggagatcccagatgtcaaagcatgggaggacagaaaagaaacagcatggttcccacaagagagaagtagacagagacctctggaagtttaaaaatatatatgttgggatttcatagatgaggtgagcaaaaaattggccgggaagaactattaaggaggagatgatcagaaacattttcaaaatacctggaacaaacaaagaaccacatttcaagaaaaagacagagaaacaagactagcaaatagagttttcaggtggaaaaatcacacgttggacaggagactgaaggtaagggaaaccaagtcaggctttaacaccattctgaattgcagctgcaggatcacttgctttagatggaatcacccagcggatggcgtttaactctgctttaaaccccttcatggcttcccaccacacttacaaatacatctccttatcctgtcagcaggggcttgcttaatctgaccctttccacatatgctggatcacttcacgcctccctgttctttcaattccttgaacacaccaagttcctgcattcccgcctcagggccttcaccttcagcctctctgtccccacctgctatcctccccagctttgcacacctgattgctttttgtaagtcagatctcagattaattgtcgcctttacagacagatttttcttaactctccagtctaaagaagccacctcctccagttctcagcactgtgcttctcactctcgtttattttgttgtttattcatttgcttgtcatctgtattttcccactagaactcaagtttgtgacaacaaggacctaggtcattttcactgctgtagtcccagttcctacaacagtgcccaggacacaccaggaacgtgacatttattgaatagatgaaagaacagtgtaaaaaccacattgctcttcactctgcctgcagccaactcaagaacaatttcctaaagcagctctgaaaattacgaaagaaatagtgcatggattccagccccagtaggcttctgggcttggtgtttctttaatttcatgtaaatttctctaagtaaatatgccttaaaagtgaataaaattttatttcgctttaacaagagaatataaaagttaaaaaggtcactgtagtaatagactaatctcaattaccagggcagcctctgaaaccctcactcccacctaatctcattcggtgcatacgcagctcaccgtgtgatttccaacacagctaaatgaaattataaagcagtgttaaatttattaatcatttaattagctaaatgttcctgcaagtactggctagatgaatggcatgtcattttctaatgcaatttgcctctcaggcagccagggtcagaaagggaagctcctggcatctcgaatgagctctttatatcacaccttctactgggagacggttgttataccactgattatatttgagacttgtacacaagaccagggcactcagatgctggaattggaaaatgctctctttcttacctgggttacaaagaggaggctcagggtagctgatgagtcccccagagattgtctctccccgtgtccccttgcaggacaaatcttttcatatttaacaagccactgagcagaacagggggaaagatagcaggcagtattaaacgcatgctcaatctagttttatttcttcaaatttactcagtcgagaaaaatttgtggagtgcgaattctcctcatgctaggtgactttctaatccttctagttgagtcaggatttatttctccattctcgccttctagcctgggcttgtcagcttggggtgtatgccgcacctcctctttgaagaggatcttcatttggaggggtgatctgactcccaaccctmcccaggtgaaagcaccgggattcatacctagggggctttgggatttggggctgactttgacccgtcattatttctgactgcaaaattcctgacaaatgtctgctgctgggtgctctgtgaatctgttcccatttgcagtgagagtgctggcatcaagcacattgtctaaattcactcggcaagaagccgttggagtgggtgccacgtgaggccgagaacatccaaatgaacactggtctgtttgttcaagatgggagctgtcagttgtgagagctcctatgggaagagtgttttgatgtatagacatccctggtccacagagccaccaagcaaggcagactatttcgtgagaaagaaggaagatagactccatgcaacacagtgggtgtggcaccaagcgggaggtggagggttgctacctagtcccggctccacctactgtcacctgcattcccctagacaaatcacagcacctcaggatccttgatctcatcatctgtaaaacagagatcagatgaaccctcgatattaatatcaataagagccgatcataggactgctctaaggattaaatacaatgatgtaacctacttgaaagtgtcatataaattctgaggtgaagtggaggcattatggatgcattttattttgttttattttatttcayttattctttttttgaagaggtatgggtcaagcagatctgcagcccacactcggctcactgatcacgtcccatacaatcttggcagatacttagctgaattccatcgatttagtgataaaatgggaacagtagtaatggtgcagattagagaaaaaaatgtgatttgtgcattcatwtgtctgtgtgtacatatatgtatatgttctgtgtatatgtagacatgtatagatgcatgtgtgtacgtatacacgcacacatacataaattgtgtacatacacatatacatatacacatacaatacatatattctgatacacatatgtacatatatgtgtatacatgctatatataatgtagcacgtttcctggcaccttgtttggttcaataatgttgctgggattatactacaatttccattactctgactatggcaacactgctgatataggagatcacttttccgcacaaacacctctaggtattgtttaacacagacctcatgaaataggtttgccatggattagataaggcaattctggactcacttccaggatagaaggcaaagacaagtaccaatatatttggtaaaaatatgacatgacatttgagtgcacacaggcaagtgaaggtggtttcaaatcctccctctgtcttttcccagctaaatgaccttgtgctggctcctcacctcctaagcctcagcttatctctaggatggacgtcattgtactcccttcatcccacctaaggttgttgttaaggatgaaatgaaaagtccacagcataagcttgacacataaaataagcacccgatgaatactgactaaagagagaggaggagtaggggagagaaggagagaagagaggaaatgaaaatgtttctgaataagttatgtctaagttttttcactttttattttttattgttttcaggacagggtcttgttccattgcccaggctggagtgcagtggcgtgatcttggctcactgtagctgctgtctcccggattcaagcgattcccctgcctcagcttcccgagtagctgggattacacccacsaccatgcccggctagtttttgtatttttagtagagatggggtttcaccatgttggccaggctggtctcaaactcgtgacctcaagcagtccacccgccttggcctgccaaagtgctgggattacagacatgagccacctcacgtggttgagattttttcactttaagaaatgctttttctgtcacctccctggactgtcttggatttgtttctttgaggggaaatatgaggctttaattttccctcccaggccttggaaaggccaagagaagcctggagataggaatccacctacacagagtgtctcagtaaattggcagtggccaggaccagaaccaggacacctgtctcccagatctgtccttttcttggatagcttgaagttacgggtagttattgaattggtcactggctaccccctgaatcattacctgattttttactgagtgttcctacctgtgagtaaagggtgcctggttttgcacaagtgttttcttggcccaagagatatttttatatttgcctttgggttgatgagatgctggtatgtatcattcgttcagccattctttcagtaagtcatcacggaagtctgcctctgtgacagattctggggctctaaggmggaatttacttcttcaaagtacagtttcctgccttgcaagtttggagttaaggccacgcagaccagagttacgtgcacaggttgtaatactctctcttgtccctggttgcctgattcaagttaggggcttcttctggattccgtaggtaggatgctgactctcagctgtcctgatgccactggtgttcctctagtaggcaacattgatggtaaacatagaaagtcatggaaggcctcagttacctctagccctgaagacacagggatacccttggggcggagaccttagggacaggacaataaagatcaggccttgggagatgcaaacagtttgcccttggaccatgtcttctgctttcatccttatgctctcaacagatcatgccaaggtcctgtgttcaccgcsttcctgagtccccattcagaggctcaagaattgagacaaaagggcatcctgcaaatttgctgccctggaagctgtgctgggggagccagtagagacttcaggtggatctggaggtccttccccaaccttctgcaaaccatgtcttcccagagagcttctaagccaaagcaaaggtgttgctctctgcctcytgttgctctgtaattcatctcagcaaccatctttcccatctctgggaagagaatgttgtcccccagaaaaagtccttatggatagatttagttattgcttatggtttagagaaagcgcctttcaacagtcacatgcaagtattctttcaggcatttatccaaacacacaggatgaggcctctttgtcaaaccagtgtttgttgacaagcgacatttgtgtgcaggagatggctcattgtgtgtgtttacttggagctgttatatatgctgggggagacactgtgtatacaaacctaggagggagagattgggaggagggaagaaagtgaggaataggcttagtgagaaagagaccagagaaagagaaaagaaataaacattagcagggtggttaaacatccaagcattgaaaactgcgtggtggagctatgtactaactggggggtcttgaggaagcccattagtctccctgagcctcagtttagtagaagtaggaatcgtcattaaggcgcctcatttatgaagttactctgagctctataagagataagcatacagaaaactttggacagtgccttgcacacagtcagtaatcaatgcatattcatcatgatgttagagaaaggccgggcatggtggctcacacctgtaatcccagcactttgggaggccgaagggggtggatcacctgaagccaggagttcaagactagcctgcccaaaatggagaaacgccatctctactaaacatacaaaattagcctggcatagtggtgcatgcctgtaatcccagccacttttgaggctgaggcaggagaatcactggaactgggaggcggaggttgcagtgagctgagatcgtgccattgcactctggcctggacaacgagcaaaactccacctcaaaaaaaaaaaaagagagagagagaataaggtcagagggggaaaagagagaaagtgaaagcaacagtaaggaagagaattggaaaaaaaaaaaaaaaaaaggaactgatctggctgtatctgtcgagttgcttctgccgtttctagcccagcccacggttttccctctgcagggtgtctgtgggcatggtttgcaaataaacagtgagaagtataagctaaacatagactttaggcatatacataataggcaggcgtgatcgcgttcacccattcagtttgccatataaaagcttttcctcggtgccactttatggcccagaaacaaggctacaaaaactttaatactgctttttattttatagaaaaatataaatcaatactttcatgtctgtttgacgtgtttgggagctacagcaattgaggcttgccagtgtctggatgccccaccactaccacgccacttagctcagagtttgtttttttccttccaccatgtgaaatgttgctggttaaccagttaaaacggggagatggccatgattgcttttagattgccacttccacattgagtgaattttataataagaagccattttttccccgacaggctgcccttgtgcccgcctctctgactttgaggtcctcattattgtgggtttaaatgaaggatgttcattcaggcagggatggggggatggggggaggccaccaggcatcagcgctgttatcaggaccttctatcaggccaagtgacaggcgtccagagcaagaatgcagagctcatggtggagacctccggctgacaccaaaggtgactcccctcactctaaccttgaaagggaaagttcccactttattaaaatgaatttcgaaagggccgctctgacagctgcataattaaatactggagtgtcagcgataatttattccactcgcatgtggtggtcagatccttttcactagagggtcagcaaactcagtgacagaggcaaggagacaagggattcagggccctttgtcatttatgtagcaccagccctgaaatcggagactcataaaacctacaaatacacacacaaacacaaaccaggcaaacccacacaccacrgagaagaggcaaagtgtgcataaagataccctgttgttattcacccagtacaactctctaattcatgtataaacagtaagtgtaaaatgttccacacccttatgtatagacttttaacctctatttgagggtctctgggaggaccatagttgtttctgaagtatcacttatcctacgttccatgtaagatctctttcctagggtaaacttgatatggaaggtcttcacagattaaaacgaaggaaaaaaaaaaaaaaaactagataaatctccctggacatgaacttttgtagaagtagttacaaygctagtgacctcatatactcatggtaacggcttccggcatccaatgaccttgccattgcggaggtcaatttcatgtgtgtgtgcacacatgggtgcgtatatgttacagagggaaacttgcctgtttgaagcaggtgtcgtggaaacaacatgggctttagagccagacatggaatcctttcttatgattaatgcagctaaatttcccactgcagccggtagcatattgcttcataaatgtctataaaaaaatacgaaaaayagaatcagagcaaattcagcatagacctccttgggatgtttwttctttgtttatgttggtgttttgttttgtgttgtttcagctggggtgcagttgtattctgttccctctttgctagttcagaggcagtgaaagcgtgcttctcaggactcattgtccagaagattctgcctacagctggttttacgcagagaastagcacacaaacccagtccatsatttcttatttgactctgtcctgtttactctgtcagggtgaaaagcacaggccaagctcggctagtcaaagcattactttgtcacaggcaggcttggcttctccgagtcagcctgaacaaattacatccctcactcggtcgccgaaccgggaacagggttataactcagtctaagcacccgtccctcttctattaccttcataaccaaggtcatactaatcaactcaattaccagccctctcagacattttcataatgttttctggtagttgctctcctgtgaaaatctttcggtctaagcaarttaatgtcattttyataactatctgcatttcaggtacagtgatctcctttaaaaaggctgcgtcccagcagcatagaccarctttacctcccagcgtagtcttcagacaagttrgggtattgccgaagtccattcttgactttttttaatagtgcaaacaaatcatcttgtttttaggaaaacatgaaattataaagaaattgacttcaatcacttctggaggcagagcactgagttgcctccccacctcattcccctcactcccaactcagcaacctgggtgtttcagccagggcttttccaggccttaatttctctgacacaggaggatggaattacattatttccaccacaaagattgtgttttaaatccttcttagtttgcagcttttcttcccttttgcctcctctttagttcattccaatgataaatcctccctcctttgtcacagagccactgtgtactttcatagaccatcctatttttcaacgagagttcagaaccacaccatacgggcartagtccgcattttcaacatttcctaacagcacaattgttaggtagctaacaattgaattgactrtgtcaggtagacttatttttcgagttgtgctggttaactgcaatccaagtttaggaagcaaactaccaatttcatttaatagaatgagctaaccaaggcacatggtgactactgtccctcaagaccgctgaactaccacttccagcacctgctcagattattcattacaatgaagctctttaacactgtgtttgcattctttagtatatatcttgttaatagtaggccctgaataaagaccagttgaacaaataaactatttttccatgtattaattctttagtgaacttgcttatttgttcagaagagacattaagctaagtatacaacactcggtaaatttcaacttcatcatatatataataattatttttttttgagacagagccttgctgtgtcatccaggctggagtgcatggcctgatctctactctctgcaacctccacctcccaggttcaaacaattctcatgcgtcagcctcctgagtagctgtgattacaggtgtgtgctaccacggccggctaatttttttgtattttattagagacggggttttgccatgttggccaagctgatctggaactcatgtgctcragcaatccacccacctcggcctcccaaaatgctgggataacaggcatgaaccaccatgcccggccatcagaaatattttatttcactattttaaaaaattagcaargaagcaaatatgacaaaatgctaacaattccaaaatgctaataacttctgagtggtgagtataagtgtgattattatattattcttagtatttggtttttttctgtagtgtgtagtttccctccatgacactgagggctcagrtggctctgaccttggagacagggagacatttagtgaaggaatgggaggtaaggagctggcatctctggtgtgtccatcatgcactgacctgcactagatgttttgcttccagagtctcctggaatgctccatggcctccacgcatcgtaattcccatcagcttaaggcagcgaagcgaatgcccacagtgcccaagtcacttgcccaaggttatccaagtcaaataagacagagatgagattcaaattcaggccacaatgacttcaaaaacccttgtatccttgttttgtttcgtttccctgcaaacattgttttagttgagatgaaattcacgtaatatacagttaaccattttaaagtgtacacttcagtggcatttagtgaactcagtgttatgccaccgtcacctctttttagtttcaaaactttgtcatcaccccagaaaagcatacacataaagtcatcactgccccattcccttcttccaacttctctgcttttggtctctgtggatttgcctattctgggtataccacataaaaggaatcaaagaatatgtgaccttttgtgtctagctccgttcacttagcatgctgtttccaaggcttgtctaagttgtggcatgtgtcagtactttattcttttttatggctgcatagtattccactgcatggatataccacatcttgtttatctgttcatccattgatggacatttgggttgtttccgccttctaggtataatgacttgtgttgccataaacatttgtatacaagtttctgtgtggacatgttctcacttttcttgggtatatacttaggggtggaattgctgggtcatatgatcagtctaggtttaactttttgaygaactgacaaactgctatccacagtggctgcctgtaccattttacagaaaatctctgcttttaatacttctggatgtgttctaaggcactaggcttttcattaagttcatttctgcagaaagagttaaggagtgttctcaggtaactataatcaacccccagggacttactcaagttgtgcatgtgcaactgaaatatctggcaggcatccagtccctgttatttcagtctctccccgcctccctgcccacacctctgaagctccatattacccaggaagggacaatggggggcctagaaatgtggagggaggcaagagagtgataattatgccatctacacttgtcgactagaatttccaggtactttcacctctaggctcttacctggcttttgtgaagcccctcagggaagaggaggaaagctgggcaagggggaggggtaaaccaagtcccagsaaagtcattccagtttcccaagatcccggagcttgtttgtatccagctgagatccagttgagaccagaattcactctctccacacctccatcagctgtggcctcgagttccttaacattttttaaaacaaaaaacttttgcatgggaaaaatccctttagaaagttaaaggttttccttatacaaactatctcactttgaaaactggcccactgtaaaaatcttgattccggagcttccttaaaaatcttttcacccctttaaagtgaaagttatggagaatctattagatacaaattaatacgggcaaggcgtgtgctagctgttttataaacatgatcccacttaatcctccacttcacaattctgaaaagtcaacaaatttggcccatggtagagaggaggaaaccaagacttgaaacattaaataacrtgtccaaagtctcccatttcagagacaggggcatttggctccaggtttttctgactctagacagtagtttgtttttagcacatcaaatktctgagacttgtgatgtgtyagaaagcacaaaggactttgatcacaagatcaagccccagagggccatgactgcataaaccacaacaactgcgtggctgcctgtcacgtcttcatctgcaagttggaggaacttggagaaatgcagtgcttccctgcagctgcagagggtctcactgagcactattcttggaattcttaaaagctgggcctgtaagccttttttgcatttcctttcagccacctcctggctgtccttttaaagccagggtaaagtccccagcacccagaatcaaggatggggaagaggaattttgagaatgtgcttcctgcttcacacaaatagctaaagacagaaatgatggcacaagccctaaccaacaactaggaaggtaggttgtccaagacaaattgcagtttagaatggacctgccaaatgggtgggtgggcaggatggctgggatcgccagtgcccaaccttgccacagcctccttttgtcactctagggactacccttttcctccccagacgtttttcctgactctaaatagtgggaaaagtctggtttgagattgctgtattgcagggaagttcttacagcgggcttgatgggcccagaaatcaagatggaaaaaaacaaccctctatgttgatggccatgcacagtggctcagcagaactggctctgttgaccaggcttgggtgctctcctgcagggcattgcaatctttaggacaccttcattacccctcctaaaaggagattttataatgagcgccaaccagctcaaacaagttaggatctcctaacatgtctggtgaaaatacaggagtatttttcatcatctctggaaaagttgctatcatgtccttcaataacccagtctaaccatgtttttccagtggaaatgattcccggtagaatgtcctatgttccttttgcacatttctcmttacaaacatcatctcatttaatcctcaccacaaaactgatagtgtcatctccaatttatagttgaggaaatagaggatcagagaagctacgtgatctatgcaaggtcccccagctaggaagtagcaaagatggaatttgacccaggtctgactccagaagcactttcctcttttgcctcctaatacattttcttatagggagcatcctgcaatacaactgttaagaccacttaatgttatctttgrattaaaaatggtaccactctcataaatcaatgagtttcataccctaaattatgccagattaagaaaatgaaatctgactgtaaattacttctctaggagcaaatgattgcttgattctattgtagaaaataaaaattttttacytaaaccacacaaattaaaaaatggaactcactttcacagtcaagagttacttctatttttttttacagtaaatgcgctctttaagatgttgcaagctcaattcatgatttttttttctttttctgtatgtttctaaatttagaagttacatttacaaggaggtaatttgcaaggtcatccttttttaaagaaatttaagcaggagatgaggtctttccaggtttgagggtgatagctcgtgattcttcatcaactttggccaaaccttcgtggattcctgtgtgctgattattagtgccttgcctacaaatttttaatacattgacttatctaaatattcctscatgcacactccccaatctaagaaaaatgtgagatgttgggaaatgtttccaagaatagaccaaaggattagtcagcctagagaagtgaactttaagaggaactatgtttattcagtggtgattatttgctgacccagtgctaggcacgtgagagtgagagggatggaatgcttgcaggagttgccttggatatcacacactgacttgggagacacacatagcgacagawaattacaacatagggacacccggggaaaatgtagacgaggtttaggggttgctcagaggaggaattaactctataaggaagtattctgataatggctttcaattataggacatatctaataacatgattacatactctcttaatagtgtagcactatagttgttatttatttcccacactgaacaaatataattatcatatacaccctttccattattagctctctccatttttaatgaaaacagtggttggtggtttataagaagttttttgtcggtgtgatctttcacatcagtttgctacccagaatttaaacattccttttttgctgctgttttaatttgaaataagaatggtagcccccaggtcccctaacagtgggtgctgatttcacagtgggcttacaaatgctcttcaagagtatctcagtgttgagtccagccacccaagggagactggttcttcactgtgcatcatggccttttaatgccattttgcttttttatcatccaatcagcagatgttctttcttcattcacgttgaaagcacttcgctatggaaacgagtaaagttcattgtcttattttttgtttgttttgttttctgatgtcctgacagcagaatcaatcttcggaatccttttcaataaaaaaaaaaattaccaaaacaaatatgatcacagaagcttttaaaatctgaaatcccaggaagctaattagtgcatccttttaagatggcttcctgcatttcgatatacgcataagcttgggtttcagatgcagttggcagtttgccatgagtcagacaggtcatcctgactctcaggaacacggagctcctgcagaagcctgtggagcgagggcaagttgggatcctcccctgtgttagcacgtgactgtcctctgtcaccatgtagcaggtggaggccaggaactacattttcttgggttcctggtggttagttgtacgccccatgaacttctctcatttccttaattatatccaaaataatgcccttgttttatttccccacttggcactgagccttagggagcaggaactgtgtatatcccacagctttgcatggcacttggcacgtaggaatgtattaaatgcagctgctttcgtgcaggaagcgcggacttcagatttggtcaaagatccatgatttcagagcaggcagcccttttaaacctgtatctgagtcacttcaatgccttgtgtttctgctctgggctgcaaactcaagagcagcaaccacttatcttggtacctgtagtcccgagccctgtgtctggctcagagtaggccctacataaatgtttgctcctcctcactgagtggctgcatgaattgcatccagcatgtctactctgggaaagaacctgtggagcctctttaggagtgtgtttttgccctccctcggaatctggtgatctcactaccaatggcaaagacaaactgtgaggtgtttttttgtttgtgtgcacgcgcacgtatgtgtgtgtgtaaaaaggccatggaaatataaaattgtaacctaaatgccttcacggccagttatggtggctcacgcctgtaattccagcactctgggaggccaagatgagaggatcacttgagcctagaagtttgagaccagtcagggcaatatagactacctgcaaaaagaaaaaaaaaaaaatgccakgtgtagtggtgtgcgcctgtagtcccagctactcagggggctgaggcaggaagattgcttgagcctgggacgtcaaggctgcagtgaaccatgatggtgccactgcactccaggctgtgtgacagagcaagaccccatctctaartaagtaaataaatgcctctgtgaatccatytcattgcattggaaagacctccaggattctctscagaagaatctttcccaacataaaatccattgttaatcacatttgacacacatgtgtgcccatgtctctgggcctgtgtccataggcatctacgtcactgcagagtgaaccctttcggttcacatcacctgctcccctcctgggcctcctgaggggtgtgagagtggcacattccacaggaagggaaccctgcatgtccatgtgccatgtgccatgtgccatcttagagacgtaaaaacactttgtatgtttgsggtacaactcagtaacccattggtgcagatatgtgattcttaggatggcccacatgggtctctttcacacacccacgtgcatgacccaagtgagcaaacaggcagagactgggaccagaagctcactgtggttctaagcaagcagttgaactggtggcttctgatggcctgagaagcagtttcccttgataagtcttcagccacacaaaaagagactgtagctcacaacactcacagtcaaagccactggaaataactatttcctatcaaataaagcctttctcttgaaaaatttgaagaaaaaaaaaaaacccacctagtgaaaccttagaatcaacctgaaggttcaacagcaggtgaatgattccataaatcatagtatattcacttaatggaatactaggtagccactaaaataaaatgacagttggaaaaaatacttatgataaaaggtttaatgacaaagtggggttcaaaatgagagatactctctgactagaactatattaaaagaaagatggatgggggagaggacggtgggtgatatattatctacatagatactttttttcacttttcaaagtgtttaatgtgttgcacagcctttagaatttgaaaatgtctaacttaaaatgcctccctagtgaaatctgtggcagcttataaactggcaggatactgtattttcaagatacgcaattgtaagtggtgctcacatacagtcagaatgtttatttgaccttgatcttgtgagggcttggttcccatggctttgtagagtgaaaggtcctgagaggcaggttagtgacgataccgggacacgtattgtagacaggttgataaagcaagcttccctcagcccagttttcagtggcaaatgcctcttggccaccaatgctgtacactttgtttctgtttccttacctgtcaggcagttactgaaaaattatcttttcccccaaatacaataattagtgccttggccagacaagttacagcaaatccttcaagattaagaagggactagccgggtgtggtggctcacgcctgtaatcccagctctttgggaggctgaggcaggtggatcacctgaggtcaggagttygagattagcttgaccaacatagtgaaaccccgtctctactaaaaatamaaaaattagccaggcgtggtggcgcatgcctataatcccagctactctgggcctgaggcaggaaaatcacttgaacctgggagacagaggtttcagtgagccgagatcgcaccattgcactccagcctgggcaacaagagtgaaactccatctcaaaaacaaaaattaagagggactgatgtccagtgaatttctatgtccgccctaagcactgaggtgaaatgaagcctagatggttcttttagaatatgagtgagcagtactcatggttaattttagaagctaataagtatatatttgataactttaacagaaatattaatactaattaagagtaaaaagatgatgaataaagtagcttcacttattgagcctttactagatgccatcttgcataaatggttgtcattttgcaaaatgtattccatctaatattagcagtaaccctgaggacttggtattcttacctggatgtgtcttatatcaacatgcacgcgttctctccctcagcataccgtgtcttattaacttctaacctccctctcattatcccaccaatctctgccagtacaaccacatcaactgtgcagatcacttctctagtgtttgggatttggggcaacctactgggtctagctatgaccccataaaagttgaacaactctgccttaatggcgctaatttttaatatgcctcattctagttgcttgaattgaacgaaggcatttgaaaattgctgaagtgcttstcagtgatgaaatgttacagatcagtttgaaatccaactttattcaacataagaaagcctatatactctggagcttaaagacwgaccttttcacttactgtaaggtatctaagacttctgggtgtgggttttaaatatattttggatgagctttgttcatgtttacacatggccaccaggtcggccacaaagctrtggctctggtcagtctgactctctttagcaggaatcacgtgacaatctgtgtctgtgattagctccgtggatattactaggtagatttctcacttgtccttgttttgatcttcattcctgggtgaaagaatcccagggagtggaaaatgtaggtagttcatagggctcctgaccttccatggactgtgtctaactcagctgtgatgaggacgtgctctgattctgatgaaggatgttagcattagaggcaggcctgtgtgcctgttctgtgtcctggcaccgatgtttaacaaaaaagatcctttcagagttactcatacgacttacacattcccatgggagctccaactctgtttggtcccaatgtgccctttttgtctcactccttcctcccacayatcctgctccccactcccctaattactcatgattscactaacagccacatcctttcacacctctgagcttttggtcatgctgtaatctctacctgagttccattcctgcctccacccttgcctgtcaaattccttagcttcatgcctttgaattttagcagaaatgttacctgctctatgaaactggattttccctttgtctccattccctaagctgcacattagagcasctgttacagtttgaagtgacccctatatggattgtttgcacacctgtgttgcaaatgtattagttaggataggctgagctacagtaagaaatagcccccaaaatgcattatagctgaaacccccaaagggggrtttctaacacagaaagcaacataagtgggtagtcctggccaatggcagctacgttccacaaagtgactcagggatccaggctgcagmcacttagtggttccattctccctgctgatatctgcatccagtcatctggtatttcttaccagccttaacctcattctattggtaagcactagtcacatggctatctcccactgaaaagtaggatgtcaaatatcctctagccctttgctcaggaagaagagcaaatggatttttgttaagaagctggcagtctgtcacaggagctacttgaggatacacacagttttctccccattagcatctscagtctctggtataaacttgagtcttctctttggtccctgataaatatacatagaatgtatggatgtgagaaagttaaactgatgtctgtgtgtcttcatgtcattaaactttgaatctayggacatgtctttttctttctggcatagtttggaggtcttcattttrtgatwgaatacaaaacaccgagggctttaaggaggcatagtggtatgttcagctgtattttctcataatatagagtcataggaaacctgagccttggcatttgtaaggcraaaagacccctggaaaagagtaatatagtaattcatctttatttgaaaagtatatcatcatccatttatttccccactggcataatccaggccgactttggctccccttcctgtgaaatgcaccctttccctctcatcagtttccacccctcctgctgaaaatggagtacaatgaatagatgtataataaaatcttttaattgtcttagcatatgttgcttttattaggtgggcataattgcattcatgggatcacctacaaagtcctttcgaatataaaattgaaatggcttcacactcagtgcacaagtccttctgaggcactgttttccccttcgctgcctccggttccccttttgctgtgaagttcacattgaagtgtgaaaagagagacgtggcaactgacacatgctggatcttatcagccgcgagtgccgttgtggccgactgaaaagcgactgtcatttctacaccatttattcctcgcctggcctcattgctcgcttcgtttcggaggaaattttccctgttaaagtactgtacttgtcatttatttcccttttttccactctccctccgtggctgggtttggatatgcatttatccaaaaggcaaggcttttacacacttccgctaacctcttatggtcaggctcataaaagcaacccaacaaagcttttatggggtcattacagatccctcaaatccctctccttccagctttcaataattctcttgtctctaatcaattcaccggctcttttatttgaaaatgggtgatggagtgggggaaaaaagtgggagcatcagctgaaaacccactttatttggactaaggtttctcaatgtgtgttcagttctggctcatgcttggcacttacatttgagccatattcagtagtcccagccttacttgttcttttacaaaaagggtcagcagactttctgaaaagggacagatagtaaatattttaggctttgtggaccatagggcctgtgtcaaaagtactmawtgttaccattttccttactttgttcaggctgctataacagataccataaactaggtagcttataaataacagaaatgtaattcttaamgttctggagcctgggaagtccaagagcaaagcaacggcagattcagcttctgttgagggctcgttccctggctcatagatgrtgacttctygctgtgtcaacttagtgggaggggataaagcagctctctggggcttcttttagaaaggcacaaatccactcttgtgatctaatcacctttcaaaggccctatcttctaatattatcacattggagattccttttcaacgcttgaattttttgaggatgcaaaccttcagaccatagcactatcatagtgcaaaacaaccatggacaatacacaaatgaacaagtgactatttgctaatagttttatttacaaaaaacaaaaaacagtgggcaggatttgacccatgggctgcagtttgctgatccctgttttattaattagttaatattattgattgagatagggtctcactgtgtcacccaggctggagtgcagtggtgcggtcacagstcactacagcttcaacctcctgggatcaagcagtcttcttgccttagccacccgagtagctggatgacaggtgagcaccaccatgccyrgctaattttctaaattttttgtagagacaaggtctcactgtgttgtccaggctggtctcaaactcctgagctcaagtgatcctcccgcctcgacctctcaaagtgctagaattacagttgagagccaccacacccagcctgattcctgttttacatattaaaaatttcatctctccaatcttcgaagaatccgtagtccatttttaagtagctcttgtcttccaaaggtatgsgatgtgcmtacctaatgctcttcctggatgggagaatattaccaaaaacgtttggtcgactaattttatgacagtttccaactacaatttttttcctctttgctttcttttgaataatagaaacaattttttttgtttaatatatcttgaagtacttcacttaagaaataacttcatggtggcacagagagctgtttagttagaagactgagtattatatttcccattgactatgcaggaccttctagggaaatgtgagtttatcatactcctgcaaggtaaatgcagcagtgagaagaatcagtctactgtgctaaacctggccctgcctcagcaatattctgtgagcctggaggtcaagagttaggggaccaaggtcctgctaaggacacatgggggaactaccagaaactcatcatctcatttaaactcacaaaacctggaagggacataattaaaagtcctgtcttccaaaagtgtagcattaaactcagagatgtaaaacaacgtgtctaaatgccaggtaagcaatgcttacttgacttggaccagggtggtgaatgaacataaaaaccgattacaacatttttccatttttatgtttcctctgaaaccagccatgagaggtactsttagcaaatcacgccttattcctaggcagacttcttgggtacactttccaccctccccagcagtaatgcctgaccaactaatggaatcctaactawtgcagtatgtgacgcctggcagctccagtccgaaccaagggaaaacctgcaaacatgcaatccttcatgcttttgtttttgtttttccttcagcctagctaaaatgaaggcaacattcagaatgatgttagaatctaggtgtggaaagcaatgtagcttctggctggttccttgagtgaccatgtggagcagagcttcccttccattgtatttgagccactggaaatctattacctgatctttctttaccagatccttctttagttgggtatggccaggctcagtgaatccagtagatgtttgaatgggaaaggactgaaagatctcaaccttgaatcccttaactccttgggatgtgtaatggagatgtataagctgtttttaaacatttcagcagctgtcatggaacttaaccaaatgagtctaagtaccctatgaacacatttgatttaggttggaattacagcatagatgtgaagtgacttgtccaaggacacacaggtgatgaagtttacatacaagacttaagtccatgttactggattcctagaccaggttttttttttccccttatcccatagaagatggttgttgtcttgaggtttccactgagttgctttttgagagattctattgtgcacttttgcccagttcaacaagaaagaatctttgctatgttagaagagactctggggaatccagagtcttggtcacgggtacatcaaaacgaygctggtgcctaacttctagttccagacaaagaaggagagagagagagrtcagtaatttataggctgacattttccttgggtccttataatacttgtttattacagataatttgcttaagtgtgcacaaggtggaaggtcacgcaaggaagctttttattagttgtgtactgaatggatcaatagtgatttgaatactataaatctatccgttaacaggtttatttcttcatcagatattaattccagagggtttcacccattataaaatggacataaagcctggggtggtgatggtgctgcctctgtaaccaggctcagctgtgtgtcttcgtgagcctccttgtggaccctcaaatgtgggaaggagataggggcaggaggaattggggaaataggaaccttagaaaccctgaagaagtggaaagagaaaaggaaggtcagtcattcattcaattgcttaatttgcttctttctttttctcttcttctttctctctcttctctctctctttctccctccctccctccatttcttcattcctttcttgtctccctgtctatctgtctgtgtatatctattcatctatccatccatccatccattcatcaatccatttatccactctgaatagaaacctaatatagatatacaaaatgaaaaactaggaaaatgcaagaaaccttgacaaaattgctactgtttctaattccaatacttaataataaccactgctacatacaaggacatttgtgtctggtctttttccctattccaggcacatgcattttaatacagttgagatcatattgtatgtctgattttttagcgtattagattttttacattattaagttaatacatgctcatttaaataagtcaaacaatatgaatatataagaagaaaacgctcgtaatttatgctctacctcttccctttgctaagtggcaattttggaccttctgtgaccgtgcaaacatgcagattatacatgcactataggagtggaatgtatgtgayttaatagcgtaatattttgtccattattttaaaacttgctttatttggtcaagacatacggaacacgtatagatcaaacaaaaatttttaaaaatgcttgcatactgctctgtgctgtggagtagccctaattaaatcaatcattcctctgtttatgggcattccatttcttttcaattttgatattattgttgttttagcccttatgaatactacagcaatatatgttattatatactgctggttttaattttgtaggacagatgggatttctgagtcaaaggtcaggtgacataattttgtatcctgtggttttacttaacactatgcagaacgatttcctcgtattgttgaaaactcttggtaggggttttttttttaattggctggaagcacttcatcatatagttgtaccaaartttgcttaacatcccccttattactcagcctttgggtggtatccagttctttgctttgataaataatgctgagatgaacatctttctgcatggctctttttccttcttttgacatacttggagttctagaagtggaattactgggtcggaggtcacaaatggagaggtcttttaaatctcagcctgcaaacaatcccactgcaggtttaggctgcatgtttcatccatttgcagctgtagcattttacaaaccacagcataaaccctaggaataattctgttccccactgggatagagcattgttattaatataattttacaaacatcattcgtttgaaagctttatccagcctcaccacagctcattagtgaaccttctgacaatcccggggcagtttgtggattctgcagcagacaggttatcgtgtgctgaagggtaccgcaaggggaaccttccaacatccccaccctacccaaaggatgattcctgctcacaccagccagctggagacattagagcattacttctcggtggcaagggagggactcttgttctttctggtggttcgttttcatcttcaggtcatgccctgtgtcacctgactcaggcaccattagcatctggggctgtacacgtctttgtactgcacactgtagggtatccaggattcctggccctgcccsatgatataccagcgccatgttgtcatcaaaacraccggaaatgccttttgtgtctccctacttccctttttaacatgtcagcccttggtctcgatattcacatctatatttttccttatcccgttaatatatgttatctaaatatgtgccatctttgtttatgggcttttggtgtaagaactctctgagaatgcagtgattcttcactgggattggaagggatcagaaggagggaaagtaattagcggggcctgttataatggggttggtggggttatttgtgcttttaaagtagaatatcagggtgtttaaaagccaagattctggagtcagaaggcctgggttcaaatcctgacccctcctcttgcaagcttgtgacaccgggcaagttattaacctctttatgcctttattttactataaatatgggataattatagtttttactgcatagttttgttatgaggagtaaatgagtcactatttctgagacacttcgtgcctggcasagaacgagcactgtgtgtgtgttacagaaatatatgtgggtgggtgtgtttctgttttccgtaattccagctaggcaaagacatatttaacaaaarccttctgggctgatgagcatcctcagaaagtaggctgagggagctcttttaaggcagcaggactaagaaggtaaagacatgtactaggcgggtcagcatagtggtggccctcgtctgacacacatatttcaggaggggtcacccctsccgtcttccatgttggggtgctcttctctggcaacccactatgggtactccactgctggccttcatgcaggtggaaccacaccgggaagacccaagccgaggggagaaggcgtgagcagagcaggtggcaggcaccatgaggcagggctagccttgcccactgtctgtggctgaccagctagactcttttccttttcttgcaaacctaatgtaggtacaaggtcaaggctccctgtgaggcttgcatagcaccttcaaccttctagtctttgtcctcccagaaggaaaaaaatgagaggagggagggacacaagaaaagaagatgcattttgtcagccaccgtgctatgaaatgctagcgcagatgacgttcagaactgccctgtgagcagacataaaagcttaggctcaaagagattaaatgtcttatttctgcttttggaagatacacattttatttttttctgtgtctctgaattggcatccaaccataatcattgtgctaatttactgtattcttactctccctctccagtgctgtgagtaaatcagtgtgttccttatacttaataacatactaagtggcaataataattattataacaaatgtatcaaataactatgtgtgaactctgcatgtttcagcccatttaatacccattacctacggaggtggtttctactattgcacccactctacagatgagaaaatggaggcacaaaaagttaaatcatctgccctaggtcccagagctggaatttgaaccaaaggttctgtgcctcccaaatttgtattcttatctctgcatcacactaacactgtcactcagtccttttctcactgctctggtctctatacttagagcttcgagacctgccactcagatgactccagaagaaaacacgctttggtgtcgtgcttgcctttgcccttgtcactttctcaactctcctcacctctgtgactgcatctttataactctcctttattagtgcttttgctggaggaggcaagcatgaacattgtcaaaaggactcaaaatggggaaaagtggcagcaattgccagcacaatcactgaaaaatcttctgaatggattgtaaattaaaccctcccccaaatgctcagaactgttgaattgactaattcaaattcattgagtcagatgcagttagtgtaacagtctatagtaacagtgtagactattagtttgtagagtccacacagaagagtccaattttctttgcacaaagagcctaccattcatttattcaacaaatgcttttgaacacccatcactgtgacagacagtggcaatgcatgtaggaacaaagtgtgtccatgggggcagagacctggaataatcagtcaccatgtaaggaaattcaccagaccaccaatttccacgccttgtatgtttctgttgtctttgctgcagactgaccaaaagcacaagacaaactcttgtccacttggattttagcatctttccctgaccctgcctctgactctggtgttgtgcacccactctgcaactctccaagctccagccctgtagtgccagcctgtacctgcctctcctgagggtcaatatggcatccagccttggtgaagtctcccaccccgtggtgattcatatctgaccctgagaattttccacctttcccagaagagtgggagtctaggaagacaaatagccaagataggagtttgaagaggaggcaccaatggcaatttgggttgttaattcctccagctaatttagttctgatttccccatgctcttggcagtgagacagttggctccagaggaaggtgataaaaaggaatcagtcaaggaacaatcaagaacgtgttacttttttggataatcattggctgtagggattctcctttacattttaaagagggatgaggttgagtctgtccctagcactgacaatgaaacatttatgctgtttataaaaatcaggaaacacacaaataatttgmttaacgctcaccttctggtccttttgtgatttgagaggtcttgagataagaaaaactgtggatgaattttactgaactattgaattgagaatggctgagggggagaggccccttccctctgtgaaatatagggaaaagttgtttttcttttctcctagtttcagaatacttggacttacagtcccaaatagcatcatttcctggtgaagccccctgaaccagacaggaaactgcctctcttcaataagagcagaggcagtctcaataaaaaacaaaatttcaacccatcctccgctttggtggcaggcagttcatcttctcacctctacttatttacagtttgaggggaaaaaagaggtaatacttgaaagtgtatttgaccatattttctaactgggagacaatttttttctttaacaattacttttggacatattacttgttagttaaaggagatgtgacacctcctgcccccctggccagccaagatccatttgtcatccaggtagcctcagaacggattgagagctcgccgcacagatctcatgtcaaagacaggcgcgtctgtctttcacggcttgggttgtcaggatgcagggagggccttttgtcaaacacctgccgatgagcgtttggcagagcctgtgctaagacatcatagatttccttctgtgttgtcttgagagcagagaaggtggcaggttaaagggaatcaggaaagaaatgagagtgaggataaacgagagggtgtggttctcagggtagaatgcatcggacactgcctagtgtgagaagggactcatctgttttctaggaagtactataaaaaagataaatttagtgctcagatatctgaggcctgatattaggaaaaatacggtaaggcatacatttagaacagatgccatgtctgtgtgtgtgtgtgtgtgcatgcgtgtgtgtgtgtgtgtattattaatatgtctgctggccttgagaaggtacattcagagaattttctgaagtctttttcacatggcctgtattgtcaaaaaatgatgttgggtgttttctgcctgtggctgtgggcctctgtgttcacacagatggtcatatgttcctaaaggatacatccaggactgtgctgacttatttggggtggctgagaagagacatgagccagatgataacaggaataattcagtgtgtgcttcccatggctgctgtaacaaactgcacagcctagagggcttcaaacaacaggaatattatctcacagtcctagaagccagacgtctgagaccacagtgtggacagggccatgctccttctctagagaactctccttgctcctctcgcttccggtggttcagtggcaacgcttggtgtttcctggcttgcagctgcaactatctgacctctgcgtctgtcctcccacggccttctccctgtgtgtttctggatctcttctcctttgttatcaggacastggtcacattggattaagggcctaccctattccagtctgactgcatcttaactgtttaactctgtattccaatctaattacatgtctatttccaagtaacgtcacattctgaggcaatggcggttgggacttgaacatatattcttcgggacatgattcaacctataacaagtaatactagtaatcatctcactcctgtaaacagtacagttgccatacctcaagtatctagtatacttgggacattagtctgggaatttttctccaatcctcacgctagcatttctagtaatgaggaaactgggggtcagggaagcttagtccacatttctcaccttttctccttttctcccatcccccagccagtttttcaacatattggtttttcaccacatgctcactgcagtgaatgttcactcccaagcccaaaagtagacatgtggagtgacaggtgtcactatatcataatatgaagaatttcaaaagccagaagtgcttgagaaaatataaattgtgcagtaaaagaaaacaccctaaatgtgcagagcaggaagtagaatgactctttgggtattgtgtttgttaggggggtcattagaaaatcatagacactgagccgaaccccctgggttcaaatcccagctccaccacttacgaattgaatgactttgagaaagttacttaaatgctgcgtacttcattttcctcccctgtaaaacgggttaatatcagcacttatcacatagtttttgagaaagctaaacgtgcttatctatagtggttattattactagaaagaatrtcgtggtgcccccaaacatggatttaacaagcattgatcaaatacctcctatgcccctacgaaccaggtactagaaatccactcctttcacttgcttttgttctgttgtgtttttgagacagagtatcgctctgtcacccaggctggagtgcagcggcgtgatctctgctgactgcattctccatttcccaggttcaagcgattctcctgcctcagcctcccaagtagctgggactacaggcccctccacascscacaccgccaccacgcccagctgatttttagtggagacagggtttcaccatgttggccaggctggtcttgaactcctgacctcaagtgatcggcctgcctcagcctcccacagtgatgggattacaggcatgcgccaccatgcstggctaatttttgtatttttagtagagatggggtttcactatgttggccrggctggtctcgaactcctgggctcaagcaatgcactggccttggcctcccacattgctgggattacaggcgtgagccaccatgcctggccccctttcacttgtattttttgagaagagaaagaaagaattatgaatgaattcttctgagctgtgagtccttcctgtgcaccaggcatggatggcaaggcacgattgataatgttccctcttatctcgaaatgtccactctctctcccatgcacrgggagtcaagctgtgctcttcaaacacaaattccttctcccacttcctgggtagttatgctcttttcttccctgaggttgctaattgtgggcagtacagtgtagagtcactttgatttttctcatctccttcctggaatgtgccacagaagaaaacccacgaagtcttgagctaaacgaagcagagatgggagaagggacaaggtgggaggcggtagtggtgctgcatgggataaaaatggaaacacacacttttgccctctgtacccaaaaggaaatgtcggtggaggcaggcgttcaagctggcctcgtgtttgtggttttagacacagctttgagtcgtgaccggtgtggccaagacctatttcccttgcaaatgctctctctcttttttcrgtaactgtgttactaaagttctcttagatactttacatttcctttcacggatttccaaaatttctttctttgagaatgtcaggaccagtaggaggttcagcacgcrttgccagagaaatcacagatgactaattggaatgcctcagaatcattctccttttgtttcacctaatttccacacttacgaagtcaaactctcagttaaatgtttatctagcaattcatttcttctgagccatctgttgctaggcaggatctgcagacctcttggttgcatgtgctgggttgggtcctccaagtctcttagcacaaagtcctgatgtttaaatcctgcaagcgaattgccacctttatttccaagttctcctcgaaatccacattcttccctacagacaacggtggggttcagtgtttgcttttcctggggctgctcggttctctcaccttgcatttctgtggcgccaaggtaagctgaaggcattagtattcacacttgtgtgtgagcagctgagctaacatgcaccagagggaaaatattacttctcataaatgctcaataattatagtctttattgcatgcaaatctatattgtgacacatagtggaaagcttttggattctgtgtggaagagttgacagagatttgcaggtgaaaaagaaaagaaaaaaaatacagatacgtgtatatatagagaaagacaaaaacttgtstgctagaaacctasggagagagatggtattgcccctgggacattggactttctgtttccagcatggtctgtcgtcttccataatggcatttaattttggaaaaattgcctgagcatttggaacaggcatctattaggaaagcctatttcttttttttttctttttgttttttctgagacaggatctcactttgtcacccaggctggagtacagtgtcaccattgtggctcactgcagcctcgacttcccaggcttaggtgatcctcctgtctcagcctcccgagtagctgggactacaggcatgcaccaccactcccagctttgtgtgtgtgtgtgtgtgtgtgtgtgtgtgtgtgtgtgtgtgtgtgtgtgtgtgttttgtagagacagggtctcactgtgttggccaggccggtctcaaactcctagcttcaagcgatcctcctaccttggcctctcaaagtgctaggattacctgcatgagccactgtgcccagcctaggaaagcatatttttgaggaataattatttctagtaatttctgttctaatctaaggggtttgaggttatcttttgacaatagatgttagctaggagagataagaaatggagcaagggaggggtttcatcccgccgtgttcatttgcttggctgtcctgaaattgcgaatacrcagttgttacctgctcccgktggragggrggggatatttatttggcatcttgcaattgataggagctgagtgattttagtaggtagtttaactccttaaaaacttccagtggtttcatattctacctagttttaggtgacagctggtatggggtggggaagsrgggggggataaagatattaatttggaagcatttgattgctccattattttatcatcttcccatggaaatgttttcataacgysttgttttttaattattattattattttttgagacagagtctcactgagtcgcccagggcggcggtgtgatctcggctcactgcaacctcagtctcccaggttaaagcaattcttctgcctcagcctcccgagtagctgggattttaggtgtgcaacaccacgcctggctaacttttgtatttttagtaaagacagggtttcaccgtgttggccaggctggtctcgaactcctgacctcaagtgatctgcctgcctcagcctctcacagtgctgggattacaggcgtgagccaccgtgcccggcctcatatccttttttatggaaaaaaaaaatcgggaattagcgtgtagctattaggcgtagattcctgcctaaggtctggatatgaattccaaagaccactggactttggaatattcrtargtctctgaaaattcagacccacagaggccttaccccgctacagagaggccccargagagaggcctcacaccctctggctccactgaaattcacttcacgtttccaacttggattaaactggcacgamagttcagtcaaatgtcaagtccattttgtcaagggagggaactcattcagaagatgaactagttggtgttacttagatgattaactacttggcattaggtagaagagggctctgccaactacagttcatggaccaaatcctgcctgctgtttgtttttgtaaataaagttttattggaacacagccaggtgcatttgtttacctattgtctatggctgcttttgcactacagtagcaaagttgagtacttataaatgtagagcctgcaaagtctaaaatatttactatctgcccttttgcaggtaaatttgaggactcttgagttagacagctaattagttggtgttacctaaattttgtgaattgtggctaaatctctcatttgtctacacattcaaataaaatcatgtatcaaaggtgatgtgtgtataataagatgctgggaagatgagcaaagcatgacttcttttttttgttgtttgtttgtttttaagagacggggtctcgctctgttgcagtgtcgcccaggctggagtgcagtggcacaaccttggctcagtgcagcctccgcctctcgggttcaagcgattcttctgcctcagcttcccgagtagctgggactacaggcacctgccaccacacctggctaatttttttkgtattttagcagagacagggtttcaccgtgttgcccaggctggtctcgaactcctgagctcaggcartctgcccgcctctgcctcccaaagtgctgggatcacaggcgtgagccascgcgcccagcccatgacttctcttyatgggagagaaaggccaccgagatagtaagtggacatcaggacatggattctattaaatctaacacctttatctttgcatttccatacattttgcttatttcaaagtagctacaactgcacaaagaatgggctgtcctctcctgctactttataaaagccaagtttttgcttctagctggtcgaaggtcctgtgggagctcacgtttttctcaatyactgatgaycatttgagacataatttggagaaggtttctatcaaatcctagytggactgcagtgaaatgttttcaaactagagaagcaccaaataggccatgataaagaataaataccacctaccccaacctggcaaatgtgtgctcacccaaaagtagtggagcctcaagctcagggagatgtgactggaaaatccactgaataaatgtctatttaaaaaaatcatagcgtctaggggatatacacttctaagcccattcttcaatggagaattacttatgcgcataagtagtttaaacaaaattagtggaaaaacagggagtttmagggagcaagagatcaggtcttctgggctcaccacacatcaggtgatttaagctaaaaatggcttaaaataccgcaatcacttgaaacgccttacataaactgaccaggaatctggggcattcgcgttagagacaattttcttctcctcaagataagggatggggaattagtcatagggtatytccagataatgtagttaacacctcgtgtaatattaggtgggcagggagctctgctctcaggaccaaaattgytcctgccagctctaatagggaatgtgtgtatttttaaagtctgggtaagcactgtgagtcatttccacaatacgcctccctttggcgtgaaatggggcagaaagtgccccaaacagctgttattttcgcagtgattcattcattcattcattcattcattcatthattcatccacccatccattcattcattcactcatcacatggcaactcatcacccctgtataccagacccagtgccaaatactggggagatgtgtgtgaacaaaatctcattttcaaggagcttattgcctgctgcacattttagcctcatctcgttagtgcaagaaataatttaacaactgaaaaagatgtgaggttgtacctggtaaggtctctattgstcaaggaaaggtttagcatggagagatttctcttaaggtgcctaggtattcagaagcacccctaaaactgatttgtgtggccctatgcttacaagtggagcctttccctcatttttgctttatttcttttgcctctcactttttatttcctttgtggagtccagcccctttgcttattctcagcacaaaagaggcagtagagtgagaagaacgtgaacttcagagcccacscatcccktttcacatttgaatcgcaactctgtcattcaccagctgtgcatccttgggaaagtcacttagcctctctgagctctaatttcctcacagggccgcaggactgaggttaaggacctgctgtcactggtacagtggttgaagaaaaggtgaatgaaggaagggcctcrttttactccttgtctcacattcctttctgctacttctctttggctcaccaaaaggagacagaagtttgtgtccatggctgtgaactgccaaagagttgccaattctctacgatctttgacctctgtgatcccaggggcaaggccagcactttccattccattagacttcattctcttgtgggtgctttctgctggaatctcccaatacagaacagaaagcacaggttatggaatcagatagaccaaagttcatctccaaatttgattccctctgcatacaagttgcttacccttgggggccctgtaaaatgaccataatagtaagcacctctgaggctcactggaagaactctttgttgtctgcacagaagatctcagcactaagcctggaacagaggagacttcagtcgatgtagggcatctccccaaactgcttttattctttatgcctcactgaaacttgaatcaaaaagcggctggaggaaaaagagctttgccaccgggcagtactgctgggtcttgcgtcacagagatgccttctgctcccttcttcagggagacctcagrgtatgaaagtgctgcttacccagcagatgagatttagtccagtcatccatctgcgtggtctctgtggataaagtaagcgtttcattcaacttttaaaaatattgcaaattgaccctcgcacatcttttcttactgccggtcacctagccagcaaagaccccaggtgagatcccactggtttggaggaaggagaggaaagtccccacttgggcaaaaacaatttaggatacctgaagattgcaaagcccagctcctcacaaagrgggtggcagctggggagaagctgaatcagtagacagacaagattgtggtttaacgagttcagggacaagagaaggccccagtaacctacagaagcaactagctccttgccttctgtacaacatggcctttggagtcacaggacgtgagtttggatcccagctctgccacttagtaattgtgtagatttgcacatgttgctggacctctctttgtctcagttttctgtaaactggggaaaatcttagtaaatctagctaaygtggttgttatgaagattctgtgtgtgtgtgtctgtgtgtgtgtatgtgtacaaagaaagtttagagcagcgtgtggcacgtaatgcatattatgtaagtgtagctcyaatgtgagttgttacttgtagagaacagctatgtcaaaaccacaccaaaaacgatttggaaaggaaataatttgactggtcattktgtttatccatcaactgagttggattgatatatttttcctttggccttcaaaggaaatttgagcattcattcattcatccttttagagaaatattctctaagcacctaccgtgygccaagctttgggttggatacctggaacccctctcagtgagatcacagtctaacagcacacacccaactatgaaatatagatggactgtgaagatgaagaaaggttctggttatgaactcacagaggaagtgacggctgaactttgtaaggacacaagtggtttaacaagtttcctggcccatatgagatctcggctccgacgttacaggcagcagtgtggggcctcaccttaccttttcccacttccatccttctccacccccgttcagttcccaggctccccttgtgtgaactggctcatttctcactgcctttctgttctacagcccccgctctgctgagtcaggaggtgctactttctccatctgctttccatcgtccaaaatttttgttgatgtttcttgatcactgagttaaataatttttccccgtattatacattcagtagagtttctggagagagtgcatacaaaaacgcctaactgaatctaccacgtctaagcagatgctcccagagtctatgcttttttcccccatgccatactccccaaactaaaggatgagaaagaaccatgcaggcagaatgagatgagtagatgctactgctaatgctgtcagttctactactaccgccactgctgtcttctgctgagtatggattatatgcctgttccatatgagaacattatgcatatggtgtgatttggtcattccggatggctaaagtgtgagcatacccgtatctcagatttacagagrwgaaaacagaggctcagactggttatgtatatttctctaagtcccccagctattgtttgttgtaggttgggtaccccaggaagtagattctgcaactgagattggcatgtaggaagattactggggagtgttctaggatccacacctgtaggggaacrtagcaagcaggatggggtggagggaggattgagctgtgctgtgggagatgcgaatgctccagtcaatcccaaggaaactctgaagctggattattcttcagagatgcaaggaggtcaggaagtcattgatgtgsgctccctcctggagtgcgtgttgctttggtagggagctcgctttggctgtgggcagttcctgaggagggactcayaggacagcctagcatctgaggaaatgagtgcctcctggcccagaatgggggatctcagcagcacactacaatatccactacagtttcytgggcttgctctgaagccatgcctctctaacttcagggtatattcatgtaagtgaggtgcagggatgggggaaagggagaaggtaaagctacaaaggtaagccagcttgtctagaccgggagctagctccttgtgaaggaatggcaatgataatggttaagtcagattcaagaagtgtgttttggggaaacactccaggtagtggtacatagaatcctagcacaagatcagtgactgggtgagtttgacattgtagatgcaaatgtgtsaggaattatagttgaaaggggaaagaacatttcagtttttcatttcctgcgtcactgtttttcttatttggagatgctgttcctctcamgtgggaaaaatttggttatctcaggtggtaaagatgcctttgtttaaaatattcttctsttagtggggacawtaatactactaatttctagtactgacgcttctcatgcaatttaatcagtaggaacctgtttgcatgttcatttgaggaagtaccaaagccaaaagtagcttcgaggtttggcacctctgataaagttacagaagtgcagtgtgagcaaaaatcatcctcttctctgttcttcacctgttggtgaacagtgagagaccaaggtgagagactcggaaattacacatgtacattgtatattacatgtatacaacatacattgtgtattacacatatacaaattacttgtcataacgtgcagatttcacaatgagagaccaagttgaaaaatgcttaaaattcacaagtctatatcattctgtcctccaggtaccccaagctggtttgggtttataccagtttgaaccgagggaccttcagctgaggaacatgtgctctgtgtgctggaagctcctggaggccccagggttatctctgctcacttaggtttgtgatgttgggcaaaaggagaaaatgctgagtctrttcggacccaacttccattaatgcctgagaaataatttaaatcgcaagatttccaatcccataagcagccctagcctctcttctcctgatactccacatacccagtctccattccttcttcccccaccctccagttctcatcctgtacactacctccagacccccagggattcagatcctgtctcccccaatgagagacttttttttttagggggagccaaattatttgttacaacatgtagatttcacttgttgtagagatgttctattttcaaggatacagagctcaaagggagcacaattccctggagagctagggaaataatgaagtctaaggtctggcagatctggatctgaatcctggcaatgcatttcgggagttcggtgtcaccctgagcatctttcaattccttgaacttcagtctcctcatctctgaaatggggttattatctacctgcagaggtgctgcagtattaactgaggcaacgttgcamcgtttctagaatgatatttagggctcatattgacccagtaggaagtatagttaccttgggccaggggagctacctgagtggagtcaacttttaggttatagggaccaagttgaaacatgcttaaaattcacaagtctgtaccattctgtccttcaggtaccctaagctggtttgggtttatacattcccacagtgcctaccacatcccaatggctttatgaccttgaggtcctgatctgttttatcatagctcttgatcttcctcaaaaattcttacagctgtattccacaggtcatcaccaagggactgctagaactggatcatagcagcttccaagagctgagtgtgtacatttcctcccaactctgcattcagtttaaattgcttgtggtgagagtattcataccatgggaattggcagacactgtgaatcaaacccaccccctgcactgcccccctccagtgagcgagttcttgaacacttactggtacaccactgtcaccaaccctgctttttrtagacatgtcctttaagcaaagcaattcatgggaaagtaaatttaattatcagaccatttcattagattcctcactgccacaaacaggtggttgtggtgataatctgggcttttttgatcgctttagaaaggcagttctgtaatgacatgaaaaacatattgcttggtaatttatttatttgttcccaatgtttgctacggattgtggtgaaaacacaaacacccaggacaaagggcaaggttcatcccaccatgacgatgggaggcagtttcatcccaccatgatgatgggaagtccttatatcaggactccagggatcttgtgtcctgatataaggctctcactttccaatcagcaggaagttatgcttcccagcctctaggaaagcataggagttaaggagaactgaaatctggggcagttataaatcttcccttatgtgtacaacagtttaaatcarttggtcatctaccaaaatctgaggaacaagagcagctttagaaaatgggctgggcatggtggctcatgcctataatcccagcacttggggaggccaagacaggtggatcacctgaggacaggagttggagaccagcctggccaacatggtgaaaccccgtctctactaaaaaaaaaaacaaaaaccacaaaaattagctgggcatggtggcatgtgcctgcaatcccagctactcgggaggctgaggcaggagaatcgcttgaacctgggaggcggaggttgatgtaagccgagattgcgccactgtactccagcctgagtgagagasagactgtctcaaaaaaagagaaaagtaaagaaaagaaaagagtaagattaaaaacaagtaaagaaaataaatcctcccgctttttttgctccttcatgggtatggctgcatcctctgctcactggtttgagttattattttcccatgggcaattaaagccctggcctccactgcagttttcacatcaaacctaagagtctcaggtgccccttggtggagcaacctmactagagacattaatcatactacgggataattgacaaatgcattgtgagtgtctgatttctgtggctcaggatgcttagtagcagtggggtcaagggcacagatgacacaggtccaaatttccccacccctacgtagtagctgtgtgacctggggcaggttgcttaacttttctggacttttgattccacattggttagatggaaataccatattattataaatattgtaaatagtacccatcaaacacttaatgtgaaccagaaaccctcataaaatgtttgctagtctttgttgttgaaaggtcactatgatgatggctcaaaatcctgacctgaaggtgtgctatgttcctgcttcacttgtgctgtggacatgttcctatttatcatagtgcagttgttgagactgggtgtctagagccatgtgatttggttcagctcctaactctgtcacttgctctttgacctaggcagaaaactttgcctctttgggcttcagtccccggtgtttttattttattttatttttcaagatggagtctcattctgtcacccaagctggagtgcagtggtgcaatcttggctcactgcaacctctgcctcctggcttcaagccatcctcccgcctcagcctcccaagtaagtgggactacaggtgtgcgccaccacgcctggctaatttttgtatttttagtagagatgaggtttcaccatgttggccaggctggtctcgaactcctgacctcaagtgatccacctgccttgscctcccaaagtgttgagatcacaggtgtgagccatggtgccaggcctctcctgtctttaactggggataatgtgtgcagaattccccctaaaggatctatcatgcgtaaggtggaccctcacagaaagcgtcaaagacacacgaatctcttagcaggaggccgccaggtggcacaaaatcaaaactgcatcattgagaattatgttatgaagtcatttactgacttgagcctcagttttcctattaatacaatgagactgtagtaacttcatagggctcttgcaagagttcagctaaaattctccaccttgccacctagaacatgtcacagaaggtatcctggcccctgtatgggattcatacatgaagaggactgccttgtaaagtcatttgattagggatccagagggtgtactggtagaggacagattttcaaccccttgacagttcgaaggtcagctacacaactggcttgtgttcctcgctgacacctccctgagtagcaatgtgcatttgtgtgccttccctttgccaggcatttctaagaggatgaatcctaacaggtatggcagccagagggcaggggcagggagaagaataagatgttccttggtgtaccccattgtcatgagttcatcatttctgttaactgtgggggcagagagttccaattgcaactggcttgttgtgagactgccccggtggttgctgccagatgatccacaaatgccaagctcctcacctgagccctgccagccttcaggacctcctttgcacgaagagcaatttgcagaagagaacactgcaggggaggcaccatagaccccttctggtctgtactgttcaaaatcacatgacatccgccagaggcctggtgggaagccagggttttaggcactagaaatggagctcagaaaggaggagaaaggtccctgctggtctgtggagagggccttggccaccagagggatcaaatggcccaggcaggaaataagtatcccgctctcagatctgaggccagattttcaagtgtatgcatgattctggggtgctacaaagggtatagagtatggagttagaacattacacgtcaacaagaatatgggttttgaacccagacctcagtttgaatctgagttccagcactgccccgttgcttggccgtgagttacttcacctccwttagcctctgtctcccctccactacaataacacctgcctggtggggagtgaggatattgtgcgaatcagaagtaataacaggtcgttggcacctaagagactctcagtaaccagcagtcatcaccaccgtcgtcgtctttttttttggccattacagttgggattagactaaccctccctaagcagctattragcctcacactccctggacaaagacatgaaaaactctggatgatttggaagggagatctagaaatggtgaaaggactgscaagtgcctctgtgctgataytgtacctgggctcagtggtctggctaaaggagaggtgctggggccaggtgacaggcgagtctctatacggcaggcccaaaaaatggaggtgcaggcttcatctatactttgatgtgtatgcttccttctttaaacttgtgataatcagagttatagctgctttaaacttgtaaaaatcagagttatagctgcttttgaactagtacttgttgtgtgcccaggaaatggccaaatgttatcactcatccttccaagaamcacatgaaggttatattattatgtcgactttccagatgaggagactgaggctcagtggyttgtcataggtgtcaaagacaggagtccartgtaaggacttctggcttcagcacaggggattttcctaccatcccatattgccaccccatctgcaaaaatacctggatctatcttcctcctgctgattctcagctccctccaggactgaagagatgatattgattctcacttgatagaggttagaaagggcctctcccttccctagctgaatagagagggtttcctttttcttttcttttytttttttttttttaaatgggaaacttacagggaataagatctgtttcttcatttgctttgcaagagagttggatttgtacacgatgcctgagctggctcggttttctaaagacctaactttgcagcattcttcaagggctccagagagtcccttgtgccatcaaattaagtttggaaacttcaataaaaaagtcccgaaggaaactgtcaattaatgcatttacactgaagcatcatatttgggaaaaacatcttcaaacgcaaacgctgttttccaaccattaaaaagtttatgcgctgcttggtttccatggatacctgaggtaatagcctccttcctctcattgaagagtgaatgttgctcagttacttttttcctgtttttttttcacttttgtcttcctgacttttttcttccatccctatttatgaaaacaaaaagataactaaattgaaacsttgacaatgtaatttgtcagaggaaggcagcctgttttataagctcaggtgatttcatttttgttcacctgtttatttcatgacacttgcaggaaaaagargaattttcatttgatcaaatcatttccatgatccatcaaacacacaagttaaaaagggaaatgctctcagtctttaataacagtcttaatcgtgtgtagagcagagattgacaaactatggcctgccggctaaatctggcccagtgccttttttttwataaataaagttttattggaatacagacacgttcatttgggtagacgttgtcgatggccgctttcacaacaatagcagagttgagtgatcgtgccagacattatatgggccacagagcctaaattacttaatctctggccctttgcagaagtagtttactgacctattatatacaggaaagaatgagggcttgggtggcacttagtagtgttgtcacttttgtcattggccttgacctgactcagtctccgtattgttgagatgggaatgacgggaccctcagtagtgttttgggatataaggcacacggtaaaggaacaacaaataggaattacattccgtcgagattcttttgctagaaagatccaaagaaacctaccttgtgattctagatgttttttaggaaacccaaagaaagtatgaaaaagcccaagccaagtccttccactgttgttcccgggcctgtgtgtgctgtgtgtctttsctgggagaaggtcagagctggagtggggcactcgattccggcaagagaaggcaaacaaaagaagccacaacagtctaggaagaaatctttaatttctattcagctttaaagagtttgagagmgttttttcccctctgttaacaaacgasttcaagtacatgccttcatattataaaagtacctgaaattgcctagaatagcagcatgcatagcttgttagtatttacatatatttacatagggaaacaagagaaagatctacagttatttacagtctacataggggaagagaaaggcagcctaattgtatttcctaaaatacagtagatgagtagtcagcacatgcatatttagataatatttgcatgatagaatgcaaactttraaaaagacatacctttgtaactttctatgctaaggtgttgcataatcaaggttaatttttgtttgtttctagtctatkggcatcaagtgctttaaaatgctcactaacaccgaggcagaattatttacccgggcaattaaagcaacagcacacacgatcatttcctactaactagcaacacgctgctggtgaatgaaatatctattgtttctcattacccatcgaccactgtgaagagatctctctgtgtaaaggcagtgcctaagctatcaccattaattatggaagtaatataaatgagacactctccacagtatgttctaaatgaaatattaacaaggccagcgtcttggaacctgagaaatggtctgttccagtgagctctgtatggaaatccacacacctaactcagacatgcccgatttgaaatagcggggctggacattgggggcctacctgtgagatctgaattattgcaaagtacatcctcttaatttgtttctggaaggcagagttaagagttaattccttcccatgatgtggccccagcggagaccttgtgttttttttttttttttycttcagtgctttttcaggactatgttatagaatacttatggggcatacgtgtaaatgaactgtcaaccttaaaatctaaacaaamagcttgtttgtggttygtcctgaaatcctccctgctcacaaaacagccagctacttggttttctaaaagacgtaattttgcaggcagacttcrtagagccattctgtgcagaasaagggaagggagaagctgtttgttttacctgtagtatgaagatattctttgcgctgttagaactgagctcattaattctgcctggcaataatttcaaaggtttattttggtgtagatggcgaatacagatgcatacatttatacgcagtayacgagctagctataaccataacagaggttaaagaagtagagtaaaaatgtaaaatgtttcaaataaacacacactaaatatcttcttttatatcttataaacacccagcagtcctttagcacgggcatcaaggtggcccagytggaaaatttcagtgacatgccatcagatttgttccatgtagaaggacgacactatcagttagatgcttattttgttggcaaatttctatggcacttctgcttggcyayttcaaaccaaccatggaagaatagataccccaatgcgatgtttcatccctattcataaagaaactgtactttgagcaatgtaggtatcccaggcagcatcagagggaatgcccagggaattcttccatggatataagacatcatcaacaataccttctcttagttctaatgagacagcctctcaggtccggtcagttctagaacgctttgggcaggcacaaatggaagatggaacaagtgtgcatgtaatgacccacatggattgccttgaagccgtttctttttccttccctcgttaggagtaccctcaccctaaccccagcaaagcatgtctagggtctcacaataayagcaggtctcagaaagataaaataattctgaatgttacaactcgtcccatttaaggctagacataaatctatcacagatcctttggaacatcgatggcaagaattctggaacacgaaggaggtatgaaaagggcttcactcgtttcatggaaaagctcagaacagtttgtcgacttggaaacacaggccctgasagygtaccmaggtcaccctgcccttcaatcctgctgatagcccaagttaacatcctcccatgccttggccttcccagaacaaacatggctttggacgcctttgggtggttgggactggctgcctatttttytctaaaacttaagttttaggaaagaattctttccagctttccatcctgaacctgctggtctccaggctcgttcctgcaaatatttcacagaggagtaagagccacattcttgctggctttccarttcattctcctctcttcgagtccacctcttaaaacttcttagtgctcttgcaagaaactcatgtcttttgtcagggagaatggcatggcctttgtatgacacttccttctagccagactcggatttgggggcatcatatttgggatggctgcaccgyaaacaggaaaggccacaggacagytcacaggttctctctgaacagaagcctgtgagcacgtgcctgtcatttaaaagctgcatggcactcttccccctgcatgcgtttctctcaaggtgtcccttgtaatttgtggttgtggtctgtgcttgaacctgttgcatttatggtgatggactggcactttactctctctgagccacggccatcaagcccctgtcatagacactgtcccyagtgtcacctggggaatgacactcttcacctgtcatgggagaggcaactgaaaaggagcctgaggtttttctacctttgtgaacctgttgctagcaaagaaatatttttccttgtggcaaaagatcaacatctaaacacattgtccacgtctaatttgttagggagggcrtgttctcttctggagggctaagagttggcatgggatctaaatggattctccagaacactttctcacacttctaaagcctgaaaacaaatatttgctttcctgatcatcttcattgtttctttttgggaaattgagtgcattcctcttctataataaaggttaagaatagcctgtgagttagcaaaactcccaaaggtttatgaagaaagttacatttcaatacctacaggaagtatttgcatgtgtctaaggctggattgttgaaggcctttgtgggagtcagttgtcaggaatttgtaggaatgactgtgttaggaatcattggaggagagggagtcagagggatggatcagtattttctctgcaaacctgatgaaacactccagagcccgcacctacaygcgtgggaactgataagatgggggttgtgtccacttcacttgtatgggatgtcggtgctttgaaaaaattctatcatcaaagagtaggtttcttagttctgcaaatctggcacctggagatggcattttgaatcggacgacctttttagtaagggtcacttgctgttggatcatcgaagggggtgctgagtcttcatttttgttcatccaaatggatatcatttcaatttagctccatgagtaaatcaatggaaaaaaaaatctccttttaacatttctcgggtgaacacacgacagcccccacatttcattttaggccatgttagggcatcacctcatggccagacatggcctggctgagaaggcggcagagcaggcagagaggcataggaagccggagccccgtggaagacatagatgaggaaatgggccacgtgcaaatatttgtgtcacatatttggggagcaggtttcatgtaccaacggacacggagtctgaagtcactcactctacgtaattatctgtatggctttggacgagttgcttttgatctctgatatcaggtaggcttctctctaaataaatggaaatactaactgtccctggctcatagarctctgtgagggttaggcaacaatgcttacaaagctctccatgcagagmctggcaaatcgtaacctctcaataaatgctagtcattgatgtcacttgaatagtactcgttggctacaactcactgaaaaagccgggcagtttgcagggctgaggactttggagtagacatctctgttctcgtctgctgcttcccatcattttggtggaagttggtgtgttsgttggttagcacttattccaaattgaattgtataatttcattatagaagtatcacggtggaagaagagggtgacttactggtgtggtcacctagccagggaggcctatgagcctcattcctgtataggctgcattactttatgaacaaatgcaatttgtggcaaatgtgtcccctaaaagattgctcttggatagtgagtagggaacaagtggccttttggagcagtttgctttcatttgtgtttccaatgagagattgaagctgtaattgtttgtgaggaatggctgtatcccaagcaccgaggtatctggagatgacctctgcactgttctgggagagtggttatagcctctcctgggggagtgttactgggagacagggaaagacagggcgtgtrgacggccatctattccacctgtgacatgagggctcaccccctcatctccaccgcagcagctctctgataaatgtagctctctgataaatgattctgttcctagtggtgtattcacagagtcagtggataaggtggctggctttgcatttgagaagtatttgctttgtccaacagacaccagatgagtaacaatggaagtaggcagggtttgaagaggtatgtgtctttccttttagccaaacctgctcacttcagatcaccactttgtcctgggacgttagtcatgggaacactgccgtcttcaaaagggctgttctccttccctgctcttggtgttccaagcctaatctaacttccagggttcattcctttcataactctactttttgcataagtggattaattcagcatttgctgtgcaatgtccctgtaagaaagcaatcttagaacatctactctctcacaatcattgaatatatagatatgccatgatattgtgtctattttttatatatctcatagttaagtctactttaagacaggaatctcctctttcttttaaatgagcatgcattttaaaatagaaaaacctgaaagcaaaacacggtgtaacatgtgtccctgtgagtattatattagagtactaaccaatgcattacaaatatcaatatgtgggtgcttttttttttctttaccatatattgtttatcagaaacctctgtaccctttcctttaaaggagtcaatatkcatttgtattctgtgctgacaactataaattgatggctagcagttatcaaatgaatgttgatgaaaagcagctacttaacattttcatcccaacaccgagttttggaaggayggataatttagatctgagggcctcaactataaataaacagcaactgctttctaaatcccacctttctgtagttgaagattgtgctgcaaatctgacagatgatttttgaaagagaatgatgaatccttattaccaagatactcttaatcccaaacaagagtcctgggtaattttacatatactctcaagattgattgcacagttctcctctggcagctcacaaatgtttgactagatcggaaatggcattcgggcatgattaaaaagattctwctgggcttcccagaaattctcagtcctgtgtcgtcaacaacctaactcattgccattgctgcgggatagacacctcccccgtttcccatgattagcaaccatatacaacctacaggcttctgataaatgattgattctcaaaaaaaaaaaaatcgtttaggggaacccatagctccagccagtgtttgtatgtcaaggtattattatttatcacaatggatcagtaagcattgatgacaactggcaaggtattgcttcagatattttataacggagttgttaacattatttcctttagatggctcyttcatcttttctgcattatgaactgatgccccaaaaggtggtatgaatgaaagtcatstgatggtgattaaagtgctctttaaatttttttttttaatcagtttaagaatgctttctcttttattggcagtacctgcttgtttactattgagatttcactaatgtgcctcagtcttattctgatgatatgtaggccgaaaagctggtgagccaaaaatgagaacctgttactaaactgtcatcacatctgatcatattaagatgtcactcagaggttgccattggtacggctgaaaattctccaagagaccaaaggtgtggtgtgtrtgggaccaacaagatattgttactgcttaattgtccagcaagggaggaaagtagagtgagtacccatgagcaccaagcatgaatctgagaaggagaatttgccaaaggtggacgattgatttttggagtagagaaggtcgtctttgctttcgggtgcccctcctgtgtactgtgttctacaaagccagagccacttgtgatggaatttagatggtaaatcaccccaagcctagtggcaaaggaatcaaagccatctcctgataaaaagttaggcttttcaaaaaggtatggctctcagcattgtagccaaatgtaggttggcatgaaatgaagccagttgtaattgcctttagattccgtggaaggaaaaggtaggtccccagctcctgcaacaatggcattctgaatcaatgggactgcagaatttcttagcaaaaataccattccagtaatgcaagagtgcaacgtggtatcattacagtaggtcatagtggcaaaatattttatcaggttaggaagaattctgctttttgctttcccaaacggactgctttggtctttcctcacgcttggcagaacagtgaaaggccagtctgtcatgacgtttgaatgctgaatagtataaccattgtggcatagagggcgggaggctggacttgaaatgggtgagctggattctcccaccactcgggagttaatggcaagtcacttggccactctggtcgttttggcagctgcaaggtaaaatgaaaatatatgacagatatctggaagttgatacaaaacaccatctccaccagaactctaagattccaggccaaaataatacttggcttgagttagctggatgagcatctcaattctccaatttgtctttagaggcacttctgcttcccttttccccacatgggatgcagaagagccagataaaccccttgaagttgtttagataaatgtgccaggtgctaagctcagggttattaggaataataattcagtgaaaggaaatttggatgacatgaactcatttccattakacttgagccacacaaatcaatgggaaaagaaacagytgaatccagsataatatctggctatttggagtgggcatgataatggagggagattggggaggtaacaaaccagctactattaagttcaagtcatgtcagttattcaaattcaggaccagtggaacttgtccagtatcatcaagcagccagttattatcaaaacccaagtctttgtctcactcacggtccacaccccgcccagagtcgtatcacttgactgcatttgaccattcagttttcagaccaactccattgttactagatatcctgacactgaagaagctaaaaccaaacarcaatgacaacaacaaacccaagtctgccttatggcasattcttcacrtcgtaacaccttccttgggaccctatttctcagtatggacctgactctcccagggatcctagaatgcaagcatagtgattgcaaaccagaccatttgagggaaactcctcyagtaagcaccctgcatggtcacaatgtaaaccctgcaggggcagaaaaatgataagctttgggtcgggtcggaaagccatttcccccacaatcaaagttccttagtgttttccttgtgggggcgagcttatcttcagttaccttttccggtcctctcttgcaacccctctccctctcatcagctgaaaattagtggatgcagctagggctctgaaacacataaataatcataagatgccagataaactgtattggttttaaattagagacgtgccgaccatgtctccctctgaacagcagcctattatttttaattatggcttgcaaagcaaagtgatttcttgccctctttatagcatccctgacagtattctgtcagtttggatgatatgatgcctcatcactgcacacgtccctagccacagccscaactgttactcaaaaggtgaatgaaagtgatcagctgcactctttgcaacttacattttgaagtgggctgggaggaaatgtacccccttacctgtggtcccattgtaaatctgggtcaaatatgacatttagaaaaaggttttcatgggatctggatgaattaatgtgttatgtgtttgtgctaagtatgaatgtatggtgaggagtgtgtgtgtgtgtgtgtgtgtgcattaaatgttttaacacaacattgccaacccttcccctagcagcaccgtgggcaaagcataaagggatgatctggcagcagccccacttgggttttctacctgatggaccacaattaagagtggttggtttgtcagacagaaggttctacaaacgatttggtatcgaattacattatacatggagaagtygaggggttggatgaatttgttcttgcacgttcagaaggataccatctttttctctgtgtggaagaggcgcctgccacgacgtattgatatgtgtatttattttccaagcctgtccctgtatgaggtgtcaaaagttacaccagctttacaagcggagtttatgaactcgtttttccaggatagtcacattatactttttacagtcatgtgctttcagcccagtaccctttgctatgccaagatccagctgaaactgaaccaggtgggggaggcctgctaatgcccaggcagtcraaatgacgccatctcatcactccttytcttaaaatttttttttgtctttctycttggatttccagcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtcyggctaagtggagctcagagcggatgggcacacacacccgccctgtgtgtgtcccctcacgcaagtgccagggctgggycccttccaaatgtccctccaacacagatccgcaagagtaaaggaaataagagcaktcacaacagagtgaaaaatcttaagtaccaatgggaagcagggaattcctggggtaaagtatcacttttctggggctgggctaggcataggtctctttgctttctggtgstggcctgtttgaaagtaaaaacctgsttggygtgtaggttccgtatctccctggagaagcaccagcaattctctttcttttactgttatagaatagcctgaggtcccctcgtcccatccagctaccaccacgrccaccactgcagccrggggctggccttctcctacttagggaagaaaaagcaagtgttcactgctccttgctgcattgatccaggagataattgtttcattcatcctgaccaagactgagccagcttrgcaactgctggggagacaaatctcagaaccttgtcccagccagtgaggatgacagtgacacccagagggagtagaatacgcagaactaccaggtggcaaagtacttgtcatagactcctttgctaatgctatrcaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctaygcttaataaaagaacatgcttgaatatcatcacctgaagtttgtattgtttctttaaatgtttgtttcagtttgtttttgtttttcattttttagaaaagaaatctagaggaaaaataaagcgcttctaataaagcgcttctcgtagatgccaggaaaacacgattcttgtttcttctctgagtgagtttgtgttttgtttttgtgctttgtggctgtccgtgggccaagttgtctcacgcgattagcatgccagcatattttctgttaaagaaagaaagaaaaaagaaaaatgactattgtttcatttcaccttaagatgttttgttattacttacttacagtgagttattttagtcctcaatggtctgctcccctgcaattagcaagtacttagtgattgattagcgggtatctctatgtttgagaatgggagctgtgcagaagctcttatctgcgcatcccatctcatggacaccatgctttccagcccgttccagcaagcacatgagaaagtccactctggcaagacggagaaaatgcttctgctgaaataccaggaaggtgtggaggctgggtgtcattgttccccctcctgatcatggcagcttcaggccagacaatgtcttgaacttctgtgcctctgcatctgtggtgcagagcagtcgaacaaacaaacaccattgccctccagtggcccatagccttgccacatcctcccatctggctatagtcttccttacgtaatccttattatcacaggacctttgaaactatgaatcagataatgtcacttttcagacattattgtcatttgcaaaagcagccgtcagaactccactctcagaatctacacctggaggggatcacccctcccatatgacctctgactttggccatgtgactggccttggccaatttggaaagtgctttgcactggggcttgcctttccttgttgatctttggaaccctgcaacttccatcatagggaacggctcctgggctagcctgctggatgatgagagacacgtagtcactcccagaaccggcatccagcagttacttagttagacatgtaagtgaggccatcccagactatccagccccagctgtgccaattcagaggagaagaaactgcacatttcactcacagcactgcaaaaagatagtaaaagtttattttaagccactaagtttcaggattacatgttactcagcaaaagctaactgatacagcttctcagctcactaaggttaatttttttctaccctacttctcttataatttggtctccagctacctctctaatctcaacttccagcactttatccactagaagccactctagtcttcctctgttcctcgaacatgccaagcacactcccaactcaaggggtgcatatttgctgtttcctctgctgaaatgctttccttccagaaaccagcatgcctttcttcctcactgatttttagtctctgctcacgttatccctgtcttcatggtgtcaccccattcttattccccttcccctctattttttctccacaacacttaatattattgtacacattatgtgtctattttttctgtctacccactataagaaactccatgaaatttgtctgttttcttcacaacttggccacagtaccttgaactgctcctgtcacacagcaaacttactgacttaataaataaccactgaaagaatgattctgggtgactaggctttatgttcaggaaaataatttccatcattgtgacaatgatcccgagccacacactgtgctaagcaggctacattaccactgtcgcccgggctgcagtgcaatggcatgatctcagctcactgcaacctccacctcccaggttcacgcgattctcctgcctcagcctaccaaatagctgggattacaggtacacaccaccacacctggctaatttttcatattttaagtagagacggggtttcactatgttggccaggctggtcttgaactcctgaccttgtgatctgccctcctcagcctcccaaagtgctgggattacaggtgtgagccactgtgcctggctttttttttttttttttttttttttttgagacagaatctcactctgttgcccagtctagagtgcagtggcgtgattttggctcactgcaacctccctccccggttcaagcgattctcctgccccatccttcagagtagctgggattacaggtgcccacaaccacacctggctaatctttgtattttcagtcgagatgggtttgaccatgttggccaggctggtctcgaactcctgacctcaggtgatccacccacctcagccccccaaagtgctgggattacaggtgtgagctaccatgcttggctattacatctgatttctaatatgactacagtcttgccagttcaccccttctccccattttactgatgaaaaagctgaggccaagaagtgtcaatctgctgttgtccatacagctcataaattgatagagctgcagttcacacccaggagtgtttgatttcaaggtcatgcagattgcctgcaccagtgccactgctccttccataagttgactatatccattctggtaggatgcaccatcttttttccttttaaacagagatggggtcttgctatgttgaccaggctagtctggaactcctggccttaagcaatcctcccattacaggcatgaaccactgtgcctggccatggatgcaccatcttaaaatcttaggctgatcagagaggtgactttatgggtctgactctagttatgcttcaagcatttggtggaaatgaaagtaaagccaggagaaagaagatattggcgtatcatcagccaaggtgctgtgcaaaatgtcaaagagaaccaagagaggacatgctggcctcctgcctcctggccgtgtctagggcctctatgctgacttcctcctctgtggatcctgcagggttcacatctgcaggctgacaagatgaggcctgggggagctttctaagggtagctgaggattctcccaaatcaagatttccaagtcatatagaccaaggcttcatacattcattcatttaacaaacataccaagtgctacatcctggaaattcaaggtttaaagtaaacccctccacagcctctgctataaaggaatttacatcttgggtctgtaggagtcctcacaaagcacaacgtcctactccactttatcagaagttatctaggttacttgaagatgaactgaggccccgtaacagtagcgattgccccctcatgcccatttctccctgaacccactcagtcagacactgtcagtccccatgggccattttctcttgccagacacatcaatcttatttccttggctatttctgtgataaattcttgacaggtgagcaagtgcatggcataattcctattattcctattttagcttattctatggccaaccctatttctccccatttgtcatatgtgcacatctgtatatgtatatgtcatgcacatctgtatatgtatgtcgtgcacgtgtatatgtatatatgtcgtgcacatctgtatatgtatacgtgtcatgtgcacatctatatgtgtatatgtacatgtatgcatgcacaaatatgtgtgccatacatgtaaaacacaggcattatagatgtataacacatatatgtggcacatgtgcatatgcacatatatgtattgcatatatatgtgtatattcacatatatgtatacagatgatccctaactcatgatggtttgacttatgatttttgaactttacgatgatgtaaaagtgatattcagtagaaactgtgcttagagtacccatatgactattgtttcttcctttcagtatagcattcaataaattacatgagacattcaaccctctaataaatcaggctaagtgttaaatggttgtgttaaatgcctttgtccaactctaggtaaacttaagttttctgaacacattaaaggtaggctgggctatgctatgatgttcaatacattaggtgtattaaatgcatttttgacttatattttcaacttactatgggtttagacggtaaccccatagtaagttgaggagcctctgtgtacatatatgtgtgtatttgtagtatatgatttatgtaataatgatcctactctatctgctacttttttttttttttttgagatggagtctcgctctgtcacccaggctggagtgcagcggcacgatctttgctcactgccacagccacctccggggttcaagagattctcctgcctcagcctcctgaatagctggaattacaggcacccgccaccatgcctggctaatttttgtgtttttagtagagatagggttttgccatgttggccaggctggtctcgaactcctgccctaaagtgatccaactgcctcagcctcccagagtgctgggattacaggcatgagccatcgcacccggtgtcatctgctacttctaatttcagatgctatttactgagcatactctgtgccagttgatgggttaggcaaatcactttatgctcataggatgaaagtgagttttagagagaaagtaacctctccacagtctcatagctggtagacagcagagtcaggatgtgaagccagctccatctgccttgaagcccatgggccttccactacacactacttttatgtgtggcctatagactagaagcatatatacattacattcatacaatgggtgaattatctgcaagggaagaccagttgatttcctatttaagaatgagctctggctcttctcctgataccgaaatgtccagtataaaccttacaaatcatttttgtacatgccatttatccagcaatattggcttcagccttgcctacatttctcaataggccctctctcctgttctgactgtaagttggtctgcaccttctcatggactcaacatcccgagttcttcgcgctcatctgatgctacagaatccacccaaacaggaagagtaggccagtttctctgcagtcgttttcttccaagtccctctctctccctaagtttctttcaactccaaaggtggccagtttccactttcacacctgattaagggagaccttgctgcaacttatcaataggaaacaagaaattgaagcattccccagcaatgactgaaggctgtggcttgtggttttgctttttaaaatggggttatgagtggttttgttttgaactccagtgaaggaggcctgatgacgttcatcaaggtcaacactaggccagaaagacttggcttgcaatatcactgcccattctgttcaccagcaggcaccatttttagaagcttatgtaaaaaaaaaaaaaaaaaaaaaaaaaaaaatctaaaatagcaataccctgtctattaactctttgtgtctttcaatatatccaagctagtttagctgaggtcactttagaatactaagtaatatcacaaattattattcatataatcactgaacaaacagctctgagttgtatctatagatgttatgttattgcctttcaaggattcatggtatttggcttcatgccccccctttttttcccttcccccctcaaagtcatcttatttctcaaagttttccattattttaatggctacctcatatatcacataggtgatgggccattatttggaaacccattcccctactgtgggacatttaggttatttctagtttctgttagaactaatggttcaattagcatctttatgcatacagctttttccttctattaattgatctcctcagcatacctttgtagagcgtagaactggagttccttgatccaacagctcctactggcctttgccacagagagccacaatgctatctggaagggttacacaggcagaaccagcatattactgtttgtttacaaccttatcaacacagggtgttcccactgataacattttaaactgattttcacattgtcacaacctgtaactatttatatatggtattcccaagcag
